United States Patent 7,365,185 (GENOMIC PLANT SEQUENCES AND USES THEREOF) - sequence listing, part 53

SEQ ID NO: 67553 - DNA, 53102 bp, Oryza sativa
gccacccatcgccgcgctcgcctgccaccctcccatcgccgctccgcttgccaaccgtcggcctccctcacggaagaagagaagagaagagaagagaaaggaggaggaggaggagaagaaaagagaagggaaggaatgtgcagctgacatgtgggccccacgtactttttttattattttttttgctgactaggatgtcatgtgggccccacatactgcctagggaccttaagtgaatggttccgtatagtttaggggtggagaatttctagttttgtggttaagggacgtcaaataaatctcgatgttaagttgagggacttccggtgaacttattcctaacaaaaatatccaattttgttgggccaaattgggataggccggaatccaatccttcagacgtgaaagattgcagctcatctaaataaggcccatccttcctagtcatcgcggctaacgtttcatgcaaataatgtcttccttcatcctgtaatcacatttgcttgtgttgggagacttggagccggagggcgacggtcgctgaatattatttgggcatcagaataatttagggatcatgcatgggacaggtaaaactcaacaacaaagttcaacctgtatggtgttacgatttttctaaatctatgacaagcatgacgtccagtctatactttattgaatagaaataacttatctagattaagagctgtgatgccattagtcatggaaaacctacaacttgtctggccaaagatcataagagagcctattctatatcatcgagtttactctaattcaatgatttgtcatcgattttgcctctctctattatataccatgactctgtcagttttttctacaatatgcattgggggtgaatacttaaaaaaaaacttcaaatatccttcaaatcatagaagggttgacaatttataaacccactataagttccaaaaaatgcgaaagtttttacatagcctttttatacaatatatgtaggaaccaaagatagatgcatatgaaaaataattgtgtattgcatagcacgtgaaagatggtttacataaaagaacatcaacaaaagatacttatattagcataaaacataaacaatattttcgaaaaatgtcagtgtaaattgaaaaccttgaaatgtgcaacacacttctatattttattagaaaggcatgtgaaagctttcatattttatcgatcttctagtcgatcaatcaactatcaacccttctacatctcgaagggcatttagggcctgtttggcagggctcagctcccagattcaacttacctggagctggagtccaaccaaacggtccaaatatgttcaaagctggagcggagcgcatggaatcgctctgagaaattgaactggcgggttggagcggcattttggtcgctcctgaactccaactccaaccgcgttatagaattgcccatatattttcgatgaaattacccgcaaatgccatcgccctaccccccatccctctctcccgtaccgcttcaccccgtcttccccgacctccagctcgcgggagcgaggaggcgaagcagcagacggcgcacggtggaggaggaagcggccggcggtaacgacgcaccggctggaaatagccggcgcatgggcttcccctttcactgtcgctcccctccttcccatcccggcgcacaacggctgagggcgagcacggcggcgcatggcggctaatggggaacacgggggcgcacggtggctgagggcaagcacggtagcacaaggtggatggagacggcgcacgacgaccccaaatagcggcacggtattttctcccaaaccctagaaatttccctcacctcttcccttcagatttggttgagtagttgttatcatgcaatgagcaaatggggaagtttcagatctgaagacttgtctagtgatgaatggtaaaaatgcaatgagcgattgggatgtgtgaaatttcagagcagtgatgaactatatagtaactttttttttgtttagtgttgtaccttgtgtttacaattatatacacacttggttggaattgagcaaatcagcaaatggttatatacacacttggtttataattctttagtataaaacctagcagtggaaagaatgtccttttataggaggataattggattgggggcatacccctggctgagcaattgggagaaaaagaatagggaattcactatgaaatctttctatgatgccatgagaatacatggactgagggcctgtttagatccatttggaatggcaatttgcaaaagttttgatgacaaaagttttggcattgcaaaagtactagttggtgtttagatgcatgttaaagttttgccatttctagcactaaagtgagagagagaaagagagagggagtggtcccaaagcactttttggcacaatttgctactatggactagcaaatgctaaatgccaaattgccaacttttgctactagtgtttagatccaaattggcaaaaagtgctacaaaatggcaaaacttttgccattttgaaggatctaaacagggcctgaacttcccacacaaaagaatctagaggccctaaggcacccctgaaagtggaagtgtccatgtggctattaaaaacacagcatactaacaaaagatggtccaaaaaatggggttggaggaaaggaagctatgactttcaattctgtgatagatttgaagctatacaatatctttttatagattgtccttaattgattcatggggtgttttgctgacctcaatggaaagacaagtcacaagtgagattttcaaatcaagatttggttagagggcacccctacgaaggattcaagattgaactaccagaagtccctttttttttgccgtcatcactgttgtccttgctttcacttgttagtttttcagatatgtgataccgagatgtttcgcaaaggttcagttggatgtaaagtagcagcacaaaacttcagtgggttatgagatgtcggtatgactgagagactaatactattgttggtttttttgcttggagctgacctggacccttgcttgcaagcaaggccttgaacttattcatcgatggatgcattttaccttgtatacgcagcacggcgacagcggcggggtcagagcacggcaacgacggtggtgtgcaaggtttccagatctgtgtggaaggtatctgcactgcaacgacaggttatagcatttcattttgcaggttagcagctggtgaactgcaatctatcaagatttcacgcctgccttcagttttatctgttagctaatgacagctagtgcacctttgtgttttttctgctctgtgtattctgctggtttgtgaatagattactatgaatctcttggaaagtcattgaaaattgtctggacctttattgaaaattgtctgaacctttatcaaaaattgttgtaaattcagttcatcagtcatgttttccaagtgattatctgtgttgtgattctgcatgtggcagctgcacatattgcgatttggtttgatatcttgcaagagagaggccaatactttcaggatgagataacataaagcattcatgatgatctagctggtcatactgcacgatgatagaccatattactatatgttattttgtggtcttttgctctatcttttgatgataatgatgctacaagttgttaaacatttatattactaaggaaaaacagcatattaatccttcatgaagtaaacggcaagaatcacaagggtggtattgtccatctcctccctatcctctctttcagaattttaggagctgaccaaatgaggcaaacacttttacatcatcttcggctcttacaagaggtagctccagctggagttagagtttggagttaggatctgagagttggagctttaccaaacatgcccttaataaattgtttagaagtatcgacccaatgacatcttattaaaaaaatagcaaagttagtggtatattataaagggagataaagtcggcggtaatttgttaagacagagttaactcagtggcacgaaattaaattattttgaagaccattctcaacttatacatccattcaattactactcaatccattttccaatctcccgatggatcatcaaagttgatgttctcaacctagcattagccaacacttgattatcatataacaatcaccgttcatgcacatgttaattgccctttgaatcgaagaatggacggccggaactcgaaatcgaaagaaaattattcctccttccgtgcataaacaaactagcattattgggcaacaaatcgcaacagcctagctgaccatccagaaaggcgacccgcacattgcaaccaacttgcacgttccgcaccgcaccatcccatgttccgtgtccaccattcacaccctcgctccaacgcccccaagccccttcgcgtagcgctcgccgatctgaccgatccacgcatgcaacgcacggtggcatgttcacaaacgaggcgcgcccatccgccgtgcagccaccaacacgccacacgctgatacgcatggccgagaaaactaacgcaccaaacaagcccacgacgcgtcagcggctcaccgcccgggtgagcccacccggcgccgttcggtgcgcgtctccacgcagcggatcgggaggatatcgcggggaacccggcatggaacgaaccagccactccaccaccagcccaccacccacatggccccacccccgcggccccgcgcgcgggcgcagccaagccgccgatccaccaaccccgacccgcaccgacggcccagatcgcttacccacgccgctgcacgcgtacgcgagggttggagccgcaaaattccagcgtggaatagcagcacggcatttcctccctctctctctctccacgggaggcggagataaaaaggcacgcagccgctccaagaaaccctcgcccccacgacgctcgctctctcctctctctccctcttccgccgccgcgcttggggaaggaaggagaaagcaagccatcggcccccgcctccgcctccgaagggtgagctgctcccgtcgtttgcctctcctcctccctcctctcctccttttttgggttgtgctcggtggagacggtgatgtatatatagatccgtggatctggctgtggctcgcgcagatctgcttgtttcttccaagtagacttgttacgcctgttggtgttcgagtggtaggagcccttgggcttttccaggttcagatcgacgcctccttcctctggtatgggaggatctcctgttcatctgttgactgggtggtcggttgcttagatctgttctatttctgctttattttgtgcatgtattgtgtggtttgtagggttatggctcccctgtgcgcggatcatgtgggtttgggtttcgtttcgttcgtagaatctttggatgttcgggttggctccgaatctgtagatcggaaggtcattggtcaggtggggatggtggggcagccaaaagggttgcgtttttttactggttttctttattttcactgacgtcgactagatctggtcgtctcatgtgcctcagatgcgtgatctgaacgcacacaacccctccaaacatgactctgtttctcgatttgatctgaccgtgaccgtattacagtaacgatccatccttgtttataaacttgtacagatttactagtataatcctgtgtttcatgcatgctagttttatacttctcattacctgttggtagaatttaataatgtgctctggaattgcgattccttttgctctgcacaaaaaggaacggccctgcttggacagggaccatccttttctgcgacctatttaaagttctcatggtgcgtcgtgatggtgatgtgcactactgtgtagaacaccttatactgtttgtcatcaggagttccactgcaatttttaatacattctggatgcatttttgtagagactgtacaattgtgtaattacatgcttatatatagttttttgggcttttgttcttggtaaatatcagtttattagctctttccgtttagtttcttaagcactacctctgtttgtacaccatgatttcttctaatgaatgaaatatctcaacaataaatctttcttctgcactgtctgttcgtatgctatgatttcttttgagtgaaatatctgaactacaaatattttgagtgaaatattttgcctgtgatcctggatttctaaaccagtactgttgccttttatgatgcaggacattgttgctagttggtgatggctgagcaggctaatcaaccgactgtccttcagaagttcggtggccagttccaccttggctccagcttttctgaaggtgtacgggctcgcaacatctgcccatctgtctcatcctatgacaggcgctttaccacaaggagctacatgacccagggccttgtcaatggtggcatcaacgtcccaatgatgtcgtcctctccaatttttgctaatgctccagctgagaaaggtggcaaaaacttcatgattgatttcctcatgggtggagtgtcagccgcagtttcaaagactgctgctgctccgattgagcgtgtgaagctgcttatccagaaccaggatgaaatgatcaaggctggtaggctctcagagccatacaagggtattggggactgcttcggacgcactatcaaggatgagggttttgcttcattgtggagaggaaacactgccaatgtgatccgttacttccccacccaggtaacctgcaattttcatgatggtagccaaatttatgttttgtatattacactttggaacatctatgtaaaacacctgaacaaagcactacgttttgatgttcagtagcctgtgtagtgattctatttaccttacatgtttatcacttattaagaagtttgaatcaatcaaaatttattaagaaagaagagttcaggtgtgtttacattctgtttgctttgttgctattgcactatagttcttttcttattctgatgacttttgattttgtctcctaggctttgaactttgctttcaaggattacttcaagaggctgttcaacttcaagaaagacaaggatggttactggaagtggtttggtggcaaccttgcctctggtggtgctgctggtgcttcatctctgttttttgtgtactcccttgactatgctaggacaaggttggccaatgatgcgaaggctgccaagggaggaggtgaaaggcagttcaatggccttgtggatgtttaccgcaagactctcaagtcagatggcattgctgggttgtaccgtggatttaacatctcatgtgttggaatcattgtctaccgtggtctgtactttggaatgtatgattctctgaagccagttgtactcactgggtctctccaggtttgttcttatttctgtctcaatattagttgttttttgcccatctatggaactattctttaacatcttcattggtttgcaggacaatttctttgcaagctttgcccttgggtggctgatcaccaacggtgcaggtcttgcctcttaccccattgataccgtccgcagaaggatgatgatgacctctggagaggctgtcaagtacaagagctccatggatgctttctcccagatcctgaagaacgagggtgccaagtcactgttcaagggtgctggtgccaacatcctacgtgccattgctggtgctggtgtgctctcaggctatgaccagctgcagatcctcttctttggaaagaagtacggctcgggcggtgcctaaactggcagaaaatgatgacgaacaagtgtttattcctggtcctgcactaacgggatctggtgaattttgcctttttaacattgaaaacaataataattcttgtaggggagaacactccccgacattcgttttttggtggaagcgtttatctccaaacattgtcataggcggaggcgttaatcgcaaacagtttaccatcatagggttgagtttgagttgagtctggccggctctgttatgtctggcgattttcctaccatacattaccctcggtgaaatatcgaaagattattgagttgctgtcttttgttggtgttactattttgcaatgcttcattatttctactgtttcatcctgttatattcctgatagcattttgcattgcgtttctctacatgcatgcaatttattgctctatgaatttcacatactatacaggagcatttcatgtttgtctctgttcatgtgaaactttttgtctgttaatgtgaagtacgaagattcatttgcgtgattgaattccatcttcatgaatagattgaattacatctaggtgccagttgagctgaactgccgagaacgtatataccgatccgaacataggcaagatgcagaggacacactagctctctttccaccgctgcagcgtctaagataccctttccactgcacctcctgacgaaggctcccacgcaccgcggcgcgttcggccttgttctttttgcatctggtccatggttttttggggtgtgcacagtagaccagattcgttagggaacctccatttcattcaacaaattcctgttcttgtcttttgttctaattatgctagtaaatgttttgttatttaattaattgtgtggtagatatttttttaccttcttggcaacaactttgttccacatttgcagttgcaatagtgtaacaatgttttttttttctgaactggaatccaagatgattttgtgctgaggtgccgctcattgactatagtggttgttactaacgaagttcaatccagcacccctgaatatcaggtccatcaaactaaattaccagtcgtatttcagcaactgaatcattgaactctatttctgtccttggctgtttttgagatttcacataatatacttccatgcactaaattgctgcttgaggtcacataaaatttatgaattgcaggaacatataatttttttgttaatttcttatgtattcaaggttcaataaaaatataataagatgaattttgaaatctgtcaaacatattccaatattccattcctgcaggaacaagatgttagttatgttgatgcggactggggtcttcatagacaactctatacctcactctactttagttatcgaaggacagttcgcagtcagattcttctttcacagcagagcttatggctctcatctttggacatgttatatgcagcactttgcaacttgcaattgaacaatgccatttacttgtcagattacactactgttgtcaaggttttgcaggagaggaaggatatcatgcaagcaatcgaggacactggagcctccggccactctaccattttcagcaagttttgcagggacaggagtccaaattaggtggataccgtgatcggtgaacaaaatggcagacaaactggtgttgtgagctagagataggccagccagaagttctctttcctcagtttgtcatgatttgtaacactatacttcttctccagttagctctcagctatctgctctttcagggagatccacctccctaactcaggtccatatgtaacggggagattgttactcgcctatgaaggaattcagtaacagaatccagctttctttctgctacgaacaaatgttcaccactgtagccacttcagtatgcttagagcaattgagatactctgcacataaacgaaactagcaacttgaggtctgcaagagccaagagtgcaagtgggttacccgcgaatccacttataggttaaaataaacaaatgctgtgatcacacctccattgcgacgtttcttcaggtgacgaaaagcctgacgagtagtttaggcccccgacagggccctgtttatctgggctggttagatggctgaaataccggcaaattggcaaagtttgcctggtggacggtgtgtgcaaattgcaatgactccagccatatggtactgaaaatgagttggcatcactacatcactgcgcctcgccgcattgaaatgtggaaatgaatggagttgccctgcgcgcagatctatgattgggccgtgatggacgggcccgattcaacgggacaagccgacatcacctgggacaaaaacggactggctgggcaggtacccactcagatcttcacctacccgatcagtaacacacagaaagcagaagcaggtagtaaacccagaccattctcacatccatggctcagtagatgtggatctccattttgacttcgaacgctagctgctttgccagtttgccactgaagaattgagacagacagccagacaggatagttaataccactttttaaaaaaatggattaattactggaccaaccccaatgatcatccagacatcatctgtgcaaagcatatatgcaaagaaaagaagagaaattggtggtggcatactggcatcgccttaactaacgcgctacagttgtaccactgccgctgcgcgcaggtcgtgacgctcacgtcgtcgccactagtccactccctcgcttcgcatctcgcctctggtgatgagagcggacagagccgagctgagggaattaaaacccccttatcctctctctgcccccgggctgccattgctggatccaaccatctgcccccgccacgcctcgtctcgcgctagccgtctcgcgtgcgtgcgcgcgcgtcgcgccgcgccctcgttttggagccttgcgccccgctactttccccttgtcccgaacccggaatccgcctcggcgagcgtccttgctttgcttctttggtatctgtgctcccgtttgctttgccttgccacgctccttcctcctcctcattgtctcctcccgtggttcggctcattctgttcttgggttgacgcgggctgcgtgcgtgcgtgcgtgcgtgcggaggcgatgtcgtcggcggtggatgccatctcctgttccaagggcatcgcggccccgccgacggaggaggcgacgaaggagcgggtggcggtggtgggcaagaacggcggcgtggagcacggcggcgacgccgcgacgatgaacgggaagcagtgcggcgaggcgccgcattgccgcaaggagagcaacgaggaggaggaggatgacgaggagaaggcccccaaggccatcgacctcggcccgcgtgtcagcatcaaggaccagctcgagaaagacaaggtaccactactcattcccgccattgctcgaattcttgcaagcacccgccattttatacaacgcatccaattcttcatgcgtttctgcgtgttcttgcttaattgcaggacgacgagagcctgaggcggtggaaggagcagctgctcggcagcgtggatttgaactccgtaggaggtaaaaattcctcgaaccaaatccatttctactaaacgtttttagctgcgtcgtctcgtcgtcctcgcgatctcgtttaatggcgccggccggcacatgcaacagcgttgcatgtgagcctgagcaccgccttgtgcccttgtcaaagatggtcccgtgataatgcacctgtgtacctgtccgtgcttagcccccgttctatgggccacgactagattcatccatcgtctatagtattcatccatgcatgcaccgcccccgtgagctccgtgttgcattctactccgtacatttgtgatttgtacgtagaaaatacggtagaacagcaaaagaaaaagtgaaatatgttgggcttggctggacgggtccggcgttttcaatgcaccggttagatggtcctgttaataactcctgtactttgccgtgcatgttcggcttgtctgataatgaatctggtccgggctcctaattgaagcttgaactaatgctttcatctgatcatgacattgacaatgccttctgatcttaatactggggaacagtgcatttctgttgttagtttatatgctagggtgttggtgcttttaagatcaaatggattttgaatagtggcctaaaaagacacatttttgcatcgcataattctagcgaaccttggctttttgtctatgctttttagactagtgttgaataaaccatgattcatatggttgtggttgtttaaccaaataatccgaggatgatggctagctgcttcacggtcggttttaggatgatcattcattcggcatctgcttgtcttccattagaattttaaactcaaaactacggccaatcatttggcctacacgtcctggccattaggatgcaataatgtcccaaaaagaactgacccaataatgaggtctgaagtctgaacctgtcacgcttgattttatcggtgcagagacgttggagcctgacgtgaagatcatgagcctggccatcctctcgcccggccggccggacatcttcctgccgctgccggtggagcccaacgccaagggcgtctggttcaccctcaaggagggctccctctacaagctcaagttcaccttctccgtcagcaacaacatcgtctccggcctccgctacaccaatgccgtctggaagaccggcatcaaaggtatacccaaacacgaaaaacatttaattaggtctccaatagatgaacaattaattactactaaaattttataaaatccgatggatttagcgcgtttgaatttgtgcaaacgcactcatggttttggttcctcccgttggggcgtgcagttgacagccacaaggagatgctcggcacgttcagcccccagccggagccgtacacgtacgtgacgccggaggagaccacgccgtccggcatgtttgcgaggggatcctactcggccaggacgaaggtacgcatgacgcgaattttctttgtcagatatcagctgcttcaggaaacctgcaaggttcagtcgctcagcaatgtgttgttaatttattcttgcagttcctcgacgacgaccggaaatgttacctggagatcaactacaccttcgacatacgccgagagtggccggcgttgagctaatgatcagctgagccgtttttccggtggtggtcgccgagtagaagggtgaggcgccggccggccggcattcatgctgtgtgttactgtcgtcaccgttgggagcagaagtggacattttttttttcgtctcgtttgcgtcttatccactcatttttttttttggtttgattcaccctagggttcttttgtatattgttgccctgtctgtcccggttgtttgctgtgttaacgccgtgttagacgtacgctttgtcagttcaagttgatgttatgctatgtgttatgtcagtgtgcgtgtttgagcttctgtcactctgtcagggtcctgtttcgatcgaactgcctgtttgagttcagagcaacgcagctgcatttcttgtaaacactgggactgtatctgacgcttcccttacaaatttcccattctgtgtgcttctctctgcaattacacgaaagacatatacccataggccatagacatcactatacatacacaaatcaataaatatactccctaatacatactcaaagacagaaaccaatgagaattcctatactaaaatcccattaaaaacatagctgtgagtatataatattcgtggcaaccagagaccaagacttaaatagtgggtggtagtcatgcaccctccaccacgaacatcaccgatacttcctctccatgtataattgtctaaacttgttttaccagtgttatgccttgtatattagagtgggtaacttcgcggatcagaggtctgaggattcccgtataatttagggtgcaagcaagcaagcagtagctggactatttatcatgggtccccactccaactcctcggcggattcatcacgcaagatgcatgtggtcaaagctttacttacatatagttgcagcgattggctaagggatgcaaagttgcaaacatgtgggttccttccgttcacctgattaaagaggaattaatagcaacacaagttagcaactcgagtaagcgggccagaaagcaggctggagcggtgatttcaggcagcccacccaacgttccaaccaaacctaccgttcgtgtgggccacttttccggcccgcgcagaggacgatccagccggcaatgctggattggcccgtcaccttccccccttttcgcgcagcgcgcgtggcccatgttttggataggtagacttcgcggcccaagctggtgggtcaaattcagaagatatagtcggccctgctcctcggcgaccacgtccgagaggagcccgaggcaagcaaaagcaacaggatctggcggcttcacgtcatcacgtgaccagagtaaaactttcacgcttggaaagcggtgagcacgttcagaccccgtcgtctcgtcggtcgcatgtgaccggggcgagagacgagagaattcgcaagcaaaaccatcggggacgtctctctatcaacagcggtggatttcgccgttttcctgggcatgcgtgatcggtctcaactccgtgttttccttttttttttcccccgtacgccgtcacatcgccggcgatcggatccgcgccaaataacaagcaaccgatgtgcgcactggcgaaggattcgtccagctttccccccgcggcgcgctgtgtttgtcgtgctatcgctttggatgccgatggaaataacgtgcgtggaatttagccgtccttgttgagttattgtgtgttggcgcgctgcaagcctggcgatctggcgctttcggaaaacggcattaaccaggaagctggaacgacagtgcaggacagtggaggagctccggtgtcagctcggctccgtacgaactcgtcgatgcttcccagggtcttcgattcgatgcatcacgttgtcgaaccgttcggccagaaaatgccatacttcggatgtgtttagtttcaaagttttttttaaaacttctaacttttcatcacatcaaacctttcatacacacgtaactttttataacttttcagtcacatcgtctccaatttcaaccaaactctaaactttgggccaatctaaacacaacctgattaattcaatactggattactagtacttcggtttagagaatgagctcttctctgcattgaatcatcctggagacctgaatatttcgatagctttgcggataaatgcgcgctgtgtgcagtacgtgtgcccaaggtacgcgcacgcgtgtctgcgtgacgggttcacgttcggcgggagcacggattgggggggggggggggggggtatgtgttgtacaggtaagaggtgtttggtttgttctggctgtgaacagtggcacgtcggaacacgccaaagaagaggcccgtggcgacgacgctttcggcaggggataaaaaccccacgaaaaattatggcaagggcaacaagatttgtcggcatgagcagcaagatccgctcgagctccgggtaaacaggtgccggacaaattttggttttcttggttgctttttgagaacatgagcacacgaaagctggttgactcgaataagaaaattacacgagagagtttcttctcgaggaaaagttggaggatctttaattgtatttttagataatgtattcacaaaaggatctttaatttgtattcatatagctggtgctccattgctcctactttctagggagataggtgtgttcttttgagttcaatgtaatggaacatacaaacaataatttaactattattacaagattaaaaagaatggatttgaaatagcatcttataatgataactatatatgtaaaaagtttttaaaaaaatcctcctatttaggaactcgacctatgtgcatttttgttcaattttgagaaaagaaaaatacaccgataatatgtaaaacggacactcatattgttaaagtctcgcaatcgaaacctcttccaatgtaaagcattcaatgtcttctattacgtatcatctattttgcacaaccctttaaagtccaaataagttagaccttggttccaatcgtttaagatgtggtaagcccaaagaaaacaaacaataaaatgttttttttaaaaaaaaaactccatatctgtgttatttctttcattatagcccctcgtagagcccaggtgctatttccttttccttttctttttctttgaaaaaaaaacaacgaatgtgctaattcttaaccctgaggaaacctaaaatcggagacataccagcgaataaacaaacaaaacaaacaaacgaaaccgacccacctgacctcctgtcctcgtctccaccacttcccctcccctctcccgcccccacgaaatctgggaggagccacgacgccattgccaacccttcttctcttttccccccaccgcaaggaaagcacttccggcgagcgtcgacgacgacgaatcgtcgcgagaaattcggaaggtacccctaccctcgtccccccccccttccccccgtcgcctcgccgcgccgccacgcgcccatccacgcggcgtgcgcgagggcgcggacgatctccacgttcctgttttttttttctttgtttttcgaggggggtttggttgcggccgttttgatctgagatcttgttgcagtcgataggggaggtcggggaggaggggggagatgtcggggttcgtcggcgtcgtggtctccgacccgtcgctgcagggccagttcacgcaggtggagctccgatcgctcaaggccaaggtgacctaaaattatccccggtttcttcagttcgttgtataggaagccgcagttcgcctctcattcggggtggaattgatgggttttttttttttgtcggggtggcagtttctatctctgaagagagactccggaggacatgccacgacgaagaacctcccgggactgatgaagaagctgagggggctcaatgaggtgatctccgaggaggagatcgccgcccacttgtcccagtcttaccctgacgccgaccaggagattgagttcgagtcattcctacgggtacaactcggttattttctgaattcctgttggtactgacgagaggaatagagcgtcattgcattgttgatttgattggaatgggattatgtgtggtgtgtttgtaggaatacctgaatctgcagtcaagggtgagcgccaaagaaggcggaggtggtggtggcggcggtggcaagaccgcgtcatctttcctcaagtccagtaccactacattgctgcacaatctcaaccaggcggagaagtcgtcttatgtggcgcacatcaacacctaccttcgtgaagacccgtttctgaagaagtatttaccaatcgagcctaccgacaaccagctgttcgatcttgtcagggacggtgttctgctatggtgagagatggtctttacagctaaccaaagggtgcatatccatttactcgttgaacagaaactgcccttgagtcatagctgatatttgctcatttatggatcatttgctcagtaaattgatcaatttagctgtacctgggaccattgatgagagagcaataaataagaaaagagttcttaacccatgggagaggaatgaaaatcacaccctgtgcctcaactctgccaaggccattggatgtacagttgtaaacattggtacacaagatttggtggagggaagggtatgcaacgcattccctactttaaattctttttagtaattcatggtgcattgtagtctatgcaaattatttttaccactaattttcattcaggactacattgaaatactttaatgccctgtaggtgctaggtagtttgggtacaaagtatgctgtcaattagtcattgtcaccactaatttgctgcataccattttatccttcgctgtataacctgctaattggttccacctcatatttccttgctcatttgctgtatgtgttattctttgatatgcttgtccatgtgtcagatgttttcagccgccttccctttgtgacttcttctatttaattcaagaaattcactaaaagttaagttgtggttaacatgcttcttttttgcagcctcatttaattcttggattgatatctcaaatcataaaggtaaatgttgcactgagttttgcattttgatgtttgacatactatggttaaactcctgcctcatcatataaagatctttttgcacttatcatcagattcaacttttggctgatctgaatctcaagaagacaccccagctggtggaattgtttgatgacagcaaggtaaataaacattctgtccttctattaatttaattcacatgttcttagaacaaaattcattttactgattattatgcaggatatagatgaagtgttgagcttgtcaccagaaaagatgctacttcggtggatgaaccatcatctgaaaaaagctggctacaagaaaaccgtcagcaatttctctacagatgtgaaggtgcatatgacatagaacaaagtgacattataattaattgattatgtgcagtttgataaaagaagctgcccttgtgctaatccactgtttggcttgcaacatctttgcatttgggtttcattgactaagcaacagatggctttgaaaattatttatgactcactcttatgctgtaaatcccctttctaaatgcgtatgtgggaaaagtgaatcaaactacattcatttaattaatattacttcaatctccaatgttcacatacgttagttctgtacaggatggtgaagcatatgcttaccttctaaaagctcttgctccagagcattcccctgaaaccacattagagacaaaggatcctagtgagagggctaaattggtacttgaacaagcagagaagttggattgcaaaagatacttgactcctaaggatatcactgagggttctgccaatttgaatcttgcatttgtggcacaaatattccagcatcggtaagtagtatgtttcttgtttctccaaaggcattaacttttcttttttttatcataaagctagctaaggtattttccccatgttgcagtatattcactttaaaagtttcttagctagctgccaatgaattggtcatctgcttatcacttgaatgctattgttccatgatgcacaggaatggtctaactagtgacaccagacaagttactctcaatcagactgcatcacgtgatgatgttctattatcgagagaagaaaggtcctttcggatgtggatcaacagtcttggggttgactcttacgtgaacaatgtttttgaagatgttcgccatgggtatgagattatttgaatgagcatttgtgtctgtctccaaatgaattgggcacttacatcctttctcatgcagatgggtacttcttgaagtactggacaaagtttctccaggatctgtcaattggaagctggcctcgaaacctccaattaaactaccattcaggaaattggagaattgcaatcaagtggtaaaaatcggaaaggagttaaagttttccttagtaaatttagctgggaatgatattgttcagggtaacaagaaattgattgttggtgagtgtgactgaatcaagtctttttagtggtttctgattgatgttatctgtttagcacacaattgaagccatatctgttgtttttcagcacttctgtggcaattgatgagatttaatatgcttcaattgttgaatagactgagatcccactcccaaggatcccaaggaaaagaaattactgatgctgatatactaaaatgggcaaacagcaaagtgaaagcatcaggaagaacatctcaaatggaaagcttcaaggtgttattaatttctgtttaattagttttaatttgttgttagataactccagttaataaattttcttatcttctctcaggacaagagcttatcaaatggacggtttttccttgaacttcttagtgcagtacaaccgagggttgtcaactggaaagttgttacaaagggggaagatggtctgttcatatgcacgtttgaattactatttgatgataatttctgactgtttatatatgtatccttttggaaaaccgtagcattggctgattcactatttcctttcaattctgcagatgaggaaaagaagctaaatgctacatataccattagtgttgcaaggaaaatcggatgttccgtgtttctgctgccagaggacatcattgaggtaagggatgctaataagcatgaaattgagcgtgcaacttttaccatcacagatggaattaaatgctttaccttcagcaatttatctagcatctgggctaaatgctttactgtctacattatttgttgtctgtgatcctcttctcttttatcttgaaaaatgatggttattatctgttgactaatcgtactcttatgtttctgtttcaggtaaatcagaagatgatcctaacgcttacggctagcatcatgtattggagtctacagaagcaaccacagtcacaatctgaaacgtcagaacaatcagagccatctagtatggcttcggatgcagcttctgatattgcttcggaggacgctgcttcaataacagctgcatctgagggagaagaggtgaattcgctatctgatagtatgtccaatttgaccacatatgatgctatttcaaatgccccgccagcagaaaatggaaatggtgtggcaggatgatgatgattacacgggctgttcttctgtcctgatagcggttttattatggtggaactagtaccgtcatggtgtccaacgtttgctgccagaagtgatttttttcctgcttctgttccaagcctacttttgaggtagcatgatagatacagatacagatagatagagttgccgtttgttcatttaattttgctctatacatacgacagggaaaaaactatacataggtcactagttgggcatttcttgtactcttagtatactttgatttcaatgtcttcactttgtttcccggacctgtcaaaatgtactggcatcgtttgtaatctgctgctgctctggaccattcatgagctgtatataacataatattgtggagagatctggtttcccaagaatccctgttcattgtttacagtactcttttcaccaatctatctctatgctctactagcagatttgggccgtgtttagatccaaagtttttcttcaaactaccaactttttcatcacatcaaaactttcctacatacataaacttccaacttttccgtcacattgttccaatttgaacaaaactttcaattttagcgtgaactaaacacagttcgggtatgacacctgttttaatcacatcaaaactttcctacacacataaacttccaacttttccgtcacattgttccaatttgaaccaaactttcaattttagcgtgaactaaacacagttcgggtatgacacctgttttaatcagtctttgggtgtgtttagttgacgccaaaattggaagtttagttgaaattggaagatgtgatggaaaagttaaaagtttatgtgggtagaaaagttttgatgtgatggaaaagttttgaagtttgaagaaaaaatttggaactaaacaatgcctttgttccgttggagaatgctgaaagtgatcaaccatgaatatttcagttctcttttcacattggcgatgctgcctcatcatgcaacgaagagcaccagttccacgtttgaggttcatagaaccgacgaaaaccacttggttttcacgacatttcgtggttttgagctggcttgagttgacaaaccactctgttgactgttggagtatcaatttgaatcttaaaattttgacaatttatctgaattccatctcttttcaaacaattttcgccaaaactgacaaaaccaacactgagcgattttcggtcagcaaacggttttgtgaaccttatgcatctgagaactgagggagtggtagaatttgctgcgttttcgattattttttttaaagaaaaaattgctgctgctgttgctgctctctctatctcttatctctctctcaaataagagcagtgtgcagcgtacgtcttgcaaaaaatgagagcagtgtgcagtgtacgtcttgcgaaaagatgcctttagcccctacataaataaatacgcatacagggccagccatcagatgctttggagggctccatgccatttctgctctttcttaagacgacgcagctgccttgctgccggtgcctggacaccatcgcccacagctccctccctctatctctctctctctctctctctctctaacaccaccacacatctcctcctttcttcttctccatgcaaaccgacgcttcatcgaggagctcctcgccttcgccatggccgccttcctactccgatccatctcgcagaacggagatgatgagcagcagctgctggtggtggtggtgacacctgacacggcaatgcggcggcggtcgagggattaaaccggcctaaaacgtatccattccgcggcatacaagggcaggccaggcatctgatttcctacctacattactactactagtctactactgctactactacatattatcatttcctagctagctattagttcacttctcgatcgttttggtgttagcttaagctttcttgatttcttttgctgccttagctttttcttttttttcctttgcggcgacattgttgcagagggcgctgtgaaatgtgaataacctctcgcgttttggatgatgagtcgtcgctcgcgttggtcgattgatctctgtatcgtttttcctgtggtgagaattgaggttggtgatctgcaaaagctagaacagcgtgatgatttctatgtttcttttttcgtgcgccaattactcgatcttcttgcttagttatagctgtaaatattccatgacaggagtgtggtcagtggtgcacagtagctaactgaaatcctaatgcccgtctcgttcgcatgctgctgaaacagtacgcagcatcgcgtacaggctctcggcaagtaccacgagtcaaggcgggtacagtttgccctttggcatttgggtagcatagcaggacaacatatttacacaagagcttttcgagctcctttcgaaagaacaaaaagttttaaactgtgtggtgacatagtaagaacaaagaacacagcatctctgactctgcatgataccaaaatctacgatcaaattcttgtagcatgggttgggaatatcttgtctctgctgcggcatatatatctgctactctaaccatgcattccggatgctgtcctttgcccaaggggcaagaaatgcctctttcattcctaactagttgtgccatatccctgcatcttcaacactttcatattccttcactggaattgcatattcatcctacatgcatgccacaatgctaccacaccaggaggaatcacactgccacttgcgatcatcatctgttcatttaattcttcccctgttcgtccttgaagccccgcgcgctagctagctcatcacacagcagcatgcatttagccatttactgccatcgcctggagaactctcaaaggcgttaatggcctgcctagctgcgtgtcagcgtctgtgtgtgcgtgccactgtggcactgtcactgtgcgagagcgatcactcccccagcctcgctgctgcctgcaagagcatttttctcaccggtactacgcgtcctacacatacatgcacaatatattctactagtacttgggctgtttgatagtttgatactacggtggatgggagtcctaccaaaaccaaaaaaacttagcgcacgatccgcacatgcagtcgtcgctgtctgattttcccataaattgtggtcggattattagtacttgcgcagacagggcagggaccagcctcatttgcctcgctctctctgcaatctgcattgccattgccattgccttgcactgcggctgcgctgctgcccagtcctcctcgagtccagccagcccaccaccgcatgcagacgctgcagcagcattaggagatgaccacacgggcttactagacgagcacaacctacgagctgcagtctgccggctgacgcgtggggcccggcccatttgtctggcgtgccacgccacagtgctgcctcccttctgactagtactgtggtgactactgatggatgatgtggtgagtaggagagtaatatactgtacctaaggagtgctcctccgtaaaaagttctagttataaatttggatatgtggctgtgtgttcaaatttatagctacagttcatcttttttagggtagagtagtactccgtaagagtagaggtggcaatgggtcggatcagacaatagacggaacattaacacgtccggcctaagacttgatatcccttgtctaggggtgaaaacggtttgagtatttttttatatccagacacatttgttttaaagtggttcggaaaattttctatatataagacgcatttgtgtttagattagttctatatatgttgagtatatataagtacatgttgagattagagaccaaatgaaataggaatgcgtcaaaatcagcaatagacacatatatcaggtctgacatgggttactcactggcataatataaaacccatatgcgctcaaaagaattttggatatcggatcaaacatgtccacgggtaacaaaataaacctacgctcatcgggtgggatacccgtgggtatcggactagaattgccatccctacccagtaaattgctaccactagttccttaattttggatgcgcggacacatgctggcctaaaacaatgcaactatgcaaggctagagcttagagtttagcaccctgcccatgttctttagcttttcaaaagctccccattggtgctcgagtttgtgctctccttgttttttccccttcaaaacggattcacgaacgctcatggttcagagttcagactagcagtaggcacaggactgtacattggatgatgccttttgagtagttgaggctgagagcggagatggtacccaatggcggccgatacgagtgatcgcggtaggggttgtcgtcgtcgtcgtcgtcgctggcgctccgctcgctcgcacgcccgcctgtcgttttgctcgcgtgcgtgcgtgcgtgcttgcctcgatcgatcggtcggtcggtcggtctgtcgcctcggcacgcaggcgcagccgcgcgcagcgaccgcgtcgtgcgttcccttgtttgggatctcgccaaccacccgcatcacaacgcggctcgcatcacgcccgagacacgcacacacgggcgagagacgccgcgcttgccgggttggttgcctggtttgactccgtttttttttcttttttttggtttgatcggcagcacagcgcctcccggcctcaaaattactgtagtaccacgagatcgatctcgacccgtctcgtcgtcgtcggctagaagtaaaaattctggatccatccatgccaaacaagtaaaaatctggatccatgcgaaacaagtagtcgaggttgaatcggatggatgtgctcagacagaggcattgccagattggctgcttgcctgctgcaaggtactcaacagtggcaggatggcagggagctacgctacgcatggtccaggtggtctggtcgcgaataggaatggtggaatgcgattatggctgtgtttagttcactgtgaagttggaagtttggttgaaaattgaaacgatgtgattgaaagtttgtgtgtttatgataggttgatgtgatgaaaaaagttggaagtttggatacaaactttggatctaaacacagcctagatcaaacgcggaccgccggtttgtttttctggttttgaaataggtgagccggagttctcatgagtcatgatccagccgaaccagggccgtgctgtcaaatttgtagaccctgtacaaggctctaagtgaggcctaaatcaagtaccaaatatagctaaaataatatatatactgcaaaacaaatgtgatatatcaagaatagtatattttttaactcttgttttgtataattagaaactgtcaaactgaaaacggagaatgtttgttgatgttgctggcttgctgcctagtgccttgcttgttggttgcttgctaagttgctattcgctagttgaatgaaaatgtgaaattggatgagccggctggcggcctggtgctcggaggagacgagacgtcgagactcgagacaaattgaataagtcacagatacgaaaacgaaagagaatacaaaacgttgtggggcctcggggctcgaagttgagaatacgaagcgccacgcacgcgaagtcgccacgcggagatacgcgcggactcgaacggggttctggcgctctagcctcatacaaatacatgtgccttctttggttgggctgattttttgaggccctagaaatttgcaggccctgtacggtcgcacgggccgcacacccctgtgcacggccctgagccaaacgttgagtgctccactccgttactacgatacgatgctcgtaaaaatatctagatgagatttcagtagcgcgaagtaaacataacttaactaaatatatttctttgtgatgaaaatataagtactcgcatttacgactaattattattttagtggtaagtgacataccatcgatagtgagatgttcgtgctgatttcgttaatctcaagctatgcctgagatgcgggtgtacgtatgtgtcatcatgaggtgagtgtgaacgtgttataacttataagcgtctgtatttgtagttttttttataagaaaaaaagatttcaatagtaaccagagtccacttagatgaactttctgctgctgggctgcgccgacgtgttcatgacttcaggggctatcccaccgaggaacggtgagcacgcgaaaagagagaaggaattatgttgctactaccgcgataacaccacacttatcacgataacggattggttatcaacaaatttcacagaaatttcatcaaaatctatcgaattatggcttgacttttacgctattcgtcgtcgtcgataaccggccaaccgggcaataactgggccggctaccattgacaacgcaaaccaaaggaaacaagccggccttatgcgatggtaagcccacacgagagaacagccaggtagggattatagcccaacgctcccatcacgacccactacctttggcccatgggagattgcgaatcgcggacgaaaaaagtgcaccgaagttccctcaatttgtcatcgagttacaaaatcgtcctccaaccgtaaaatcggatacaacgcatccctcaacttataaaaccagtgcaaactagaaccctcgatagttttgactctagttttgtctgacgtgacagctgacttagtatagtacccatgtgggccccatacgtcagggtgaccacgtcatcatcatctctttcctctcttctctcccttccttctctctctctctttcccagttttctcctcatacgggccaggcggtggggtgatgtgggaaagggcagctggcgacgggcggtgcggtggcgcgacatcggcaacactagagaaggggcaacgcggcggcgacggcgggtcgggagcaggcaggcgccgcggcggtgggcatggaggtggagtggttgcgggacggggtggaagaagaggaggtcatcgaggctctagcacacgcgcaggcggcgcacaccggggatgggagtgcgatggcgttgcggtagagcgagcatgaggcgtgcgcacggagccaaacatctacgcagtccatgtggaacgagtgcgcgcagagcggtagcgtgcggagctcgtcgccgtcggcaaactcgagcaggcacacggtgcagacgcgtgcggcggtgtcgtctcctccgcctcccccgccgccgtagccgtgcaccgccatcaccgacgacagcaacttgatggcggcgccgttgaatcgatcttggtgcaggcctttcatggcttcgggttcgaccgtcgaggtcctccagctcctccattgcttgtctgttgcctctaagaagctcaccaacggctaccacggtgcctgtttccacctctgtgcccatcactgcggcgcccgcctgcgcccaacccgtcgccggccgccctttcctgcctcgcccctccagctgacccacacgaggggtgcggggaggccggcgagctcgtgccgctctgagcccgtgtgtcgccacctggggaagctaagatccccgggagccaccgtcgccagccgcaccaccctttagccgcgcgcgccaccgtgggcgccaaccctagtgccatgcctgtgtgaaagcagagagcgagagggaggaaggaaggagaaacatagaaagtgaagaggggaaagagagtaggtgctgacatggacacaccgacatgtggggtccacgtgggttccatgctggctcagctaccatatcggataaaaccgggatcaaacccatagaaggatctaaagttgacggttttgtaagttaagggatgtcgtatatctagttttgtggttaggacacaattttataactcgttgacaagttgagggacctttggtgcgtactttttccaatcgcggacgggaagtgatgcgtgcgcagccagtgtacggccggccaaggtcgcgtgggtgatggaacccaaggtcagcggtttcacgcgcatgaacgctaccatccggcgaagcgcacacgcacggcgggttccgcggccgcggccgcgcgcgctagctcgccgtggcttcgcgcggctgctacgcgggcgatttctacccccattcacaacagtcaacaaccgcatggcgcgcggtgagtccgaaactgacttgcactgttgcacaagcggcgcacgcgtccaggttggtcaacaacgcgtgcaaggcattgttgatttcaggctttcagctacagcatgttgacacacattggcctcgtggggatcaggcccgaacattctggcctctgttagagcagatacaatagcaggctataagctagctacaaatatattttaagaagataaatgaggagagagaagtgtagcgggctacagatttatagccagctgtaatacggactccaatacataatgtgtgtatgacaggtgggaccagttattgatagtgtagtatgtaactattgtatgaatatgtattagattggctatagatgaattggagccagtagttggctatactattgaacttgctcttatcatcaaggacgtgtgttttttttccacgaatgtgcagaaattttgcacgtcaatatattagaaaagagtagcatacaacggtaatacgcggagacggttgttggggataggaggtcatgtacagtatgacactaataagcaagtactccctccgttcccttttgatcatcgtattgcaaaaaaaataataattccattttgattgtcgcattacggtggggaggagatgaaaatcccgggaaggacgttaatgacacttcctaacgaacactacatgcatctgattggttaggctatacggcatgtagaactgattaggagccgctgcatgcatcgatttaatacgctcacaactgattggccagccacacggcatgtaaaattgatggcgttacattcacggatacgaaacgctaatgtatgtttttgatgctgattaagtgctccacatgattgtcttggtattgatgcacaaatcatatatgaagatcgattaggaatggagcgagtatgacactaataagcagactgcgacaagcgaaactaagcaaagttacgtgcctgcctcctgacaagataggcgtaagcatagtgagagaatttttcaccacgcatacaactcaagcgcaatttcaattcaacaagcaagcatatttcatttgccaggccgactggccgagtatttgggctgtacgggcggcggccgagcaagtcagcctaggacgatatgccaggaggctaggacgaaaggaaatggctgaaagatgcggggagccaaggacatgaaaggactgaaagatgggggcgtgtgatgtgactcgtgtgctcacgtttttctttcacaagctcaaagaaagctgaaccaaatagaccaaaagaccaaaagacgaacaaatctgtgactctcgcacagtatagagacaaggaactaagtaatatcttactaggtgacctatctgcttacgtctatttttctcccacatctatacccatgcaattgagatcctctgtggtactgcatgtgcagtactgcttactgacatctgggcccgaggggctgtggggcccacatgtcagtgagcagtactgcatgtactgcacatgcagtactgcagaggacctgcatccataccaatgctactaaattggagtagcactttgcgggagcttgcaccagtgttcacaatctttattaattccaaacgatttttgtgaattttgaacatctcgagcatgcttagatatcgaatgggggttttgttttgactttttaaaattcatttggaaactgtgaaaatcaacgtatcgatacagctcgaaattcgctaaccaatcaagattataaatcatagcttccatattaaccagaaagatcattgttgattggattgatcgagcttatattctacgaagtatgtcatattaaataaaacatgtaattggaaatgtcatatactctttcttttttggttttttccaacatttgaaaattataaaatttaaaattagtaatgaagcaatacatgttatgtaatcagcaacccgataaacaaatattcctatgtctctggttagattcttgcaaacaaagtagacaacaacatagaaatagaaaataaaacaaaagactatgacaaaaaagagtcgcatagatagaactgaagccttcgcatcactcttgtgcgagtggctcgggagcgaaaccctagccgcccgtgccgccacctcccacccaaccttgacacctcgcctccgtcggagttcgccgtcggaaagtcgagcgaccagctgggaaggcggagcagccagctgagaaggcggctgcagagacaagaagacctgacgaggcccgtcctcggcgtgggaggatgaagtggtgcacggcggtagccggaccctggcggccagacacggaaagggcaagtcggatctgatgcccctcaaggcagatgcatggacgactgtggagggcggccgcggaagcgaaggtggtggtaatggtgccagatctggtgctcccatatccaatttcggcagcgatgcaatgtctcagcgcggtaacgctgcatcgacgaagggcaattgccaatgtttggaggaaggtggagacgacaacggggatggggagaagcaggcagcgactgctgggtgtggggctcccaaaggaagactggcttagtacgaggcgcatggccggcggtgggtggccaacgaggcgcatgcagagcatggcacagaggcttgtggtggagctcccgaggggaagttgtcgtggcacggaggagcacgaccggcagcgagaggccagcaaggcacgaggagagtgcgctgcggaggcggtgaggctgacgcggaggctggagcggtgtggcggcgagcctgtcggggtgggagcatgccaggcctagggtgatgcggcggcgaggctactgcggtatgaggacagacgcaacaacgatgcgatcaggcgactcgttggagagacatgggtagcttggtcgaggatgaagtggtccttgaaggctacggcgagctcctttccaagcgttagtacccttgcagtggcggcttgccgtcgcaagatggccacgttggacgggctagtacaggggagaggggatccattcttctctctcaccatcttcttctccaacccacccatgtggatggatctggagcgcaccggaggtcgagatcctactttgatagccggccggcgacaaggcgtcggcgtggtggctgtgcgttgaagaggattagctagtggtgattgtcaaaactaacaggcactcaataacctgggagagtagggaaaatatgggcgaagatctagccttcaggatggctatggcgacgcctgcgggcgccgcgttctccttgggtccttgttgcgttttttttcctctcccagtggtttttttaggtgaaaaccatatcctgattctctaggatgggcagcggcggcattcttggcgccgtttccttcttggaggcgtcgttagaagatccattccttaggggtgttgtgtgcgtgttttatttttttagcagcaagatcgatcagacgtagacgcgtggtttggttgtatttttctttttcttgactatagtcttctaggactatagacttgtattttatttctactatatcaatacaaacgttgcactatcttgtgcgggttgttttaacaaaaaaaaaagactatgaccaaccctaactccatgaaaaatcatggtagacaaacccttaaatgacttaatagatctaattgctaaagactttattcaacacaaaccttaagagcttattaaaattagacgagagacggatcccctccctcatcgcatctggtgaggatgatggaggcaaagaaggagggtgattggagtgatggagagaacccatgtagatcttaatgtgagacgttgaagtatggactcaggaagcactttctgcaacaactcatcttaatttctatgtaattccctatagtttataaacaagttcggaataaataagtagagtttaatctcatttaccttcgcaattattgtaaaagtacgttgtaatatccaacaactacgaaaattaggtaaattacacacctcaccttccattcaatccgtacatttatacccccccgctccccaattcatgtggttctttttttttttgaaactccaattcatgtggttctggtttggctatccaacatcgcacttccccgtggcgaatgacgtggtaacttaataaaatactcatctctttcttcctctctagctccatactctacacattcaaattatgaataaatgtgacagtgtagagtatatatttttcaggttttttacacattgagggggaaaagagataaatgtgagcgttaatatagtattagtgctgttcataagttggatttatcttttttcttttgttcatagtgagcgttagtgcgttacacattgatgagcagtgatgactgtcgactgatgaagcacatgttatgcatgagctagcgtgaaacaagacgacgcgcgtcgacgagaccacccggccccgaccaaggctgagagaaacaagtcacagaaattgtacgtacttgtaatggacttattaaccgccaacacaacctgctggccctataaattgacaagtactcgtgctcttcagctgcaaagagccacagcgaacaaaagccatatattgtaacgaattactacctagctagttaacctggtctctccagagcaagctacccgttagtcttgatcagctagctctagctagtagttagccatgaaggtagagcaggacctccacatgagccggggcgacggcgagaccagctacgccgccaactcaaggcttcaagtatgcagtccctttctactgtgaaatccgtgtgatcaaacaaatcacatgcatgcaattacttcctccgtttcacagtgtaagactttatagcattgctcacattcatatagattttaatgaatctagatatatatgtatgtctagatttattaacatttatatgaatgtaaataatactagaaagtcttacattatgaaataaaggaagtaaccaacacaactaatgttgcacacgtctggtataccgaatgaagctaatgcatgcttgattttgcttgacatgttgttcaggagaaggccatcctgaagacgaggccgctgcttcacaaggccgtcgaggaagctcacgcgtcgctctccggcctctcccgcgcgcctgcaggcggcaagatggtggtggccgacctcggctgctcgtcggggcccaacactctcctcgtcgtctccgaggtgctcagcgcggtggccaaccgctcatcatgcgaccacaagtcctcgctggtggcggacgtccagttcttcctcaacgacctccccggcaacgacttcaacctcgtgttccagtccctcgagctgttcaagaagctcgccgagatggagtttgggaaggctctgcctccctactacattgccggcttgccgggctctttctacaccaggctcttccccgaccgctccgtccacctcttccactcctcctactgcctcatgtggcgctccaaggtaattaaacacagtgcaaaaattaggaaaagaaaatgatgatcgagctagctatacgtaactcatttcccgtaacgagttgagagaaactcctgcgttcgattcttactgacatgagaacatacatccaggtgcctgacaagctagcgagcggtgaggtgctgaacgcgggcaacatgtacatctgggagaccacgccgccgtcggtggtcaagctgtaccagaggcagttccaggaggacttctcgcagttcctggcgctacgccacgacgagctcgtctccggcggccagatggtgctgacgttcctgggcaggaagaacagggacgtgctccgcggcgaagtgagctacatgtatgggcttcttgcccaagctctccagtccctagtccaagaggtatatatacaaacacattgaaccagtcactctatgtagtactgagacgaacacatttgattgatcttgttgctaatatgcagggacgtgtggaggaggagaagctggacagcttcaacctgccgttctactcgccatcggtggacgaagtgaaggcagtgatcaggcagagcgggctgttcgacataagccacatccagctcttcgaatccaactgggatccacaggacgacagtgacgacgacgacgtggcgacgctggacagcgttcggagcggcgtcaacgtcgccaggtgcatcagggccgtgctcgagcccctcatcgctcgtcatttcgggaggtgcatagtggacgacctgttcgacatgtacgcgcggaacgtagcacagcacctcgagcaggtgaagaccaagtaccctgtcattgtgctctccttgaaggcaagacgctgaacctatccgttcgtcggctcgtggtacacgatgttgcattttataagtagcgtgccagtgtgtgttgttggggaccgattgatcacccagctgctctgcaaattgggtctgccatagcctttgtctagctttgagtcgtttgtcgttgtaagttaaatgcgacgtgtgcgtgagtcagtaaaagtaaaatgaactagcccacgcgaatacgcgggcatgtatcttaagttgtgtttatatgggtagaaaattaatctaattatttctatcttgattgaaaagtatgatttctctaaaattttacttatcaatcacttggattttttttccaagctatatgttaactttatactttgtactctctccgtcttatattataaatcgtttgtttttttttctagtcaaacttctttaagtttgaccgctgacatgtagggagaggagaatgaagagttcgctgctaacatgtaggctccactcgtcatgttagcaaaaaccggccactataccatcgaaggactaaagttgacacggtattatgagttgagggatgagttatacttggtatttcggtttagagacaaattataacctggatgataaattgagggatctaaagtgaacttattcgaaagtaaaaaccagtgaagaaatttgagggctgccagatccttagatggaagcctgcgccggtgagccctggagccgtgggcttgaatgttgatggtgcattactttcccaaaaattgatgctgtgttttaacgttatttattagatatattaatggtttattagtgagagttcgaaaacaaatgcatggagaaaacgttagaaaccatgtgttagtcagtcactcaccgttgttgcagcaaacaaaaactaccagtggtggctcgagtcaacaacaacgcggcgaggacaaaacatttatcggctcctgaaacttcggccatggtggtgcgcagatcagcaggtatccagatgcaatgatctaaatgatgcatcgcgcgtgcgcccgcgcgcggttgattccgtcgcattcggtgggggctcgtctagatcacgtttctggagagctccagggtctctttcggtggattcgactgttggtgaattgtgtcggcgactcggcgtcacggccgcactgctttggctaataagcgcactcctccaactcaggccgaattcagttctaaacttttttttttaactttcaactttaacttttctatcacgttaaaacttttctatacatataaatttttaacttttccatcacattgttttaattccaatcaaacttttaattttaacgttaactaaacacgcccaacacgccctgatctacgaaaccatccatccgttccaaatcgcacaaaaaaagcaaagtcatgtggtgaagccgctgtacctgtacgcgaagcaatgaaagcacacgcccccgtcttttcccaaagacgcgagctcgccgctgcgcagcatccagattccagatagtactattggcaaagcacaggtttggggcgccatgggctcctaccactacacctccacctcccacttcttcttcgccggcggcggcgagggggagtactccagctacaagggtactggtagcaccgacacccacaggcccaccaccgtgcggatcccggttaccaccccgggcccggagcggccgccggacgacgcggcggcggccaggatccaggccgcgttccgggggcacctggtgaggaggcacgccgcggccgtccgcggcgccgacgacgaggcgacgcggctggagcggctgctccggaggcaggagacagtggacgccgtccgcggcgacgagcgcgagcgggcgcggttctcggaggcgctcatggccgtgctgctccgcctcgacgccgtcccggggtactacccggccgtgcgggaggcgcgccgcgccgtgacccgccgcgtggtggggctgcaggaggtgttcgacgccgtgctcgccgcgcccgacgccgccgacacgtgcggggtccccgccagcctggatcaggtcctcgaggggatctggggagagtcgccggctgcgccgccaccgccgccgccgccgccgccgccagcggcggtggaggtggaggaggaggtggtgaggagtccgtgctggaggagatttttcgggggagtgtagcaagtggtgtaaactgtcaaaagtgtatgcaaccgaatttgttgggaaatatgccggaaatatgttggtgtgtacctataaagtattaaagtggtgtagtataatgctatgaacaatcacgtaacatagtaaataacggattaacaacatgcttgttttgaatcttacatatctgaacatttgcaatctacttctatccagaagaactggctaattgggtaggtttatttgtccagtctgtagttctgacacatttgcaatctgaactcttctcttcagctctggaagaaaaagggaatcagctagggccgagtttagtttcaaactttttattcaaactttcaaattttccatcacatcaaaactttcccacacacaaatttccaacttcgtgtcacatcgttataattttatccaaatttccaactttgatgtgaactaaacacacccttatcctccctgctgagtgctggttctgtatttctgacaaaaattgttggatattattccactctcatcgtacatttcgttgatgttctggcgaagttcaaagttctcaaaaaaattgtccagtcagtagtgtaccgtatttgaatggtagtcaggaggtagggacgagtccattttcgaggatgggccttaatctcggcccacacctcacaactaccgtccgcgaggagcgagcccaagtaaagtccctgaactccttttccagttctctctctaagtctaacccaagtacccaactcatctttatgtgcctcaatgaaatgtacgattagagtggattgatgtccaacagattttgtcagaactacaaaccagcgagaaataaaccgagctgattccctttgttctatagctagctggaagagacaactacccaattggccagttcaacgggtaatttctccgttcttcagttaatccatatatcctggaattgtctcacgttcatcaacaaccacccagtacattcctttttccctgtcactatacccatccaggcaaccagctaccaccaaagtaatcttgggtatgttttctctcgttccctgaagttgttttgatccgcatcatttccagtgttccaccagtccacttgtgttgtgccatctctgtttctacggactttctccgttttacaatgtaagtcattctagcattttccatattcatattgatgtaaataaatttagatagatatatatgtctagattcattaacatcaatataaatatgagaaatggtagaatgatttacattgtgcaacggatggagtagttgttaatgtacttcccaaaaggaaaattcatcatcattgagaaagtatattcggaaaaaaattcatcatcattgagaaagcatattcagtgcaattgctttcctttctttttctatcgaatcaagaactgttgatccagcgtaggtaaatggagtaccaattatacatcatcttgcactgagcatcagtgctgtacagtactatataacaagagagaaaattgaagagtagtactagtgtttgtggtccgatgtgttcttacgtttcagatcgtgtggtcctttgccttttgagacgatgacactagcgtaaagatgtaccggaagctagagggagaatcaagcctgtggcgcagcaatggagccgcgaggcatcggtgacgcaacggagcgcgacttatcgccttttcgaagaaagcacaggaggaatgcgacgttcaactgcatatgtatggatggatagattgcagcttctttgataagcaaacgcttggaagcttgtcctggattcacatacaaatgcaggggcctgctgccgatgctgccgggtgaggacgtgaggtagagcagctgcacactgtaggcagattcagattcagattcagatgcgatagcagaagcgcagaactgaacatacgcacaagagtggtccagtccatgcagcttcagaccgtgcatcagtgcatcatgattgtgttcgttgttggggagattatctgccctgctaattggcgattagtggaggcattcgagacaagttggcctataaaattttcatccatgtcagtcagtaactcatcagggtaatcatcatggaatgaaatcagtagagtagatagatgaagggaatcaaacatctctggttaggctaggcatcagtttaatgcctagggtcaaacaaaccaaacagcacggcagagcaagctaaataaaagaaaatttttaaggagtgcttagagaagtaaccggagttgacacggtacagttggccctccaagtcgtagtagtttcgtatcatcaactgataagcacaggattagtcagtcagcgaagcaaccttgcatctatgcatggcttaattatgctagctcctctgccaactgatccaggactccctctactaggacatcaatcatcacatagatgtactgtacgtagttaaatataattagcaggagattgatgatgcatgtgtaacgtgttgattggataagggaggtcatcagccaatataatgcatgaaatcgatgatcaacatggcccggccggtcagaatgatgagctcatgcgcatacaagtaaatacgttatcctgctaaatttgttgctggtatccggctatccgcatctttgagaaattgtctacgttcgagattgataaacaattaagattaagggcctgtttagatctcttggcaaaattttacgctctgccacatcgaatgttgggacgcatgaatagagtattaaatataaacgaaaaaataataattacacagattgtgcataaattgcgagacggatcttttaagcctaaccgcgccatgatttgacaatgtagcgctacagtaaccatttcctaatgacggattaattaggcttaataaattcatctcgtggttttacaggcgaattctgtaatttattttgttattagactacgtttaatacttcaaatgtgtatatccgatgtgacacgctaaaactttacacccctccatctaaacacaacctaagtaacgatacggaaatagactatgattaattgagttttaattattatgaatttgaatataaatttatttgctattttagaacaacttctatatagaggtccttattgattgactatatttttctaacaaactaaaactgtttattaaggaataaaattaatttatggttaaaatttatatatgtgttcttagtgacttaaaagtcaatataaaaaaagaactacgttaaatgtatttaaaatcaacttcaatttttttttaaaaaaattaaatttaaatttaaattttggctctgagcaactaatgggacttagaaagtttgtagtttgaaaaacatgctaacaaaaaatcaatgtagaattacaacttaattaggcgtgtgttttgttacttgtatatgggtagtaacatacacgtccctcgtgtaattgataaagtattacatacgcagtattttacattgtactgtatatataatcgcattttaggggagacaatggaacacacaatgacacaacgtgacaaccagagggagcaaggaaagcaggatagctttacaaggaaaggaaaaggaaagcggccgcggacgccagccgccattccaatccaccctatagaagtgcctccaactgcagtgccaggtgggccccgagaaccgggcccacatgtcatcgaggttctgaggataaaaggcaggtagcaaaacgatggagccaatcatcatagctgtcgctttctttctaccactactgcaaaatcctaaaaaatcgtcccatatcggggaaagcctagcgggtgcagccttcgcccgtttgtccttttatagatatcgggtgaaaaactgaaaacccaactcatttagcactccagttatttttatccttatccactagattgatcccatcaactgtcatcgttttctcggccgtagaccatgttgagctctctgcccgtcctttttctacggtgctaattaagtttagactacaaaacatgattctaacaatttaatattatttaggagtaatatgaagtactctatcaatttcataatgtaagtcattctatcatttcccacattcacattgattgttaataaatctagacatataggatcccacattcatattaatatgaacgtagaaaatattagaatgacttacattgtgaaacggaggaagtagttttgaagtactaaagaaatttatttgcttttcttaacaacttaggagtataaaacaatttgtccattcgtactttttctaaaacactataattcatattgagttttagaatatgattttaaaattaattttaggggagggttttacttagcaactttcatcttattcatgataagaaaaaaaaaactcaagattccaggcttctattggatatgttgcatcacattggttgcaaacgaaaaattgtttgcgttactaatgaagcctacttaaacacggaaaataaaacacgtgattatagtaagattaattaagtaacgcaaacaattaatatgatttttaaattgaaaaatagattaatataatttttaaagcaactttcagatataaaacttttaaaaaagtacaccgtttaataggttaaacaactgaaagggttgagaaagagaagaaaagaacacagcctaaatatagcaggttaaggctaccggaagatttcaatctaaaaaaacattatcaatgcagtttagttttctcatgttcatcaatttaaatacctaacaatacataatttgcagtattatattgacaaatgggcccacttgtgcaacatatatgcttttttcccccgaaaccgcggttttcgcttggttaaggtctaacgggtcaatcaacaaccgtgtcttcttaacgggttggacaccctatccaattaacactcctccccacccatttctatccccattcaccaccgatccccaccaccaccaccaccccgacggctcgaccctacgaccgtggccgcagtctgcagcgagctccggcgccctccctcccctaggtatccccgtcgatcggcggccgcctcccccggctacgatcgccgccgctccgacgaccaccggcgtggtccggcgaccaactccggtgagctccctgctcctcctcagtctcatctaatctcatattcatatggtttccccaacctccgtggccgtcggggccaccatcggcgcggggccgccgacccgagtccaccaccggaagccgccgccgccgccgccgcgctctttctcgtagccgctcccctcaccgtaacttttcttcccgttgcacccggtcgccggccgtcttccgacccgtggccggcggcaccagcaccgcctcgccgccacggcgatcctctaaaccccgatctcccccgaccccaccccgaaaccctaatcctaacctcgccggaggcagggcaggagacatgtgtggtttccatttttggcacttcccaattctttgctagtcttcgctagacgctagtgatgcttcactgcatagcgagaattctgaatggaataatgaagctttaggttagaaatctagttgggacttcaaaagattgtgcgaataccaaacagggaaaaggtcaaatccttgtcctcgttctctgcctccaaacgcggttatgggcttggcgcttactagggattgccggggaagtgggctgttgaaacgatgctacgcgttagagaactgtgggcaagactggctgttggggagaaggggtggaggtgaggcgatgcaacgatatggcaacagatttaaatgaatgggggaattgaatcttttattggtggtactgatagcgtgtgattagatttgaatagttgcaagaactatgggcaagacttggctgttggggaaaaggggtggaggtgaggcgatgcaacgatgtggcaacggatttaaatgaattggggaattgaatcttttattggcggtactgatagcgtgtgattagatttgaatagttgcaatacaaactatggttgccatggtatggtcaatgtggctgggagtggaacagttttgatatcaacttgggggaagaaaagaaaaaaagaaggcatatatttctcttggggtgatgagaattgctataacaactgacaagtgaaagcaacaaacattaccccccatggaaggtatccgtgacacgattgatcaatctacaagtctgcaaatgtaagcatgttaacaaacctggtaatatcccaagacgacgacgaagatgacgactaaccaagtggagaagttaaagtgcttggatgaattagttgaggaaaaataggcaatcaatcaatcaactgcatattgaaccttaataaatggtcacaaaagccccagaagaggaaaacaaccgcaggggtagagaaggaatgagcagtcaaccagcaatagtggaagcgctaagtattgatttctattcactttctcctctagactattggtggttgagagtgatatgtgagggagggaagccaacaaggtgaacaaagaggaggaaggggaaagaaactagaggagaggcaattgaaatctttctttctcttttgcttgccctcttttgaatcaaagttcacagctttcacttgtcaactgcagcgcttctcgcttcatgatgaaatctattcccttcttcgtttctttttttgcccctcaagttaagataaaattttgcttcctttttgctctcaggcacattaaccatatgtgccatgtgttgtttgtacttcaactcttcaaatgtaaaaatgctctatcagttctgccaatcttgtttaattcgtgcattgcaaacgtaacaaagtaaaaagattcagttttccccatttgtttatttcaatctgttataggtagggataatcctaatgctaaaattagctcatgataccctctgatatgcaggcatcccttcggcaaatgtggtgatggaccgaccacaagatcctttcaactcacgaggtatcatgacatgtactccaccttccaggtaaacggtgttttgctctggtaaactggatcttaatcgctgtccctatatgcatttgtcttgttccagggattgcagttccccctgcagtcaagatgaggaacatggctggaaacaacagtccatggatagaccctctgccaccaccgatgaatgcgcgcaatgggctggcaaatgccagcctcttctccacctctttgccagtccttcctcatgaaaaaagtatgccactttcactcataagacatgtcatgctctagtctgtgcatgtcatgctggaaatagcttgctgtccaaacaactgatgtgctcattggtgcagtagggtgtttattttttattttttggctatagtactgtagttacataggtatgactgagggattttaattgtgatgtgtgcaaagcaaagttggaagagggaatgacactagggaccgagatacgagggaaggctgcaaatggaattagttgtgtccaaatgccaaatatgtggtttcacaccaccatttattgtaaaaaattcccatctttaacatgccaaaaatcacatgaatccaaccttttcttctgtaatgtaatgtagcactggctcatatccatatattattatgaatatagcttgaaaagggggcaccacctttgctttggaggcctagaaattactacattaatatgagaaaaaaatctaagccgttagatcattgtgggaccaaattataaccatgtagattgatagcaatagtcgtataaaaagtaccattgtgtatatatagaatccgaagaaaagagttgtatattgaatccagacctacttttaatatctgctgtatataaagtataattacatacatgaaaataggagctaagagctctatagcaaatccaatttaactaccccgtgcaaaattgtgtagggaatttccctagtttgtattgatattcctgataatgtgtgtttccctctttcagtcaactttcttgattctgcacgtggcaccccattgatggatgatgcttctgcaaaactaaaagagctcgatgatgaccctgaagggaaggactacaagtttgactttgatctccgccaaatcgatgatttattgcctaatgaagatgatcttttcgcgggtatcacaaatgagattgagcctgctgggcagacaaattctatggaagaactggaggaatttgatgtatttggcagtggagggggcatggagctggacacagaccctgtggagagcatcacagctggtttggggaatacaagtatagctgatgggcttagaggcaatggggtcaaccattttggtccgtcaaatagtgccagcactgtggccggggagcatccatacggggagcacccttctagaacattgtttgtgaggaacatcaatagcaatgttgacgacacagaattgcgctcactttttgaggtaataactgcaatgtttgttagctttatataattattgccatctgagattgatttgttagtgttacttatcagtaggtataccttgcaactgaacaactttatgtgctgtctaatcaactcatagtcagtgttatgtctgcacttctcttataatgtatctcagttgatctttacaatatccattattgtatttcagcaatatggggatatccgaacactttatactgcaacgaaacatagaggttttgtgatgatatcttattttgatatccgagctgcacgtggtgcgatgcgtggattgcagaacaagcctctgaggaggagaaagttggacattcatttctccatcccgaaggtttattatgttatggttcactttcaaatgcttagtccctttaccataaagtacttagcagtttgccatgttgattttgtaggagaatccatcagataaagatttaaaccagggaactctggttatttttaacttggatccctcagtttccaatgaagaagttcgccagatttttggaacatatggggaagtaaaggaggttaggatgttacttccaatttttccctttgaaatatgtttttgcttgaaaattgcatgttcttacgttcttcgtatactttgtttctgttttttggaattcaatctgatggtgttagtttctatccacagataagagagacaccaaataaaaagcatcataagtttattgagttctatgatgtaagagcagcagaagctgctcttcggtcactgaataaaagcgagatagctggaaaacgcataaagttggaaccaagtcgtcctggtggaacgcgcagaaagtatgattatgcgttttctttccctatccatttatctgtcatagtcttgagttgttgtttgcactttgcagtagaaccctactgaatttatacaccaattttgggatgatctattgatgctgcagttatgttgatttatctgctgtatgcaaatattttaatgtatcaaattgcactatttaactgaccaaggcatgcctgttaaggcttttcgttacatcctcgtgatgctattagcaatctgattgttttaatccagttttatcatttcatcagcagtagaatacctcagattcatcctcagttgattggctttcatttatttcaacgaaatacttgcagttttgaaagtaattagcttgttgtacaccctgtctccctgatttatttaatgggcagtgcactatttcctgaaggtatattttcaagcttgtggatatgctcatttagtcctaggattaatttaagaaaaatgcttaatgacattgaaagttcacacgtaataccattgagagtttgcaccgtttctttttaataccatttccgtctacttaactaatgtttccattaactcagactaaaaataacccttgtgaaccacactcacctcaaccatggagaaagctccaactgcaccactgattgttgtcattggacaccgtttcccatcatctgattcccacagtgggccaccaattcagagattcactcagacacatgcatagtagtagtgatcacgatttcatgagagagggagagggagaggcagggcacatggtggtggccattggcgatgaaatgattgtagatagtggtgcggcaggcaagtgtgggttcagtggttaggaggtcacccagggtgctgtatatgccgcgcaaaacaaatcacgctcatcgccaagggagtggatggacaaacagacaggttgagcggacaggtcttgtctctttcgtggctagagctgctctgctttccgtctcttgcatttgatctagcatcgtcattttcaattgcctctcctgctaggaaaataaacaaaaacggaaaaaaacagaaaaaaggcaaatggaggacaaaaatggtataataaatgatcaaatggtacattgcaaattttcagcgctattaaagtttattatgagctttagtggtacaaatttgaacttgagaattgtttatgccatggaaccaatctttcctactgtttgagttttggaaggcatgttttttcagttatcgtgcaaaccaattatcattgacagaatgtttcactttgttaacactgatctgatttattctcattttcttctggtttagcttgatgcagcagcttggtcatgatatagaccaggatgaacccagaagctacaggattcctcatgttggttcacctattgccagctctcctccaggtactcggactggatctactttagggacatttaatatgcttctgtctatttgtttacaacttatgaatgttaaatcatctcctgtcaggggcatgggctcaatacagtagtccaactgataacaatttgttgcaagcattcaatgcgtcaccaactggaaatggcatgagtcctattgggatgcctccttccttgatatcgaatgctgtgaagattgctccaatcgggaaggatagcaactggtctaaatatgacaaagtattctcaaacaacaaccagccccacggtgctgcatttcagcattcccattcataccaagatcacaaaagtgaacatatgagttcaagtcctgggactttaacagggcctgagtttctatggggtagtccaaagccttattctgaacatgctcaatcccctatttggcgtccaccagcaattggtcatgcaataccatctaatacccgttctcaggggcagggattattgtatggtggccgtcaggcttcactttttgggtctcaagatcagcttcatcatcatcatgttggctctgccccttcaggtgctccatttgagagccactttggatttttacctgaatcaccagagacgtcttatatgaatcaagtcaggtttgggaacattgggaatattggtagtggccgaaacggaactggcctcatgctgaacatggctgctcgtgcttctgtaaaccctgtttctgctttgagtggaaacatgtcagacaataactctagtagctttagaccaatactatcacctagattgggacaatcattttacgggaatcccacatatcaagggcctggttcttttggacttgacaattccatcgaacgtggtcgtaaccgccgagttgacagcagtgtgtttcaagctgatagcaagaagcaataccagcttgatttggagaagatccgtaaaggcgatgatactcgaactacattgatgattaaaaatattccgaacaagtatgtatgtggcttgatattgcattttcttttctgatcttacattactacatagttgctcagctcctaaattgttaggtacacttctaagatgctgctggctgcaattgatgagtttcataaaggaacctatgactttttctacctgccaattgatttcaaggtactagatttgtattgtattgtactgctgtttgcagtgacttgttttgatgcccagcagaatttaattatattttccccacgcagaacaaatgcaatgttggctacgcgttcattaacatgatatcacctgtgcacattgtatcgttctaccaggtatgtccatttcttttattgactcttgcatgctacacagttctttaattgatatccatcaacatgaagttcgtggtttatgtttatgtaagtttctcctaaatatgtctagctgagttgcacaacaacctaagattactggtagacttattcggaacaatttgtaatgatctgtttctgaatatgtgctgtaatttgcaggcgttcaatggcaagaaatgggaaaaattcaacagtgagaaagtagcctccttggcctacgctaggatccagggaaggactgcactcatttcacatttccagaattcaagtttaatgaacgaggataagagatgccgccccattctttttcattctaatgggccagatgctggaaatcaggtaagcttgtttaaaatgtcgacacacatttgtccgcttgttcttatgttcaaacagtatatcgaacaaggtaatggtgatttaactagcaaactgcatcttaggttataagcgtgtttctaacaccatgcatgaataccaggaaccatttcccatcaacggcatatgtatccatatgccactggaagatggagcaattgcaacaggggatccctttggaaatgaagaggacaacaatcagaacgagaggacagcaggagaagagttatgaccattgctttggagtcgccgataaatcttaactgcctagagaagagttttccttcccaaagtgtatagaagtgagaaagattggttagctgcgaaagtttgtggtgtggcatggcgcatctactagttttttttgtggcaaacgatgtcgccccctgaagaacaaaaaagtgacttggagttgagagttgggagtctgctaggtctctctctccatgtcttcctttcaagtttcaaccccctctgtacagatagatgtcgggagttgataattggtcgcatttgatttggtgtaaaaagagagtggtaccggtcaaactgtacagttttaaacattttaatcctctatgttttaggagacttgttaactctatgttttatcctgtgtgaactgagactccaaacagggttccaccttcctgtctacaaaccaaaaatcttgttatgtgcctgctttctgatccttcttccctgtcttgtgaattgtgatactgtgcaagcagagaagcacaacccaggcaagaaaggaaagtgatggctcctttgaaactggaacgtagatattttaaagaattcatgccgaaaacgatttaaatctaagtacaattctttcacaaatcatggcgaaatgagtacacaaggcgatttgaagcgaaaaggaaattcagcccagcctccaaaagcccactagcccatcctgcactcctatctcccaatggcccacacagaagcccatccaaccatccaacggtatccataccgcctcctaacccgcagcccgcatccacgccgtccatccggtctccactactccacccccggacccaccaacccaactccgccacccaccaaccgaaaatccccccacccccgaaaaaaaaagaaaagaaaagaaaaggagaaaaaaaaaaactcccgtgctcggctgcgttctactactagcctacccctatctctctctctctctctctctctctctcttctcgctagtcttcccccaaaaactccacccttccgcggcctcgcccatctcaccgccaccatctatcggctccctcctttctcgtctccaaactcaactctaattgagcgcgaaaacgtggacgcgtttgaattgggcgtctccctcggcttccaggaccttctagaaccttctcgaggctcccccggcctcgcgcggtcgcggctctgcctcccgctctctctcctagggttttccccctcctggtcgcgcggcgggggcggcggccatgggggacgccgcggcggcgtcgcccccggcttccctggggaagcggcggcgcaggggaggagcgggcggaggggacggcgaggggctgcggcgggtggcggagatcgtgatggtgctggccgccgctggggaggtgaggggtgggagggagccgacggccgcggagcgggcgctcgccgcggaggcgagggagaggctggctgcggtcgtcacggagggggcggtgcggcccaaggatctgttccccggggaggccgtgcgcgccctcgtcgaggatctcggcctcaacagggccagggatcccgccgccatggggttccgcccgcccaaggcttccatcgccgacaggctgatgctcactaagcgcaaggtttggtaactctcattcttttttcgcttcattcagctttatagctttacgatgaactagcaccattgacgaaaactggaacgatttggtctatactctatgctgcgttggggagaatgctcgtgatattattgaattgttagcttagctatatcatgtgaatgctactctcttgatggtttatattgattgattttctagaaaacagctcatgtactggtaagcttctgttactcctgtttaactttggtctgatatggtttgtttgccttcctagtgttgctggcttgttgcccactaagataatttactttgcttccccgtgttttgagtatatattcgtgttaagtgatggaggaaatcctttatatgccaatcaaaattcatgagtttccttatgggaaaatcggttccataacaccggaagatcctgagttcacaaatataccatataaattcatcggtacacttcaatactatccaaagttttccatggttgggcatataccactctgttgcctcttttccgtttaatgatttttcttctgtcaataatccgacgaaaaagatggttttgtccttacaatggatatgtctatcctgtgctggattgacactacatagtgaagcagcccactggcctggcatccaccgtacttgcgttcgcctctgcagcatgctggaggggtggtagcaggggcagaccgactgcaacactgtgtgcccgtgccaggggagagcatgcgcgtgcttctacagccacattccagtattcctggtggccggtgttgtcccttctactgctagccatcggggctgctgtccagcacaccaatatgcagaagaatcctcctaggggtggccgccgcgggtatttcttgacccactttagttcaactaaaatgaactaagtttcacttttagagagtctaaagtgaaatttagttcatttagtaggactagaatgggccaaagaatacccatgggtcaacccacacccatccctaaatccttatgcgaagcttagtgagaagtgaaggggagagagagcgagggtagttttgccacagattacggtaaagtgcctccaactcaagaaatggtaaaaaaactaaacaacacaaactttggatggtattaaagtgcaccactaattttcagcgatatactatttctgaagtcaggttcttctgatgccgcgaaaccaattctttccttatatgccactgtaaatttgctatgaaattacccatgttccccctcctttccttcttcaacctcatgggagttgattgcatggtggggtcatccatcagcgagatgttgcgaaggatagcgtcaatttcctgtggctgctacagctgtccagcgagatgtagtcatgtcagagcttgctgatattacaagtgactgcgtggttggatcttaatcaatctactccctccgttttacaatgtaagactttctagcattgcccacattcatatag

SEQ ID NO: 67554 - DNA, 131738 bp, Oryza sativa
tggtccctagccgaagccggcgtgctaattccggaagttggtatgtcagtcccggtcagatccattccaggcttcagcgcaagtatggcaaggaagtcgctggccattaaatgaaggttgaaatgggcgtccaccgaaaaaggggcgagcagagcaggaaacgtgcgctctgcttgtcagaggtcacttctggctgtagactagccctcattgtaaaagcatgtttcctttcttaggtggcgagaggcccttgtggtgacccctgaccagagaaaaaggaggcccaggcctagaaagaaaggagagagaaaaaaaagaggagaagagaggggacgaacggggctagagcctgaactctctctcgctctccggctctctgtattccttcactcacagatccaccagaacacaggagtagggtgttacgcttctcagcggcccgaacctgtctacgtcgcccgtgtctcgcgcatttcttctctcgctgacgttcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttcgcccgctcagcccaatggccgaacgggcagtggcgcacagcctctctccgaacgctagcggtgacgatggggagcagaacccgcgccgtcgggctcgcaccccaccgtccccctctcgccgaaatcttgggcggggggaggcgctcagggaggttggaggatccgcgacttcgccgcccgcgggcgacgggggaggacggcgaggcggggcgcgtcgctgcctcgtctactgcgatggcggcacgccccagggcgcgctccaggctgcgggcgcgctcctgcgtcacccgcccgtcgtccccgatccaaagactccagcccgacgttggctggatgacgtggccgaattggtcatgacggcgcagcagcgactaggcgccggcgggcggtcctccgccaccgaggcctctggcgctgccgccgccggctccaagtcgtcgaggcggagggcgcggcgagcggtggccgttgcccgccgttcgtccgccattccctcgtcaacgcctccaacccaagaagatgtgagtggggggccggatgcccgcctcgatatcgagcgccggcgcgacgctcgtcacgccgcccacgcaacggagggcgcttcctcgtccggagcgccacttcggtccgggcacgggggccagccccccgtgtccccggttggcggtgccggctgtcgaacctttgtggcgagccttcggaacgtccgttggcccccaaggttccggcccaccatcaccgaaaaatacgacggaagcgtcaaccccgccgagtttctccagatctacatgaccgggatcgaggccgccgggggtgacgacagggtcatggcgaatttcttccccatggccctgaagggtcggcgcgggattggctaatgaacttgccacccgcgtcggtccactcttgggaggatttgtgccagcagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcatgcggcacaaccgcatgctcgagaagatcgcctccaaggagccccagaccaccgcgcagctttttgagctcgcggaccgtgtggctcgcaaggaggaggcctggacctggaactcctccgtttctggtgtggcagctccggccgcccccgggtccgccgctcggtcagggcggcgggacaggaggaggaagaaggggtcggcccgttccgacgacgagggtcacgtcctcgccgtcgagggcgattcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacatcgacgatggcgacgatgacctagggttccaggagcctgaggccaccgtcgccaccgtcgatgggggagcgtgcgctcacgcttctcgccggagcctcaaggccatgaagcgagagcttctggccacggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctgggcaagcccgcgttggtgaagttcacggcagcggtccactacgcctacctccagatgaagatgtcgggccccggtggccccctcaccgtccatggcgacctcaaagtcgcgcttgcttgtatggagcagcgcgcggaccaccttgccgcggcgtccaagcccgcgggtggcgacgagaggctcagcacctccgtctcggccgccccaaggcagcggatggtcacgtgcgatgaggtcccggtcaaggaggttgccctgggcgacggcccgtccaagaccacacgaatcagtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccgacagaaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattatccccataggaacttattgttatacgacaatgcctttcgggttaaagaatgcaggtcctacttttcaacgtactactcaaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctacccgaggcatcgaggccaaccccgagaagatacgagctatagagcggatgcgcccccccagcaagcttagggatgtgcagtgcgtcaccggctgcatggccgccctaagtcggttaatatcgaggctgggagagaaggcgctacccctatttaagcttctcaaacgctccaggccgtttacctggacagaggaggctgagcgggccttcactcagttgaaagcgtacctcagttctcccccagtcctagtcgccccggagccagatgagccgttgctactctacctggcggcaaccccgcaggtggtcagcgcggcgttggtcgtggagcgcgacgaggacaaccctcgccccgcacatcccagtcctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctctgaccccgaggttgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattacttccaggcgcatcgggtcacagtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggacttcttgcgggactcagagtggcagctggactggggatccgccgcctcctggtgttaggcgactcctcaacatcctcaagaagcacggcgactcgtggatcgaggagctgccagcggtgctctgggcgaaccgaaccatgccaagccgagcaaccggggaaacgcctttcttcctcatctacggcgcggaggcggtcctcccatctgagctcaccctgaggtcccctcgggtcaccatgtattgcgaggctgatcaagatcagcttcgccgagacaacctcgactatttagaagaacgaaggcggcgcgcggccctccgagccgcgcgctaccagcagagcctgcggcgctaccatcagcgccacgtccgggcccgatcactctgcgtcgacgacctcgtcctaccccgcgtccaaacgcgtgctggactgagcaagctctcaccaatgtgggagggtccgtatcgagtgatcggcgtcccccgggcgggctccgttcggctggccacgggcgacggcacagagctgcctaacccgtggaacatcgaacaccttcgtcgcttctacccctagtgggggtcgggcgtcatgtctcgggctcgggccaaccccgcaccccccctgggcgtgcaggattggccgggggctaccacatgcatatacttaccttttttctcttccgaatttcaataaaagcattttcgacttcttgaggactgtgtctgtgccatcgtttccttttgaagaatcttggcttgaattagcacgctcgtgctcgaccctgccctcggcggcccgggccggctaaaatcgccaaacggggcccagaaccgagccgtgccccggggcgtggtgacctccgggggggaatcggcaaaggcccacaatcgggtcatccataaccctcggtcaccgcgctcccggcctggccagtctcgacacgaggatctccccaggcactggctccgacccgcgccgtttgaggctgggacctgggcacgagcccttgttcaagccaagacaaagaaggaccgcggcaagaaccatcctcgtctcatacacacaacaaacagaactgacgtggaaatttcctctttacttgattacagattaaatcagtctatacaagaagggggcccgaaagcctcggaagaagaagcaaaagttattaagattggcgggggcctgggggctcactccgacgcgcccgggacgtcggcctcgtcgtcgctgtcgtccgcaccgtcgtcaccgccctcctcgtcggagtcgagcgcgaacgcgagccgaggggccgtaccctcgaagctgtggacgatatggtcggtggcgtcccggaccttcgcgcgcgcgccgtcctcggttcctggagggaactcttccagcgctgcccacggggaaaagtcagggtccctggcctggtggcttgccagtacgagctccaccgccccccgggcgaggtccctcgaggatgacatgatcgtctcctcgagctccttggggagccgctcgagggccccggtcatctctgagaggcgctgggcgaggcccccctggttggcggcgtacttcgcgtgccgcccgccccagaggcccgcctgccgcccggcgcggtctagacgggagacggcgtcccgaagcatgccgggccctacttcgctcgccaaacggagggcctcgacctccccggcggacgagtccagcgcgccctgcagctcggcgatggtgtgttcggcggctgcgaggcgggcggctaggtcgccgtggcccgcggccgccccgccgctgtgcgctctcacgtccagctccttcgcccgcgcctcgagctcagcggcccgctgatccagtgctgccctctcggcgcggacgccttccagattgcgacgcgcctgctcctcccgcactgcctcgcggaggaacaggctgtccgccagccgctgcgccacggcctcggcctcctcgagagctcgcccccactcggtgagcgcgtcctcgcggaagcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccacccgccgttcccgggcagcggcggcgtcaaggactccccgggcggcgtcgagcttctcctctagctccgccgcccggctcccgtattggaggcggaggtcgtcccgcgcctcgtcgagcacggcggtggcgatgagggcagtctcccgctcctcctccacctccctggcgatctccgccagctccctacgacgggcctcgagctgtgaggtgtgccggcggtgcgccttgcggcccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcgaccaaggcctgcaggaagggctccgcactcagtggggcagcggaagacagaggggagagtcgcctcggtgtgggcgccgcgcggctcggcccgccgatcgacgtgccggactcgggggcgccccccgaagctggctcgtcccaagcgtcgcccgaggggtcaggcctgagcggcgcgcccacggcttcgtcgtgggtggcctcggaagtcgtcgtcgcctcgggtggagtcgggtcaggggtttggcaggccgcctggcgtgcgcgcgccgcctctgcctcccggacggactccccggcccggcggagtctggcctcctcccgagcggcctactcagcctggcgaacccggacggcctcctgggcagcctcctcggcttcccggaagcggtccacggcttctcgccggtcagcttcccgcctccggacctccgcggtcgccgtctcctcggcctcagaccggccggacttggaatggcggggggggggggggggcgacgggatctcgctgaggcagaagaaaaaccagaagacaaaaagaaacgggtgagtgaaaactcgccttgggagatgggaggatgaatacggccgcggtgggcatggggacgaacctgcggggaggtcggctaaatgaccacctcgggggcgagatgaggttcccccggcatggcacgatcccccccatcttgcggagccgtttcttctttcgctccccctcgggctgcggcgtcggcgcggcaccctccgagcgcctgctgctggcacgcaccgccccgcccccttggggaggagatgggggaggggtaccctcctgcttcctcttcccccgggcgtcggcagggtggctgccccccgggcccccgtcgcggggcccagaagcacgaccccctcccggggtagattgttcccccctgcggctcccacctgcgccatcgtggcctcggggggcccgctcccccgacgccccgacctcctgcatgatggtcaggatgttggcgcgctctggatcgcagcagagggggaggaccccttgggggatgagggatgcctccacggagctgagattcagcacccgttggaccaccatcctgaaatcctcagggtcccagtcccatttgcgcccctggtgggtcctcatgatgtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccggaggctggttcggaagtcggaggcgcgcttcgtcggcgaggggggtgtagaaccaatcgctcttccaatcgtcccactttttgcgaaggacgcagggaatgtagcggttcagcacctgcccccgcggctggaagtagcagccaccgactaccgtcggcggcgacaccggctgtacggtgaagaaccaccggaacagccggagagatgggcgcaccccgacaaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgcggcgccgggcgtccctcgcccagcgtgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgcaggaaacggagagtcagagcacaagtggcaaaggcaaggggaagagtggtgagaggaaggaaacaaatcccttccttggcgtctttgtacccttgccaacgctatgcccggctcctggcttcccgcgcccactacctcgccccctcgtttctcgcgcccacgcctccactaaccccacttgcccgtttgcggcgcacgcggcagatgtgcggccgtggcgtttgagatggggcagatcgtgcgcgcattaactgcgctcgccaaccgcgaaaaacgccatcatcgtgtccccaggcgaaacaaaccggctcgtcccgattcgcgcgctgctcgagtaatgtagcggtcttgaagaggccgctcattattgtcgatcggtttttcccttgccgatgcgcgcgatttgcgaccgttgggtttccgcccgcctgtggggaccggccccacctgtcaccgggcctaaggagtggcatcacgcccgagcgcctccctcgaggggggcggtcgccctggcgtaacgccgggggctactgtcggtgacatggggccgggggtatcgtgactagaggcttgggtagccgcggtcacccacgtggcctgaccccctcggggggggggtcgggcccgacggtgacgtggccacccctccctctgtctccccgaggggtcgggccgctcccgtttcggccccgagggctggggtgccccgaccccctgtggttttggcgccacgtgtgtgggttaggtgagcacagcgggctcacctaaccgcatttatagcaggttggacgagtgcgccacgccgcatttaatgcggcgcagcgcacgcttatccggtccgtgaccagtcgcggtgtgtgaccggtcacagaccggtcagatcgcgggttaggtggcaacaggcagcctgtcacacgcctcgccccgtcccgtcggaatgatgagagcttcgtggctctcgtccctagccggagccggcgtgctaactcctggagttggtatgtcagtcccggtcagatccattcctggcttcagcgcaagtatggcaaggaagtcgctggccattaaataaaggttgaaatgggcgtccaccgaaaaaggggcgagcagagcaggagacgtgcgctctgcttgtcagaggtcacttccggctgtagactagccctcattgtaaaagcatgtttcctttcttaggtggcgagaggcccttgtggtgacccctgaccagagaaaaaggaggcccaggcctagaaagaaaggagagagaaaaaaaagaggagaagagagggggcgaacggggctagagcctgaactctctctcgctctccggctctctgtattccttcactcacagatccaccagaacacaggagtagggtgttacgcttctcagcggcccgaacctgtctacgtcgcccgtgtctcgcgcatttcttctctcgctgacgttcctcagatcgagggcgaagaacctcacttagcgcccccggccgaaccggcaaaggggggcctgcgcggtctcccggtgaggagccccacgctccgtcacatgcacacaagtatttataacccacatgcaatatcttgatttgctattggctagaaaatattggggatgatgcatgcattgagtttgttgatagaataaatatagtatgagagagttattagtttgtcttggtcttgatatagctatgaaatatatagattaatttggaatggagggagcataaggttgccacatatcttgcgttagacaaatctaactaagttaggtggattagtcatacttaagacaagattctttcttcactatataggcttcgcatgccattgagataaaaagatgtggcaatagtggcttatgctaactaaagtgtatcttcaattttgttagccaaaccttaggtaagttggccaaaatattattccatccgtgtattttaatgtatgacgccgttgactttttaatcaacgtttgacaactcgtcttattcaaaatttttatgcaaatataaaaatacttatgtcatgcttaaagaacatttgatgataaatcaaatcacaataaaataaattataattacataaaatttttaaataagacgaaatgtcaaacgtttgtcaaaaaggtcaacggcgtcatacattaaaatacggaggaagacaagcttggtaataatttgaagtactgaactaattagcagtccagttatcttggtgtatgttcttgcgtgccttgttgattatgagaaggaaaatattgagacaatgtgttgtttcttttcctttggcgttgaaacatgtcgtctcggtgtactgttgattatgagaatgaaaatattgagacaacgttgtttgctctagataaacttaattgtctgttcatgttttaacgagctcagacgaatcgagctggagcctcgcagaggttgagcctgtgttaagctcgaaggtcagccttggctcgtgcgagctcggcttgttatagcagccggacccggttggtaaatgcatgggcatccggccgttgatctttttgaaagtgtttttgacccattctaccatttgaagctccatggcaagtatggtcaagctgagctgctaggcagatgtacaaaagcgtttttgactcatttctgttttaggcaatgattccattacgtctctcgctgcaacaagccagatgatgggccagtcgctcatttgggccggatgaaatgcatgtgacccgctagcagctaggcggaggcagtcactcattcgggaaggtagtagtagcgttgcttgtaagccatggaccatggtcacagcctcaggatgacaatgcatgtgaatatgtgatgtaaccgctagcagccttttccccgagacaatgccggaccgcggaccgcggaccgccgcacccctcaatcgacgcacttttgatgaggaatgcatgtgatggtagccatccatttttcctatggagggttcagatttgaagctgcattctcactcacccgataggcacagacatttgtgttcgtgcatagccgagttcttagcgggcatttgtagggaaaaaagaaaatctcaatttggtttcttttgaatggccaggtcactttgagattcctttatgctaaagcacctccgctttatccatcttccccctcttctctacgagccattgccgatatcgtacttcttggtgagccattctcctgctcttctgctcccgttttggccgaaactttttggcaacattgctcagactcacttcttttcttggggtttagtgtctgcttctttctctctcaggtagtagcgaagaagaataagaccctgtttagatgggattaaaaatatttttaagtctctatcacatcgaatgtttggacactaattataaatattacgtaggttattaataaaaacccattcataatcttggactaattcgtgagacgaatctattgagcctaattaatccatgattagcctatgtgatgctacatattaataaaactcatctataatcttggactaattcatgagacgaatccattgaacctaattaatccatgattagcctatgtgatgctacagtaaatattctctaattatggattaattaggcttaaaaaatttatctcgcgaattagctttcatttatgtaattagttttgtaagtagtctatatttaatactctaaattagtgtctaaatacagagactaaaattaagtctctggatccaaacaccacctaagtcattccttacgaagaagtgcttttcatagctctgaagatctgaataattttagcactgaaactttgtattagtttcaacaatgtgcagaaggaacatgacagtttgttaaacaaaagtacgaatttcaaaagtaaaaccccatactccagcaaaacagaagagaaatggaagccccaatctttttttttatatcgaagtagtagtaacaagttagcaacagatcaaataaaagtactgttagattgcgcaaatattacacagagaagagtttgtgaagtgcaactcaccagcaatattcaatagctctcagcatattgcacattaaggccttgtttatatcttaccctaaaattttacaccatattacattgaaagtttaaacacccacctcataaaactattaaatataggctaaaaaacaattaattgtacagattgcggctactttgcgagacgaatcttttaaacataattgctccatgatttgacaatgtggtgctactaataacatgtgctaatgcaagattaattaggcttaataaattcgtctcgcggtttactgacggatactgtaattagttttgttattagtgccggaacaccctttacgacatcatatataatacccgatgtgatatgccaaaactttaccccctagatttaaacactccctactgaaaacaacgtgtaacgcgctatggtgtgagaattctatttacaaattttgcatcacaaacgaatgaccaaacaaattctaggcctcacgaattcacgatcgaaacagccaatgaagcactgaaaaactacatatttcagatccaatagcaatttggaccatcaaatgacgtttctgatttgggggtttgttttgcagatttttcagaatttggagctgctgacgaacttggaggtggactagaaggacaagatcaaggagaaaccggagaagatcaaactcaagcagctgccttaccttgtctgcatcattgtcgaggcttgtgcttgcatcactttgcattaacgatgaaatttcatgttgaattagagggtaggtctaatcggcgatcgatcgcgattcggtcgccatgcacgaccacgtttccatgcagagcaaccgctttagccgatagcaatcatttcccattccgtatctctccaccgagccttgagtggttcatcctaatagtgtgatggtccagcccaaaaaatttatacatacactttatatgcaaaataattaatatataaaacttcatgtatagacatattatatgtgtacaaattttgtaagtacatgcgtacaaactttttatgtacaaattttgcacatataaatttgaaacaaattcaacggtgtgttaaattagtctcgagaaaaatatatatatagaattttattacatcagaaaaaactatacatagcaattttgtacgtatatattttacatatatgtgcatttaaactttgcacgtgtaaagtttatatctataaactttgtatatgtaaatttaaaacaaattttaaagtgatatatgtgggtttgaggcccatgtgcatgctggcagcccactctaaagaaaaagcccagctaaaaacaaggcccacacatcagtccagaaaggattaagtctattttgccttcctcatttcttgctcctgttaaaatcatattcctcaattgtacaaccagcgagtaatgtgactatgaaccgcgccaccgcaaggtctggcacctggaacgatggtgtatattgcatccaatcccataaaaaaacaacttatggggaagtgggacagagagtattttcgtagatctttcaaaaacacgtgtataaataaaaaagtttaaaaataatgtaacttttaaatttttattcgataagcaaccgcataagcaaaccgatgggggtgttatataatccaaacggaggatgtattaaatacatgttaacagaatgaaaaactaaacctgttttttttactagacttcccactaaaacacgtttcacaagaacagacaacactaagcgagtagggcacagggcaacgcaagcatcaaaaaataaacagttctgcgggtcaggcataaagaaaccaatagagtatccggaatctgaaatctgaggaagcataaagaaaccaatagggtatccggaatctgtaatctgaggaagcatatcaccacacagctgctacaatttgaaagcttgagaggttttaacagccctggattgcccctagaaaggaatcacaattttgtggcagccacctacaatccacaagctggcctccaaaagattttccatcagccaaatgaaaacgggtgaagaagcatcattgaggcatgacgagtcatagagcatgcgaatatccacgcacaaactgcaagtatataattaacaaaaaaaaactaaattgatgaaaacgaacaaaaagatcagaacaagatgtcctgacatattgtgatgcactagaaacttacgtaaccactgtctatctgttagcttgcgccttcatcttttatgtgcattgctaagggcttttctcttttttcgaagctctgatagactgacgctatcaacgtgtggttttactcttttttgaagctccggcactagtatcaactggtggcttccttttctctaataaaacattcttttggtccataaaaggctgcaaaatgtccttgattgcctacacaaaaaccaagagattgtaaataagagaaatttgtgatgttattgattgcaaaagatttcaaaatactgcaccttgctttttatctgtgtttgaatcttctgaacatgttgtataatagattgcaccttataggcccggacagcacctctattgtcgaagcagatcccaaccaaaagaccatcaacagtaaagacaggggacccaaatgaggcacaaggaagtagcacaatcatgagtaaaatccgcctttcttacaaacctaattaaacatttcataagagcctataaatataatttaatcatttaataggactaattaagcatttcataagaaccaacaaatctaatataatcatttaatactccctccgtttcacaatgtaagtcattctagcatttcccacattcatattgatgttaatgaaacagaggaagtaagacagatgaaattagataaaaataaggattttagctcaccggaccgatccaggagataaaaggtacttttggattctgatatcccaaggtgtaaacatcctcattaatcaacggtccagattcacagattttcacagcagctaatggattagtgcattttggtttgcttagcatgaaagagacaactatcagcaattgatacatcggtaaagttaatcgccacactctccatgttcaagccaggaaaaacagcagcatagagcccttcagaaccataacaaaatgtccccttgtctgttatgacgtagcatgatagcttcttcttcgcaataactattcctggagcaaataaagtcggttttcctgcactcatagctattatcctaacgaaacacatttgaaccttggcttggagattatcaaaagtatcctggtaatgaaacatcatattaaaaaaaagccattaggatcatttgatatctacctcctataaagaaacaagcatacaaccatatacaagaatttgaaaacttgagatcatgtacaatgggaggtatataaagaacttgaggttatgtgaatgattggtgcttataaatatggtgcctaaaagaaggatgtgtccatatcatcgagaactcatatataatttatattgtctactgcaaaattcttttctcaagtgtagattattatttttttgataagggcatgcccatttctattgaagtacagaaaacatggtaggaagaagggagaagtttaggagacaagacattacaaaagtcaatactcctacggtaagtagtttccacacacacacacacacacacagagccagcggaccagatccttccctcgacacactagaactactagaacagcagtactgagccttcactaactggagcgtagcctagggactgcatctacaggattgcagcatcgtgcagactcctacttgatacaaaagcaaagagaacccagccatactaacaatatagccatattaacaatactacaagtaaacaggacacgatcaatcactactggtaccacaagtgctcagacaactaccttttcctattattttatacataaacaactgccaagcatcacacacaaaaaatatgaacaacacaaatctgattctatttactatataagcactccatgtaagcacttgcgcaattaagcatttataacaacagaaccaagaaaccaccacgggctgctgcaggcaggggttcagccaacttatttcgagaaaccaaagagagagcaagttcagtacaacattagttttgcctagtgccttagaccatgcaaaacatcaattaatcgtaatgtatagaaaaagtgagtgaccgattcaagcacatacgaacagaaaagaaaaaagaaaagaggaggggaaaaaagcaagctcaccttaggcagcattttgcaaatgggggaaacaatacccaagtaaagggtgaatcggtgtagcaggtagccaggccaccgggtggaggtgcctaggaagagagatcgtcgcagtagcttatgaagtagtggcgtaacaagaaattttcgtccggtggtcctgcttcacaagttcacatcacataccaaaattttgtatcaccgcaaatcccatgagtacaaattcaggtaaaaggcgaacaaatataccaataatatcttataacatcagtaatcaactaatttaactagcaagttcaaaatgtgcacatattacaatacagatagttcaaaatgtgtactccccactcctcttcatgtctttaccaatcctacaaactaaaataagtccgcggcacatcacaaatttagcaatggcaaatgcttccttgatcaaacacagtgagaataatgaagatatgagctagaggtataacctgtaggagcaggagacggcagccgggagccgcggcgcggagggtagagaagccgcgaacggcggtcgacagcgacgggcaggggatgagggtcaggcgacagtgcgagagggagccagtcagacggggttcccgagctcccggagctggcgaccggtggcggtgcggcagatggacgccttcgctcggcggtggtctgtggctgtgccgatgcggcgccgcggcggggaccggtggtgtgcgcccccgtcctccggcctacgcggctcgggacaagcggacggcggcggcggcaccgagacccagtgctcagtggcgacgaggagaggcagagagaggctgcgaggagaggcgaggcaacggcggcggcgcggtcacgcgcgtgcgagggagcagcgcagcgccgccgcgaagcgcattgccttaccgagacctaagcgcagcgcccgcttctccttctgcttattgggcctgagtagctgggccaaaatcggggctagtcccgaaccaaccgggagcgtttgccatttggaaaaagtatatataagatccctcatcttgtcaccgaattacaacatcgtccctcaactgaaaaaccagatatatatgatccctcaacttacaaaaccggatcaccctgagtcataacttacaaaaacagattactctgggtcattaggtggttgacaccagttttgtcctacgtggctgccggtgggtgaactcctcaagcgggggagtgaggccccctttgttaattcgggcggggggtagcgggtgagaattgagggtttggatggatgtgtgctgtagagggggtcggggcccctcaagagcaatgagataaaaggagtttatacaagttcgggccaatgagaagcgtaacactctactcctgtgtatgatgatttttttgagctttgaaagtctctgaatctcggatgtacaaactagagttggtatgcaaaagctaatcttttgatccccccaccaaggacatgggcctccttttatagcctaaggaggcaccacaggagtttaccggattacttaggggagaaggcgaaaaggaatttatcggaggatgaactcctcgagcgggggaccgtgaggctcctcctttgttagttcggcctagggcagtggatgaaaattgaggagctggaagtatttgaagaaatgagggggtcgggccctcgagaggggtgagacaaaagagatttagataggttcgggccgctaaggagcataataccctactcatgtgtatgataatttttctaagattacaaagtctctgaatctctagcgaggaagctaagactcagcttcccttcagaatttttaggtttcaaccacctccttcgtaggcctggacctccttttgtaccttaaggggttaccacatatgccataagagctacctagagaggagggaaaatgttctctacattaaatgcatgtcttgtgccttagctcggaagccatatgcacattgccttggtggtgagcccattagaacaggccacctgacacggggggtgccctcgtcatctcccatttaagggatggagacttctgggctcctgttacaccgggaaacgggatcctttctttgaccagagcgggcggaccgactccagctggaatgagaggctgaaagcctctcgtcattatgatgagacggggcacttcaaggctgtaggctgcttgacagacggacagtgcgcaggtgcactacccctagtcccatcggttattcgatcggtcacggaccggtcagacgcgctgcatgccgccataaatgcgggtaggtgggctcttgggggcggccacctaacgcatcgcacgtggcgacccgcggagggggtcgaggaagcccgacccccggtcgcggaggggggcggccgcccccctaccccgggcccgaccccgctcgggagagggccacgtgggcactaggggcagcctccttcctctagttttgataccctcgggcaaggaggggcagctgtcactccaccccgggcccgaccctcctcggggaagtgctacgtgggtttaggggcggcctcctccctccaaacatgatacccccgggcctatatcatcgacataattgattatgctaaagagcacgttttattctattgacatgacgaccacatcctcgaccgccacaacatgggcccatcaaatcgagccgctagacacgagggagcattgtgtcattcgccaattaatggatgaagactcttaattgggctcctgtttacaccgggaaacaggaggtcggctttagaccagagcagatgaaccagctctgggcggatctaggggctagaaaaaaaaaccccaccatcacgatgtgatgaggcggggtaacttgccgccgcctgtcacctgttcattgactgggcggggcaaaccgtctgccgcatgtcactttgtcagtggctaggcatggcaagccacacgcacatcggctgccatatggggcccaccacatcaggccggctgacatgggggacgcctgcgtcattcatcatttaatggatggggacttagagtgcaggcttgcaccgggaatacaaactcgggcctggccacaccggatgggatgagtggctaagagcccctcatcattacgatggaacggggcataacccgctgcacgccgcctgacatgcggtcagggcatgagcgctctgcagtcgtcccatccatcattcggccggtcatggaccggtcactgaccagtcacaggccggtctggcgctcggcacggcgtggaacgcccgctgcaactgccttaaatgcggttaggtggacgctgtgaggcacccacctaaccatatacacgtggcggctcgacccctcgggcttggaggggatggccgccgcccatccttgggcccgaccccctgggaggagtgccacgtggacactgggggcagcctcttccctccaatctttgtacaccctggcccatatcaccgatagtggtggccatacctgggtgaccatgtcatcaccctctccctctctctcccctcttctctcctttcctcctcctccttcccctctctctctctctctctctctttctcttctaccctcgtctaggtgggccggccagccagcgggttcgaaggaggccggctgaaagggtcaattaggcctagaggggggtgaataggctaatttaaaactttatgcggaagctaaaactgaaataaggtcggaaagtctgatccacagtcagactatccaaaaatatcagatagtctgatgttggatcagactgtctgatccaccaatgaagcacaacaagtagatctatcacacagacaagagtaaagcacaaacagcaactagatctatagtggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttcctcaagaggttgcactaagcactcctccttccactaaggggtatctctttccttgcggaggcgagatccggccttcacaaacttctcccggccaaccacacatagatcggtggctcgggagtgacacctagccgtctaggagtcctcaacctccaagagtaacaaacaccacacaactcttggtcaaaccctagtgctcaatatcgagtgaaacacacactaggccctcaaacaccaaatccacaaccaccaagatccaccacacaaagaacaaggagggatttgagagagggagaaagagctcaaagatccaaagcaccttagcaccaagttcaacccaaagtgaatgagaatgaaatgagttgggtaaccctagaaaagggttaggtggggggtatttatagacccccccccccaaaaaaaatgtggtcgttggagaggaatctttcagcccacgtcggatagtccgatacaagatcggatagtccgatattttaaacctccaaggcaacgagaaacagagaacgaagttccatgaaatttcggactttccgagacatcagactaactgatgttaaatcggagtatctgatattttagaagcaaaaacttcgtcctcaaacagagactcaagttctatgaaatttcggagtctctgtatcatcagactatctgatccgacatcggatactccgatacttagaaaaactcactcgataggattttttcaaatcaagacagagagtgaagttctgtgaaaaatcggatagtctgatttcaaatcggatagtctgatgttgatcaagtaaaactacaataactttttactccgaactccgatttcgaagatcttggactctatgaaaagctagtttcgtgggtcaaacccaacataaaacatggtccaaaaccttcaagagatgttgaaaaacttgcaaagaaacccggtgtaagtgttgtgacaagtgaaacaactcgggattgaaatttttacttaggtttttcaactcacacaaagatgaagcattttgagcactagtattctaccaataatatgcatgtggtatcgctcttaatagtacgacattcctacgacacaatgtaaggtaaaagatacaatataccatttgatcattgccgcattgcatcgtgatgtcgcattcatggggtatgcatctcattacaacatgtcgaggacataacaaccttcacatttgcttgaataaaagtgttagtcctctctaatcgcattgtaatcaatcatcaaaatcattaggggcctagatgcactttcaccggcaacgggtgatgcggtgggcggccttgttggtgcagtctaggagttgatgaccacacgtgccacctcctccgcctccacctccacagtgcacacctcccacaccatccttctcgccaggaatccccttgctgccgcccacctcctcgacgacgcccaccaccaatcctcacgccctcgtcgtcgccaccggctcgagacctacgacatcgtcgtcgaggccacgcgccgcctacaaccgtgtcatgttccagctccgctgatccaaggccatcctcaacttccccaacgaggtcacagccgactcaaattcctacatgaaattttctttgaatgcttgtctataacttttctaactttgtactagtgaaattcatttgtttataaccctcagtagctattaaaaaactaaacaattagctatctcaaacggagcctcaatattcaaatataaggaatattaggttctaccaatatctgttctgaacatactaacatatacttcctccgttccacaatataagatattttggcatcttcatacctcgtctaaattcaccaacatctatataaattaggacgcgtatatgaaatacatatatggatccatgcatctatttaaaacccaaaacgtcttatagtgtgaaataaaagatatcatataaattcaccaacattcatatgaatttggacatgtatataaagacacatacatggatacatgcataactatttaaaactcaaaacgtcttatggtgtgaaatagaggaagtataaatttaaaatataggtgtatatatttggcatatcctttttatttgtgctataatatattattagtctgtttgttaaaactctaattcctaaatttaacttcacttgctttagagtggagttgtgaagcggctcgaaccccactcagtttacctctctagtccattttatgatagctcttcagtatgttccgctccctttttaggtgaagctatagttctgccaacaagctctctatctagtactactggttctattatagttattggttaagtactctctccgtcctagaaaaaataaatctaggattggatgtgacacatcctaatacaacgaatctaaacagatatatgttcagattcatagtagtaggatgtgtcatatctaatactagatcggttttttcttggacggagggagtaatgccttccatgtgcatcctagccattcagttctctaggcaaataattagccctccgaaatcttgctatttagaagtatttaataaagtctatgtacagaactacttgttgaacccctgggctaattcgcaagacgaatctaaagaggtatattaattcataattagcggatgattactgtagtatcactgtagtaaatcatggattaattaggcttattagattcgtctcctaaattagcttacgggttatggaatgggttttgttagttatctacgtttaatacttctaaatagtaagattctggagggctaataattagccctccggatccaaagaggccctagttgattatgctcccttcaagagccagaccctcgctttcccctatagatggccatgaggcccgctcggcacggcccggcctaggcacgactaggcacggcccaccagccatcgggccggcacggcccgatcggccgcacctccggcctaggcacaacccaccagtagtcgggccgtgccgtgccagcccgaaggcacgggtggcccatcgtgcctttttttaaataagtctattctccctccctcctctttgggctgtgacatactccctccctcctctttgggctgacatatatatagctaaaataagtctattttatgtccctattctttggaccgtggcatataatatgtctatttttactccctttcattgtgtgttgggcctggctaccggcccaacgtgccggaggaggggcccaggcacggcccggcggtcgggccggaccggcacgggccctaccccgtcgggccgtgccgtgcttaggccaggccaaaatgtcgtgtcgtgggccggaccgtcgagcctcggaccttttcgccatctatactttccgctttcaagctacagctctatcgtcgcttgttcggccccttttcctcctttcctccgatgattcgtcgtcggcggagagagggagaggggtccggtccttccccctagtattaggttagtttagtcgggtttttcctgtttagtcggggttctcccgttgtgtagttggttttttgagtccggagcaagatgaacacagctggagctagctctggagtttgttctcagggtcttctagtcatcactcgggatccctccagatctgcgagttcacaggtagcgtcgaccaactttcatttcttcgacgaatttcttcctcggctggttctcctctgctacttctccagcgaaggatttttttttctccaaggcgtttgatatttccaagtctagccgagatggtctcaatctcctataaatcgggtatgcctctcagttttctttgcaaactgctacgttctctctctaatcctcgccagtggaatagttatagggttcatccttggaatttttgtctgcaagccaactttcgccagtggaagtggaatagttatagggttcatcctgccagtggaatagttatagggttcatccttggaatttttgtctgcaagccaactttcgccagtggaatagttatagggttcatcctgccagtggaatagttatagggttcatccttgaaatttttgtctgcaagccaactttctttcactgatccggatccggatccggcgaatttcttatatgttgttgctgatattattatgtgaattccaacatccaaacctcctttgcaaggccccgtttgggacagcatgttggttcaatctcctgcagcgcatcctccaccgtcagagtcaagtttctggatttcgtcgttggggttgaaggcaaaaaagggggaaaggactccattgctttttgctatttttaaagtccttttctgcactttattaagctcaagtgtaatttgcccagttctaaggggcttttctgcaaacctggttgtattccagtgtcctccactgtatgcaaacttgtactcgtgtactgtgttacttctcttacttaaataaagttacatgagttcaaaaaaagaaaagaaaagagccagaccaataatcggagaatgaaaaaatattaccaggctattctacttttacttgtcaggagcatgaattatctcgatagaacattatgcaacttttactaggagccagttagaaggaaagaatacgtatgctccacttttctatacatcagctatctatatgatgtcttcaaaagaagtgatccattccatcctatagcacacaatgcactgtcgtacaacacaacgcacaacgaattgaagaggtaattcatcttcccaaataacatacttccttcatttcacaatataagtcattctagcatttcccacattcatgttgatgttaatgaatctactaacatcaacatgaatgtggaaaattctagaatgacttacattgtgaaacagaggtagtaccaactaatcaaccagcatgtgttgctataagaactcaaaatgtagaataaaacatgagttttaataaacagtcatatcaatattaagacagaaataagcgcttttttcgggagcaagacaaaaaacgagcacttgtgcagatgtgctcagcctccagtagtatacatgtcaggaaataaagcagtgattgtgtgcgctttgctcaagaaggaacagatgagcatcaaatgccttattttaccatcacatattgagatgtttatgaagacgtcaggccaaagccataattaagataactcactccacattatttgtttttactggagctgaaagtgaactctaacatttaggaaaaatgggagtagcccattaccaaaaacaaagttcatatttgaagggcatccgcaatcgaaccagcaaggctcaacacctcaaatggaggttgttggttgatggctttcactgtttgagggcaggagtcagtgatccagaaatacgcaaacttgtcagctgacccagctgtgagtgggaaaaaaaagggtgagaactgaagttgagtggctgaaaggtagaaagagaagagaatcacgaattaccggaattagtgtgagtgaagcgctcatacgactgcttgggaaaaacagcatgagtcacgtaagcactaacttttgcagcaccatgagcagccaaaactttctgcaaaataattagacaaagaagcattaatgagaaatgcaacataaagcagcatatcccatcaacagtttatgaattagtacgtcctcaaaagtgttaaaacaattacatggagtaaaatgaacatcaagcctactaaaaaatgaaaatgcaaaaataagcatgtgactgactttgctaagatcaggttttacaagggcatgtaattaatctctgtttttcaggacctctgcctgttggcaattaatatgtgaaacgtatattataggaggcattactctttgtcagacaactaaaaacaaagatagcaaaaaaccatatccctcttggcctctcccactaaagtggaagtaagaaaatccaacattagtaaaaattaagtcactgaagcactactttgtagtatcatggcaaagccacagacagtatgttgatacctgacattctctaagagttcccccagattgcactaaatcatcaacaataaccacatgccggccttcaggattcccctccttaattcgaactatcctcttgtcaccttcccgaacctttgcgcagacaaccttataatcaaacagcccaaagtaaaaactcggagtctttcaaccagaaaaaaaaaagagcaattccacaatggcatgcataaccgaatttcgacatgttcattcattcacacaaaacaagaagctaaccattgggaagttgagcaatagcttgtggaaacgcttccacgccccatcatccgggaaggcaatggtgatctgcgcaacacacaaatcacacaagtcagcagtagcaacacgaattgggtacttgaaagaaattagtaggacaccggtggccttgctacgcacattgtcagcatcggggagctgccggaggcgctgcagcaggagcggaatcccggtctcgaagcaggggaggacgtcgtccccgaagtagaacctctcctggagcgcgtggatgtcgtagatgacgacgctggtcgggccgccccgggacttgggaatcatggagaggatgcgcgcgagggtgaacgcggtggcgacgtcgccctcctcctcgacgcgctcgaaggagcccgtggggaagaaaggcagcacgagcgtgaaggaggcgatgaacagcttgggcagcgcgaagatgacggagatctgctcgaagatgaccgacggcgagctgaacgacgccaggaacgccacgtgctgcccccggatgtcgtgcgcgttgttgatgaacaggttggggaacccgtcgtcgaagctcctgcgcggcggcggcggcggcggaagcgaatcagcgaatcaggtgactccacgaaaccggcgaggaggaggaggaggaggaggaggaggacggggagcgtacctccagttgatggactggagatggatggtgtcggagctagcggcgaccttgagcgcgagctcctcgcactcggagcagtagaagaggtttatctgcttcttcgccttcggctgcctcgccacgacgacctccatcctcgtcccgggctccccggcgggcggctgcggcggcggcggcgcgcgcgagcggaatctccgaaaagaacggcgcggggggacgcgagcagtgtggtcggctttatcgacaggggagaagcagcaaaggtctaggagcaaattattcgctcaacacttttctttttttttttcgcgagcgtaaaccctagcttagaccccagccgcgcggcgcgagccacgaatcggcccgtggtatgatcgatcgatcggccgacgcgagcaggctggatttgggctcgaggcgagactagcacctactagtagcggcgcaaattggggaagaagataatgcgagatttttatagagcgctacttgcaaaaactgacgaaaaaaaaacaaaaagggagaaagcatggaacgcgccgccgccgctgcaacgcgacggattactatcaccaatccgataccatatggtgtcatagagaggcatgaagtacacagccaacggctggctctcagggattaaacgtcggttctaaaatatactctccgtttcgaaatgtttgagaccgttaattttttagcacatatttaaccattcgtcttattcaaaacatttaagtaattattaattcttttcctatcatttgattcattataaaatatatttttatgcaggcatataattttacatattttacaaaagtttttgaataagacgaacggtcaaacatgtgctaaaaaatcaacggtgtcaaacatttcgaaacggagggaatactagtatactaagtacaaatttgaattgactgatatctaatactatctaaacggatattcgtacggtcagattcgctaaacaaactcttaccacactatctaatactattactactactaatctataaatagagagtcgctaaataataaactcttactatacaatctaataacctgtttggtacaactccaactcctaaatttagcttcaggagttaggtctgcagtgaagttgtggagctgtctaaacctagcttcacaactctagttcattttatgagagaactccacccaactccactcccagttttggtggaactgaaactgtttggctgagctccagctccaggaggggtggagctggagctgtacctgtaccaaacaggccctaatactactattagtagtatgtagtgttagactgtagtattatataatatctaattcattatttggttaatatattttagtacgaatgaagcaccgaagagcattgttggtgaaggtttttcccatgaaaacaaagtgtacagaagcaagggaatcgtaagaagcatatgagaacctgagcagaagacaagaaaatttctcgagttctaatgggagacatgggactagtttattccccacttgtctctagtggggtgctaatttacaccagcccgtcttgtgtgtatgattgattatccttagccaaaatcaacggtacaaaaatcgtaagttacagaaatgtggtcaatccaaaaaggtatacgaaatcaacacctgaaaagaatgccaaaacttttgcaatgatccaaccgctgttcaccaacagaatctgctccaggcctattcaagaattaagataaaactggcgtgtttttttcaggagcatacctcgcttctccggaacaaagctaagagctgccagagtatctgagtatatacaagtctagctaacgcacggatcagttgacgaatagcccttttccaaattgaatttcggctcgctgggatatacaaagacagttgcggctgaggctgaaggagtcagtgcagcagaatacctcactgaagttattgttatccttggcagctgctgggaaccagaaccaagcggcacaagcttatggctaacaatatgctcggttttcggcagaatggatgcagcatgattgtgagccccagagaagacgaagttctgggaatcaacaagagagtacttgatttcctgaagtaaggatgttgaattgtagatcttcacatgaaaagtgaaagggattccaaggatagcataaggagggcactccatggtcacaacaagtggcggctcctcgatatgaacttcaggtaacctttctttcattataacacggctatcttgactctctccaatgcttgaatctcttgaccagctcaggcaaatttcacctagaaaaaagcttggactaatagtatgtggattcactgaaaatattcctttgtattcttcactaggagcaataactgcgtattcattggaaatcccactgatctgttgcactgagcagagttgttttccatcatcattagacacaatagtcatcgtgtgtagccgcaaaggtacctctgtgcaatttctagcacttaaaataagcatatttgactcgttgaaagcaagagaactttttttatcatcatcacttgaggatctgatcctagataataacaggggttctcgcctaaatggtctcaaaaactgttgactgactatcatggggatcttaccttcaatttgcaagcttctgtgcacattaagtctgtgcagtgctgcttcttcagtcgagtccagggaatagccaagtgagacatagaacatcactgacattgcttgatgccattttatttccaatttgcatgaccaggaatcacctgcatataatgtgggaacagatacaaccccaaacgagtgctggatttttcttatgctatcaacttcttcctttgacccattttccgtggtcacatctgagacaccaagaagttcaacatgatgactttcagattcttctgcttccctaggactcatcaaaaggcctccacctttggcatcgacaaggttgattttcagttcaccagaatgaactgcgtgtccttttgacaatatggtcactgggactgtaaataattctccaaccaatgcaggaccaggacaatctaagacaaggtcaacttgagcatctggctcttcaacttggatcagtttctgcccagaaaaagcaagtacattgtccttcataggtaatgcctctacttggtcctcaaatttccacaatgaaaattctcccattgaaacaggactttccgcttggcagcaaactacaagacgtttacttattgttgccttcaccgccaaacattccagctttccactctgtcctgcagaaagtactcacattgttatttcatgataggactaacagaaggggaaaagttaacatcagcaaatgccgaataaagcttaaattttgattttcaatctatcagccacagccaaaatttggattttagaacttaattttatagttgattttgatgttttttcatcgtagttcattttccagcattggcatttaagtcgctaagaacgcatataaaagagttttacccgcaacttatgttttggttgctaataagtgtcatgacttaaaatcggttgtacgcaaaacgatgagactggtaatgtcctgttgtttctgtatgttcagattaagatactaatatgacaatatttacaggttacttttcaagaaataaaacatttacaagttacaatacgtgcagagagcgggtggatgaacatctaatgaaataaactatatataatatatataactgatacctggtttaacttcatgagtcaaccgcatccatttatcagtgaacagtgtcagaggagtctgaacagctccatcatgaacatgtgaatttgatgcagaacaatcttcctgtgcactaactataacaaagttacagtcggattggttaaactgaacctccaacttatcaatcataactggacaaggaagatgagactgtagagagacactgacaagcattggtgaatcaggttttacagattgatcgtgaaaagcaacagatgcgagaaacactatccttagtggacttatttgatcaatatcgaggtgagtagattcttccatcaaatgaagatcaaattcatcatcagtgttctccgatgcatgctttccttccaagatattaataacttcctgctgtataagctctctactggaaatggtaggagatcctgctggtccatttttccttttattttctgaatttccctgtccactgccagagaataaaggtaatgcagccatctcaagtgaataactgataaagtccttcagagacttaagtttccttgcacattctctcaagtaacctaggttttcccaaagtaaagtggcccaaccttcttgacggtataggccagcaacaccatcaaaaagttgttttgcattactaaaatcccctgctgcataatactcaatggccattccaccactacaggcagaagccattcttgtggcacctaggctccgaaatgattcataagcttttctgaacaatgcaattatctcataggaatcttgaaacctttcagcttctgacaaagcatagctggtatactcagtatcagaaaggctgcaagcacagtgtcagatataagtagtcatataaaaattacgttaacatctaaaagtaactaagggtcaaagaacttacggaagcaccgcaactgtatctccttgctcaaacaagcgtacatactgaccaacatatacggaaggcattactgactcaggtaatccattgactcctttggtaaggcttacacttgatgaagagaactctaaggcatacctcttctctctcaagtaatttgccgccaactgccagaagggaaggcatcataaaaagatcactagtgtggtcaagtaaaaggaatgaaatatcctctgttgtagtgctgtgtagggagaggttgaacctgatagtagtaagctggttgaaattcccactcggtcagtgcgttgtcagcagtgccaaaacgaggagatagtgtatccggaacagttgtagatgttgtttctatgagctcaccaaagacaaggaactgcctgctaaaccattcccagtgaagaaaagcaacttctggtgatccaacaacacgctcatagcttctgatatgcttacggaaccatgtgattgctcccacaaccttccccccatgaagtaatattgttgatatcttaaagtgaaattgctcagcaactgcttttacctcaacaaggcgttgtgttggaggcagtcttgttgaagttcctatcatctaaataagagcaattgtcaatgcagggtgtaaagccaatagaaactgcttaagcaatagtgtcggaaaaataaaacagtaaggaatcttgaaggctttcaatatgtaatgtaagatgcaaacacacatggagaggatagggcaggatagagtggtagcttggataaattatctttaatgctagacaggtatgagatcctcatgaagtgttttctatatttaatattttaaaagtagcacgtgcacaagagtatattcagcattacaaatatatacgacatttggatggatagcaaccatagctgtctttctttatttactcatgagttcagtgtcacaataatctggcttctaaaagagtatgtcaggtgtggattcacttaattatcagtcttttaaggtctatggcaaacatggaacagggatccaattcacacctcacgcagaacacgaatgccctcctcatagaactttaatgcttcaggccaatcccgcctaaactccgcataaacagcgacctggtgttagaatcagaaatatcagaggaatgcagcccaaaaaaaataaaaattagagtagtgagaagtcattagcactactgactttaccaagcatgtgaagaaaaatttttgtcccaataccacgggcattaagaatgactaacagtgctaaattgaaccagagagagattcctcttcctaccttgaaacagtagcgaatgctcagctcaacagatgagaaattccttttctcgatgcgagctttgacccttcgtccttcatccttatagtatgtcgtacataactccgcaaaaacagttgtcaacctttcaatacagaacataatgcaggttagtaggtataactccaaggaacacatgaaaaagaaaagagcaaaagatagtttcaaaaaaaaaagaaatataacagtagaagattaaggggaagtttcagagcatacttgttgagagatttggtccattccatttcatctctctcaaccaaaacaaccaggtgctttgaatcaatttctgcacgtttcctcagagcaaccgtaacatcctcgctcagttcatctgcaaaatgttattggctatctggttaggtttgacgacacaaatatcaagcgagtataagggtctgttatcataaggcccatgcccaagcccaaccctcgattcccatgacgcagagtgtaggcattgacatgcgtaaaataacagatctaatgctgttgcagatatggccagttgcagattgtttagctaagcttcgtaagctaaagtgctaattgcttgttcagcgagaaaatgtattactattacgtatactcgagaggatgcttaccaccagcttgactctgtacaaggatcaccactaatttagtgtttcttccctgaatcacagacctgcaaaaaaaaaatgaacattacttggtatttgcgaattcagtctgtgctacactagctgcttatacactgctgatacttcagaaaagtccttaatccaaaagaggtcgatagtttccaatttgcattgcaggggtgatatttatgagttctgattatgcgcacatctatttgggatcaacgatgcaagagatgtagaggaggtacttgaggttctcgagatcggagcaggcctggagccactgggcggggtccccggagacctgatcggcccggaacatcgcggcgacggcggcgggcactcgggtgcggtgcttgaggagccagtccttcttcaggatcccggcgggggcctgcggcggcgcgagcgggtcgcgggccttggcggtgcgagcgaggatggaggccttggagaagtccgggagggcgagcaagttcatgggcggctgcctggagctcagcgccgccgagatcgcggggtgcagctccgggcaccccacgatggacaccagcgacagcggcggcgtccgcagctcctccgggtagtcctccatggccgccccacccgcggcgccgcggcgaggcgaggcgaacggtcgggaggcgctaggtccggtcgccgccggggtggtggccggggaggacggggagctcggatctgtggtgactgtttggttcgtttggaagaactgggtgggggcgaggacgacgacgcgcaaggagtggaaacacgtatcgctatgtgagatgtaataatgaatatagtcagggtgttttctatgaagtctgaaggaccttgttataaaatttcagaattctgacagtcatcaggttaaatgaacaaatcaataaactacgtagtagcttgtactccctccatactcataaagaaagtcgtttaatacaatatttaagtcaaacattaggaatataaatcataaataactctcaagttgttgagtttgaaaatataaaaattatatgaatagatttgtcttaaaaaaaatactttcataaaaatatacatatatcacttttcaataaatatttttatagaaaaaagaagtcaaagttatgttttggagatcgtgtcgctgtccaaaacgactttctttacaagtacggagggagtagttcgtttatattgaaaatgaagatgaacttagagcacggaaaacaaaaaaatcataggcgtatgattaattaagtttagttattacaaaattagaaaatggttttatctaacatttcaaagcaatttatatatagatagttttcacacaaaatacaccagtaggcagtttgaaaaaactaaaatatagggatgcaagcgggtcaacccgcgagttcacttataggtcaaatactccctccgtactcgtaaaggaagttgttttggacagtgacacggtctccaaacacataactttgacttcttgtttctataaaattatttattgaaaagtgatatgtgtatagttttgtgaaagtatttttcaagacaaatctattcatataatttttacattttcaaactcaacaacttgagagttatttatgatttatattcccaaggtttgacttaaatattgtcttaaacgacttcctttacatgtacggatgggagtagatgataactcatggatttttgcaacgtggtccggcttgccgcatctagatatgcaagtgggtcgatctataaactcatttataggtcaaattaatagataacccgcaagtcaaatccatgggttacccactaattttgcctataaacgggttcgcggacaagcctgcttgcacccctagtgaaatattttttaatggcaaaagaacatgatctgtttggatcccatgaagacgaatattaagtatggacatgtaaaactagaaagccaataacacatggttaatttagttttaattattttaaacttagaaatggatttatcttatatcttaaaacaatttcacatagaaagttttagcacaaaatacatcgttttagcagtttgaaaaacgtgctaacgaaaatcgaggtaaaatatgtatcttataagacaacggaagtcattcgaatttttttagtgaatatcaacaactaattcctaactacactaattcgaaagtagaaatcacagattcagaggtcgggtggaccgacacgggaacagaggaggcccgtggtggtggggcgacgccatgctccctagcctcgccactcttctcgccaagttcacgcttcccctcattgtgtcgccaaaggtgatgacacctagcctctctctctcctttcccatatcttcccattatgttctctcctatcttcacgacgccgaggcctgaggccctcacgacagcaaaaatgacaacctaagcatcaacctgagcttccccgtcttcgtcaccgatagagctcggtgatgccgccgccaccgtctagctcctctctgccgactaccgcccttctccctacacaggcacgtgccatggaggcctgaatagagatgaggaagagagagaggggaggaagaagatgttgtttcaatatttaggaccatcatgatttttttttattttctatttttgcttttggttccaggtcagcttaacacagcctacaaagctgccttgggactacattcgtttgttttgaaagataaagaacgtgtgttatacttatatctggtactgcggtccaaagacacgattcgaactcaacgtgaattatgagggacctaaagtgaacttattctatcacgcggttggagttcaatagtctatcaggcccatccgggcagagagaacaaagcggcccatccaggcagagagaacaaagcggcccaccactggcgggagtaggcgtaggaacaatctgtccctcgctcgcaagccgtggagatccatcctttttttcccattgcgtgccagttgccacctctcaaccccccgcccctggctcaccctccgggcctccctcccccctcctctcctctcccctctctcgcggtcgcctcggtgcagcccgcgaaaatagcagccgcccgttccctccctctccctctcccctgccctgccgaagccgcggcgatgaacggcgccacggccggctccggctccggctccgaccacgacgacgcgcgcgccgccgaggaggccagaggggaggaggcggcaggccgtgccgtggaggttgaggaggaggaggaggaggaggaggcggtgcccgtggcggaggagagggccgcgtggggcggcggcggcactcccccgacccccgagccgaagagcgacgcggacgcggagggcgcgggctcgctggatcgggtggagctcaatgcaggggcgggcggcggccgtgagcgcgaggacgacgagggggaggacgaggccgtgggggcgaggggggtggagatgaacggggaggacgccatgagccacgacggccacgacggcgatgaggatggcgatgacgaggaggacggcgacgacggcgaggaggaggaggaggaggatgatgatgaggaggatgacgatgacgactccacccccgatgcgtcgccgagggcggaggcgaaggcggagggcgagagctccaccgtgatggcgggctgcgccaaccagcccgctgagcccgaccccttcctcgacggtgacgactctggaacggaggaggagcaggcggcgttcatggtggagctggagcgcttccacagggagcacggcctcgagttcaagcctcccaagttctatggcaaaggtctcaactgcctcaagtgcgtgtctttctacacctctcgtttctgttagctcctcaacccgagtacacccatctcttctcgtctaagcttgctctgttccttttccaatccaggttatggaggcaggttgcccacctgggaggccatgagcaggtatggtcctcgactccttgtcactagcttgctcgctgctgctactgtagagtaaaatattttcggtgacatatgtccgggtggatcacgatcaaataagttcaacagtgattagtgagctgcaaggacctgagttatatttattctagttaaatattttgcttgttcaggtaacaatttgtaaactatggcgtcaagttggagagactttcaggccgccaaagtaagcctctaattttcacagaacatgttattcgcagaaaaaaaaagacttccatatgtgagtaatttgttgctgccgtaatcctttgcaggacgtgcactactgtatcgtggtcgttccgaattttctatgagaaggtgatgcatttgctgcatgattttcttttgcctctgtacttgtcacaagagaacttcccccttttcagttctttctgtcacaagtaaatggtcaccaacaatcattttttttcctgcaatcagtatcatatcgcatcaactttattgtaagttttagttgcaaaactgttagacttattagtatagttcttagtttcaaacataagaattgatctaaaatgatgggtctgcctttattagtgtaaaaattttaggggttcccgtgtcagttaatgttgcttccttttttggcagggaatatttaatgttcttacttcttacttttagtttaacgagcaattatcttacttgatgcgtcccttcatcattttattgaaactgttgcgctttcttcagatgctattactcttaattctttagatcattaattttcttagttatttatatgctaactgatgcatgttttggatggaatatagtacagaagcattattgtaagcttagattccatcccatatttatgcattgttttctgcttgatttgttaatttttgtttctcattaacttaggcacttctcgagtatgaaaaatacaaagtccgaactggccagcttcaagtaccattgtctgctttaccacagcctggtggtactggccgtgaggtaattgttctaatagtgcagtttttaataagagctctaatttattaattcagtttatattttagttcaatactgtacaatttaacgggattcaccctatttgtgtaaatctttaataattagatgaacacatgctgtccttttaggacctgtctaattcgcgcctgcgccaaaagtcatgatcagttacggacaggatgcagccacgcaggacttttttttaaaaaaaaaatcatcactggaagaatagtaagacgagagcacccagaaggcctcaatccagttcttgtgtccccaactcgtgcagcttgcatctcatttcttgaactccccagtcacagtcacgcatgggcatggcacatttgtttatagcttttcgtgcatagtctcccctaatcctttccctggaatttgtagcccttcttgttctgcatcccgaaaagggaaactttcaacttctcattgcaaaaaaaaaaaaagatgctactaaaaacctttgattggacaactttcatctggaactgaaaactttcacctggaactttcatctggttactgaaaactttcttttggagactaagctttctactagagattgaaaagcttcctattggagactaaagagcttttgatcggaaaactttcacatggagactttcatctcgagctaaagctttggagcacacaactttcatatagaaaaccaaaagaataaaacggaaaagagaagggaaagcataatcaatgtgcttgtcaggggcctcctgagtgaatgccaagcctaaacaaaattgcataccccttcgtgtcgatcaggcccgtatgctagcattcctcacaatgtgcgtgaggggatttacttttttttttatatccatttgtttatggaatggtgttacgcctttgttagcatgcacctcattagtcatgtataaatgaaagctgtgatatttacaccaacctagctgaattaaggacacagtctggttatatccggaaagaccaagggattttagtcactgaattccttctgaaaattgagtgttggttatggatccaattttattgacatagacgcactaataactgatttaagatgcctgccatttgttaaggtttccatcaagatgtgtggtgttgcgttgttgccaaaagtgttttcttgtcgatgcgtgtaaactactagttttagctagcttgacaagtttgtttactgccttgcagattggtatgaatcaatcatcttctgccagagttagaagggattctgcagcgcgtgctatgcagggttggcatgctcaccgtctccttaccaatggcatatatggagatcaaatgttgaaggttaaaaagatcttgctctttgtttacatgtaccttttcaagtcaccaactatttaatcagaaaagattcaaacttgtacaggaaaaagattcagtcccttcttcaagtcgtggtaagaacctaaagtatttggtatgtttgataagttttctttcagcagtgcatctgttgttttttctcatttatttgttttgacacatttaggagtactcaagaggaagaaagcatctagtccagagtgtgctatcaaggtgtctcgtacaaaaataaacaaatcacagttaagacttcctttcctttctgttggttatatagcattggctgataatgacttggatttagctacggaatatgtcattacaaaattttataggaaaatcctaaaaattacagttacattttgttcaattaagcttctcagcagaatttaaatccatatatttggatacttagcctatgaagcctgaacttgtatttatgtaacgggattctcaatttcagggatgactcaatggtcactgatgttggagaacctgccgagtgggtgaagattaatgtacgacagactgtaagtctcatatggtgcattgatattacagacaagtttttcagtgctcttctgaaatcctaatagcatatgagctggtttttctgttgagttgccatttttattcgggagaaatctcttcatttggctgtttctttcctgcagaaagattgtttcgaaatctatgctctggttcctggacttctacgcgaagaggtgaaaaaatatctttaatgttgaacgcatcacttcaaactgttccattttcctaaaataaatacctgacttaatttgtgcgtaacaaacaaaaagcttccacttcttgaactgaggcactacctgcgagaagaaatgaattgttgaattttgttctaaatggtgcaggtgcatgttcagtcagatcctgctgggcgtctggttataactggggacccagagcagcctgataatccttgggggatcactccattcaagaaggtgatagcagcaatttgaatactaatttgagcacgtttgcattctcttcagataacatgaagtgattactctttctcaggtggtcaatctgccattgaggatcgatcctcatcaaacatccgccgttgtcacgcttcatggccaactatttgttcgtgcaccatttgggcatgctgatatgtagatagtttcctttgagtgcagataccactggcccggtggtatttctggaattctttataggtttgtgattcaccgttgcatctatcccttgcttcaaattaagctcgtcatgctttgatatcaggtattctgtttttcatgcaggctttagacaattttgttgcagaagcaagtttttgtgtgagcagacgctcaatgccgagctgacaacggaattttgctgtaatcagtagcaagacttggggatctgctataatagtattgtttatagtagttgacataagtaggctggtttattttggtttgacctaccggagatttttgttttgttgtttatttttagtcggaagcagagtatatcaaaatagagagatgaaaataggttaaatgaaagcttaacttctttattttttggaaaacaaaggattagtttcttaacattattatttactattttcatagtaatgtttataagtgcctctgggcaatgcttgtccttaagcaaattttttatgcttgcatttgattcctcgtcccaatggactattgaattctaaattttgttgctggctatcatcgaatattaaggtccatgttcttttcagctatttcactagatattgtttgtggattatttgtttcatgtgtccaaaaatattgaagctgttgctaacttttctctaaaatttacatgagccatctctaatgaatttcgttggatttggtgaaaaaaattccacatatacaatcttatctacatcgaatttataccgtattagattacctgatagaggcattattttccaatgctattgggtgggttgatttgatagacttcttttgcttttgataaataatagcgataaaaataccaaactaaaaccccttgaaatcaagggcagccccatcgtttggcatacttgaggaaaaaacggaacggcatatttgcaaataaaaaataattgtgaataaaacttttatatacatgttttcaacaatccaaaagcaaaggctggaaaataaactatgatgaaaaattcccaaaatcaacttcaaatttaaggttgaaaaatttaaattttggttgataagtataatcgaaaagatgagaatgcgaggttgcgttcgttggaatgagttgggaactaatcccttgcacacaaatggaacgaattgtagcgtatgattaattaagtattagcttatttattttttatgagaaattaattaatatgattttttaaagtaaatttcatatataaactttttacaaaaggcaatacgttcgagatgtgaaaaaacgaggaatgtgagttgagaaagccggcaaaagaacacatccctaatagctccagtaactgagcccacttgtaactgcgatcctacggcccaactcccagggcccatcaattagtagtgaaacaaatccggtggtgggcccgattcgcaattcgccaaacggcagggacccgacgcgaccgcatcggcatcgcggcagcggcagcgtgcggtgccgacttgtgggaggagccgcctcctccgcctccgactatataacaaaaatcctcccgcacccccggcacatcgtccccgctagtcgccgccagtcaccaagccccgagcccacccccccaagctaccagcacagaacgaatcggagcgccgcgccgcgccgcgctgcgtcaccggcgatggactccgactacggcgtgccgcgcgagctctcggaggtgcagaagaagcgcgcgctctaccagcccgagctgcccccctgcctccaggtccgcacccacccattgccgctaatcctccttcccctgcgtgcgacattgcggtccctggcgcggcttcccggccctagatctgtgtgcttccggaccgcgcggcgccagatcccgcgccgctccggcgtccggatcagtccatctcaccggcgctggtcgtgtatactgttcgtctgcttccgatttgatttctcgggggtcttaggccataggtttacgtgtatcagctgtcagtctgtcactcgttttcggggaaccagattggatctgaatcgtgctggacctcgcctgcgaggtgcagggctctgtctagcaatgtactagtagatccaaccggcgtgcctggcttgcgggaggctgcgtgcgcgggggaatttttttttttgaaagctcgttttgccgtgttggtattgtcgtgttgctgttttatttatgagtttagtagtggagcgtagcaacttggaataaacagtagatggattgattcgtctacagcaaccatggacttttctttttggactagctttcacggtcctgtgttgtgttgtttacttttgtggtgacccatgaatcgctatcaaatcgtaagactttctcctgtttagttatgctgtttgactggtggctggatcggatgaattcatgataattttgcgaatgattttctcgcgtgcgtgtgattggtggtggatgaatgattttgtgaattcacgctctgaatttcttcactccatgtaaatcagggcaccactgtgagagtggagtatggtgacgctgcaattgctgctgatcctgcaggcgctcatgtgatcagccacgcgttcccccacacatacgggcagcccctggcccattttctccggaagacggctaatgtccccgatgctactgtcatatcagagcatcctgttgtcaggtatatatgtattttttacttgtgatattcaatttttttacttgatatgccatctgctgcaagacaagaaactgttttgaaaaaaagaaaccaaatactagtagtaaagtatttgtcaaattataagagaatgctggagagaaattacatcaaattatttgtcttcgcctctcactgcctgcacatataagacatctgattgttttgttttggatgcagggttggtgttgttttctgcggaaggcagtccccgggaggccataatgtcatctggggactccatgaggcaattaaggctcacaacccaaacagcaaacttattggttttcttggtgagtcctttgatatgcaactatgaatgtattaatagttcgttccctttgttctcatgtctgcttgttgcgtccaatcagactttcagcgtttgcttaaatagcttcacaagctacttagcacactatgtgttgtcgacttcccctagcagccaccagtgttttaatttgaattaactcagcatttttgttatattttatttgttttcattaccttagcaggtgatcacaactgtatagcatcaatacatcatttagtatttttgtcacataagtagtgacatctaaagctcttcaaccgaactttgctaggtccacttaatgaaattaacaacacagtgacatacctatactaaaaaaaaaaaaacaatcagtgatgctttgctacaagatcttggacagagtacctatctttcttaagtgtctaatccaaatcaaatgtgttaattttgtgattggcatcctgtgcatgaatccccccaaggcgggcttctgtctctcatgcctgcttttctgaacatgtctaacacttggagctaatgcttacagattttctttaactgtttcttatgtttgtgtttatttcgttcttttgttgaaacaggtggaagtgatggtcttctcgcacagaaaactttggagatcaccgacgaagttctttcttcatataaaaaccaaggtggttatgatatgcttggccggacaaaggatcaaattagaacaacagagcaggtcaatggtgccatggctagttgtcaggctttgaagttggatgctttagtaatcattggaggtaggctttgtggcattagtctactaaatagctacattgtgtatattttttttaatcctaacatctgtttaatttctggtttctgaaggtgttacatccaatacggatgctgctcaacttgctgagacttttgctgaggctaagtgtgcaacgaaggtatatcataattcccttttcttgttgcagtccgtgccttggttcctgattccctatttccattgcaagtgtatgttttacttgcctgtaaatggcatgacacaatttattattgaacaggttgtaggtgttcctgtaactttgaatggggaccttaagaatcagtttgttgagacaaccgttggttttgataccatatgcaaggtagctttacattactatgctggggctccatttacctttactgtccttccattacctctatatgatgcataactgacctgttaggcatgtttggttttgtcaattgaggttgtttatgtatgcgaaagtgtgttttttgtgctatggataactttccaagttgcccattcaaaaatactacgcatttaatttaccactttgcaatttttatttattgttgaacttatttattattataacaggtgaactcacaacttataagcaatgtatgcaccgatgctctttcggctgagaaggtaatatctaatatggttgatccgcttcttctttagttggatgtactttcgtgtctgtgatactatttagctatggtcaattcctttatttttttctcagaattaaataatcaaattgaattgagacagtaaaaaaaactctgaattgatactgttaagtcccagtacagaaagagctaaacaaatatagaacacgggctataatttgcggttcactccttaattcggcctatgtgggaggttcacacttcacacacaggtgtacacaatctttgtataggcaataaaggatgccaatactgattgataacaatgcaaattcgcctaggtccattagacaactgaattatcctttttcttggggttccatggtccatttgttcttcagtatttctctcagcgtggttattcagtagacatacttttccagcaaggcctgctgagccttcctgtttacaaattcacattacaaaagtaacaattttatatgccttgtggttgtattctttctggcagtattactactttattcgcatgatggggcggaaggcttctcatgtggcattggagtgtgctcttcaatcacatccgaatatggtttggacttttcaacttttcgcttatgcttcctgagttgctgcaaattcttcttgcatttgtttgaacctgtatcatatgttcaggttatcctaggtgaggaggttgctgcatcaaaacttaccatctttgatatcacgaagcagatatgtgatgcagttcaggcaagggctgagaagggtaggggccttctattgtgatatgctcatgtaaccttgctttcaccaatgaaatgccattttgtgaaaatttatgaatttacttaaccttatatttgttgcacagataagtatcacggagttgtacttattccggagggactcgtggagagtattcctgaattatatgctttgcttcaggtaagtttgtacatgccatatggctattcatttacaacatttctaagtggcatctatgtaattgtaggaaattcatgggcttcacggcaaaggtgtttccatggagaatatctcctcacagctttcaccttgggcatctgcactatttgagtttttgcccccatttattaggaagcaggtgtgtattgtctgatactcatctatcaactcttggacattcataactctcatcaggtctctgatattgcattgttgttttctgatgcagctgcttctccatcctgaatctgatgactcagctcaactttctcaggtatattatagtatatgcagcaatactttcagtcatttgcgtatgctttttttgtttcatttcattatgtctgattacaacctccacatggttaccggtgcagattgaaaccgaaaaacttttggcccaattagttgaggatgaaatgaacaggcgtatggtatgctttctgcagcctttcttgtaactgtctcttggttctgaggcattactgatgtctcagtctacatgtggagtgagtaatatttatattggctcatgatgttcttggtatctctgcagaaggaaggcacttacaaaggaaagaaattcaatgcgatctgtcacttttttggctaccaagctaggggttcactgccttcaaagtttgactgcgattacgcctatgcaagtttcagctcacctttctacttggacaaagcaattttattttgctgttgattaattatatgtatgttgtttggcttcaggttcttgggcacgtgtgctaccacatcttagctgctggtttgaatggttacatggctactgtgacaaatcttaagagtcctgcgaacaaatggcgatgtggtgcggctccgatttcggtgagattactactgtgcacccccttttggcaaaattagatgagtatgatatgaatgaagggaacacctaacccacaattcttttccctttagtctatgatgaccgtgaagagatggtcacgtggtcctgcggctactcaaatagggaaacctgctgtccatatggctactgtcgacttgaaaggcaaagcattcgagtaagtgtgtacacaatctattaatcccatcttatattcgatcgctgtacagttgctgtcattggtctaaagaagatgcataatctcattgacaataacaaacttgtgtttacaggctattgaggaacaattctaccagcttcttaatcgacgacatctacagaaacccaggaccactccaattcgaaggagcaggtgctgattcaaagcctatttcactgtgcgtggaagatcaagactatatgggcaggatcaagaaactccaggaatacttggagaaggtactttccataatcccaataattgatcgatcttcgtatcgaacaatctgaattcctgtggacaaatggcacatgttggtgtctattctaactgttgttgctgcgcaggtgaaaagcatcgtgaagcctgggtgctcgcaggatgttctcaaggcagcgctgagcgctatgtcatctgtgaccgagacattggcgatcatgacatcgtcttccactggccagggaaccccactctgagtcaaatggattactaaatccacattcgcttgtgtcatctgacatgtggggttagaaacagtgatgttgcaaccccacggctttctttttcgtgttttttctttggagagttttgccatttttgagccggtagcgtgagtctgctattgatgtgtttggttggactggaataataattgttcagacagcgatgttcttaaataaaccaaattttggtaggcaaaaaattacagtttgtgtttttcttccctccttcgagagggttgcactggaggagtaatggctgatggtacataactcgtgaggccaactgcgtggatcggaagagcgctggtgtggaggatcaggaggcaaagctccggccgcaaggtttggccgggaccccattcgctgcgtaagccgaaaggccaaaaaggaaatttctagagtccctgatcgctgataaccgatagtattgggtctgttcggcagccctatacagcggctgtgcagctgctaccattgatcttctataaatttcactgtagcagctggctgccaattagagctaccgaacaggccaattcttttttgttggagaaacgttattttctttcccgatggcgaatccctactgttctcgagatacgttggcaaatgaccatttgataatccttggaatggtaaaacatagagcaggttaaaaatgcaaatattaaaaaattacctaatatcattttttcctatcaaataaataaaatgagtaagtcctcaaacccacgctggttagcccatcaaattgttgagggaaaggagaggacctgtcactcagttttgaacctttgaaccgaattaacgaaatattaatttttgttccaagatgaggttcttgttggtaaagctgcgccgttttggtttgatatcaaaatattgccataccaatgttttggtagtttaaatagtaaatgtgatgatttggtttaaagccaaatatttggtaatgcctatactcaatttagcacaattctagaatgttcttcaccacaatttaaaatttggctctcaattggcatcaatccaaagacactcatttaacttgcctagagtttggcactaacaatatattggtagggtactaaaccaaacaagcccgctctgtttttacccatttttcttcctcttggttgaatcttcaagaattcccttccatcagccagctgaacatagtattattgtgtccaggtccaggcagtccagctgaacataatagtattactgtgtcacactcttgctaccttctgaactccacaagtccttttcctcatttgtgtgacgagcattcaggaagtttagtactttagttcgcagcgtgcagccggaaggactgcccatatttccataatactcctatttattaaagtaccgtcatagctctagtacagacatcctacgtgcaagtgtacaacaatcattggcgttaatacccatagaaggattaggtataggtcattttcgatgggtggaattcttgaagttcttcaaaccggggggagtttaacacggtttaacagcttgttggttgtgacagttttttttccccacctaaccctggctatgatcatatataacctgcaattctaaaggcttaaatttacccaatcgaacagcattgcgcgctggacgcctagatttagtacaagtggtactacaaatctaccatctgtttgcccatgatccatttttacgagacagttgtgtggacctttgtgcgagaaaatctgcattcctcccctagccggccatccatgcatgtgccggccacagccatctgatctagccgagcaatcaatgcgacagcattgcacggtatcgattgctacagtagccgctacatggcatattggcataggttgtgtttagtttcacgttaaaatttaaagtttgaaaaaaaagttagaagtttatgtgtgtaggaaagttttgatgtgataaaaaaattagaaattttttaaaaaagttagaaactaaactcggccataaatcacagggcgtcccgcagtcacagtgacgtcaccgttggctgcgtactcggtaaccgcaaagttcagaccttcatatgtgagttgtgacgccgccgaatgctgcaaaaccagccggtctgagtacgggcgtgggacgcccctttttttctgctacgagtagtggatgaaaatttttatcattgtgacatattttttaaactaccaaacaatatatttcttacgaaagttattctaaaatattagataaatattttttaattatacattaataccatcttatttaacgtaaaatatttaattttcatttttattttcatttccaacaatattttcatttccaacacaaaagaacaccgcgggtcgctttcctgatccgatcccgtttcttttaaaaaaacacgatcccgtctagtcatgtccgcatcttgcgagtcagctgctgagctaatcaatagcggcaacagcaacagcgagataaatcacggtaatcacagcaacagcaacagcaacagccggtcccggtttgcactgagaaatcactcggttagccagccgttcgaatccaaaataaaaaataaaattaatcaaaacgcaatcattttggtactaaaatttatcggcaaacttattccgaaaaccctgcgtccagcttacctcgccgattcgcgctgatccgcacgaacgggttcgtcgtcgggcgcacgcacagcacaaccatcccatctactccatctcatctcccttattccaagggatggcccacctgtcagccgcgccggctataagttggcagcgtggggcactgacaggtcaagcccgcgagccacagcggagacgacgcgacgacgcatcgaaatcgcccgcgacgcgagagagaggcggacaatactagaagcatccctcgacgcgagacgcgacgtctctctcgtcgccagcggcggcggcggatgggggcggggaatggtgaagtgcggtacggcggcggcggtgccggcgccggcgaggcggcggtgatggcggacgacgggaccacggtgttccgggggacggcgcagccgccggtgcgcaccacggttgcgctggcgctgtggctgggggccatccacttcaacgccttcctcctcctcgcctcgctcttcctcttcccccgccgcgtcgccgccatgtaacctcttacccaaatctctcctccagcttcttttccctacctcgcgctctgctcgccgttgacgggttgggtacttgggtctcactctcgcctctccgcgctgtattatccagggtgctcgccacgcagctcttcttcatgttcgcgccggtcaatgatatgagcaggttggggcgcaagatcgccaggttcgtctcctcgatttcctcggctgccaacgtttttttacctgaccgcattgttggatcttacattttggaggacgacgcatcctcaggttcatcagcaagtgcgtgattgggtacttccccgtcacattacatgtcgaggactacaaggcttttgatcccaatagagcttacggtgagcttcctctttatctcattccatctctggaatcttgattaattcttgaatcacattgatgattgataccgaggcttttcagttgattcctaaagctaaacagaaacaactactaaagatgatattgtgatacttgaatctttttaatctttaaagtatcaaacccttttggcctatttctaaaagctaagtaaaggagtagtaatatatagaaaagtatggagtcttttatatagagggcactgtccactgggttggtgattatattgtgctgtgcttgcagtgtttggttatgagccgcattctgttttgcccattgcccttggggtccttttggagcttgttggattcatgccattaccaaagataaaggttcttgcaagcagtgcggtgaggttcccacttcccagatttccttcctaggagtacattcttaagagtttgatctttcgacactctattactacatatgctatttattgtggctgcgaacatccatctggatatagaggccaggttttaatccattttctaaataaagatatgctctttactggtgaattggtcggtgttaggtgttctataccccattcttgaggcaaatatggacatggttggggttggttcctgcatccaggaagaatttctactcctaccttaaagctggttatagctgcgtcatagtgccaggaggggtgcaggagatgcttcacatggatcatgattcagaggtaactgcggatttcttcttttattatcaataaagacattgccttctttcttgtgcaaaaccaagtgaaatacttacatcttttaccggaatagtgatggttaatttttgcaaatgacaggttgcttttcttaaatcaagaaaaggtttcgttaagatagctatggaaacaggttcccctttagtccctgttttcgctttcggacaggtaatctactcttgcacccaataagttcataaatgcaaaattccttatccatatagtaaatttattcatggtattcagtttgctgatttttttttggcactactttgactagagctatgtttataagtggtggagaccaggtggcaaattaattgtcaaaattgctagagcaattaaatttactccaattatgttctggggaaaatttgggtaactttctgcagtttatatatattttttcaatattttttatttggtcaagagttcatatgtccttgcacattgtgatgcaggactcccattccgtttgcgacacccatgcacgtggttgttggaagaccaattgaggttaagaaaaatgctcagcctacctttgatgaggtgaaatatcatcttgacattatgccaagtacaccttttgatcagtctgcacactaaaaaactgaaattaaatgatgttctaagataaatattaccatggaaagtaggatcttttttgttttaattgtttttgaatggtaaaaaaataaaaatgtatatattcttacaattaaaattgggtaattccctgatgtggcagataaatgaagtccatgaacaatttgttgtcgcactacaagaactgttcgagaagtacaagactaaagctggatatcccaacctccatttaagagttctatgatggcttctgtaagttccagcagtaagctctaatgatctggatttacggaataaaatggttatgctgttaggccatcaattcaatccctcgtagcactgaagctggagtgtgttcagttcaagagccagaatcagaattcagtagcttcagacatgattcgccacattcccaacagcagttcagtaaggcaacgtattgactgacgaattatcctctggtggtttggctttggcagaatagaatgcattgtatgtaaagtaaatgtgtacatttgtttattactcacgattctctcacatcattatcagcaccagtgattgaatcgtgcacagaaggggaaatctcagggttcatattcacagacctggtgtacttccaaagctccaagttagtgcattggcagcagcagctaactcgagctgagagcattgtgtcgtcatacagaaaacactcaattttctgtaacaatatttcacaaaataaagacagcgaaaccgcagataaatcagttcaaatagtaaagtttttaacaacctagacttgaacaatatcgctgactcgggcagagagcattgtcgacttgtcgtcatacagaaaacacaatttctgaaacaatatttcacataatacacaagactgccaaaccgcagaacaatttgtacaagttttaacgatcaagactgataccgctaactcgagcagagagcattgtcgtcacacagaaaacacccaatttctgaaacaatttcacataatacacatcactgcaaaacagcaaaacaatttgtacaaatagtacaagttttaacaatccaggcttacacaacaccgataagaccccaaagcatgggtttctcatccgaactgatttattttggtcggacaacaaagtgccgttctcggaagtcgaggaactgctgagcacatagcaatgaaaaattaaacacataacaacagttctgataccgataccagtaacacaatagacggtagttctgataccgataccagtaacaccatagaagatagtcctcgtgacctcgctaccagttggtaacgagtaacgaccctgagcagttccggtagacacttgggttacagatacaggaggaaggaccatcttggtccaacattttggacatgatgagtgaagcggacgcaataactatttatacctccaaaggccgatcaagcatagatcacgacgatgaccatagacagacacaagactgacgggacgggctacatttgttggacttgtgccagacttcaacactgggatataatcaaccacatagtagcttgatgattcttcaggagtttaggtgaacaatcatatgagtgcatcatgactaatccaaggggattagtcatcttacagagtgctggactccattccagcatccagtatatctccatgggctaatgagctgtcagatacaggatcaataatgctgtatctagagcttcaagctgcagcaatggtcgcagtcccattgagacataggatgtaaccaagcaaaactgacaagagcaaccgttgctcttggatcattgtcccatccatcggggcaacatcatgattccaggtacatctgatgaccatgataagggcaacctgcagaaatttcatagcgaagattatcataataatcaaaattacagaaatagaactcaggtcaataaaatgaaaacttgtatatgataaaaaacaagatgcatgatcacattagtatacacgtgcgggcacatgatccaattggcttacaataacttcagacaaacacgtataaaccatttcccaatgttttgaaacaagaaacaaagaaagcctgaagcaaacagaaagaatttctctgggaaatttttgctatttagtgtcgaccatatcatatcacaagcaaacagattgattaagattcagttggctgtttagtctgtatgttcagagtaatgatgaacgccatgatgccatcaatgtacttatcttctgttagatgcaaaactaatctaacatcaacgttaagaatgaatttcctggtttggtttcaagttaattatgggaaagcatcacccagtatcgaatgcaatactattggagcataataggagatcctaaaaaacataacgagattaaggagtacaacaatgagaataagagacaaaacacaagcatattaacatcaaagtttgtcccttttgagttctgacaagttagaaccaataggtaactccatcattttgttctgaaactaaatgcatctgaacttctgaagggcagaatattgatggactaatttcccataagagtaagattggcattctatgaatgtaagcatggcttctcagtacagcataattggtaccttatgaatgcaagggggattacttgccaggtaagaaccagtactacaaatacagcagcactgctcttttgtcctgctgcaatctaagggtacctattagggacagaaaaagaacagttactaccagataatcacaagaaaagataacagcagtccagacagaacaaacctcaaggtacaaatgtttggcagcatagttcagcttgctctttggtctgaaccactagcctgtgtaaactgaggtgagtgagctgggaggaccaagtgcgggtgagtaggaaccggtgctgctacaaaggccaagtaatatgaagttattcacaaaaggagaacacttaagcagacactataaaaagatgcagggtgacgaatgaacgatagcatccatgttagcctggtaaatttggtgtgagaacatatagcataacacagtattgtgttttctggaaagacaagaggaatcactaaatactaaaaaaaataggcaaagaagaccacattaccaactaaaaagggggcctgaatggtgggccgaggtgtaggcgatgcactgctaaagtttgatccagttaactgtacaaatggatttcctggcacattgtaaccatgaatagccacataaccattacccccaccagaaatggacgggctgaactggctaaatggttggctagcagtatttgctgcggatgaaactccataaattggaacatattgctgaccaacatatgggtttaatgtaccctacaaagagatctctcatcagaatcagtcgatgctttgtaaaacccttatgttgcgcaaggaaaattaaacgtaatatttttcacacttcaacctgtggatagatgtattctgtcccatatgtagtgtagctgcaaaaggaggaaaatgaatgaccgaacacactttattgacttccaaaacagcgatattatgttccacgaagaaaatgaacatatttatttggcaattttcgaagaggagcagaaaaaaaataggatgcaggctatgcacaatctacacaaagtaattgccacaagattatatgccaaatgtggacgcctaagtaagaactacttgaagattgtcacaaatgggccatctaagagcaggaagctgcattggaaaagttaacacatcatacctgtattgcggaaccgggaatccttggtaatacccaagaggaagtgtccggtgctgaccataaccccctacataaacaccccttggaactggaacgccaaagtaggacccagctgatcttggcctccctgaaaagattgtgcatgtattcagaacaaatgcttacagaaatagaactattatcaccgcatgagcacttccaagaactgtttaaggtaccaaaatggtatattagtagtcatcgtatcaccattaggggtggcatactgtaatttgtagttttttgtttgcaaaacaaaacaagcacatgccaaacaccaacatcatcagtacttctgttcaaatgaatgctcagtatcattttagctcacctgtggtgttattttaagtcccaaacccacttgagaaggtatatagttgactgtacctatgttcacttgattatcaatttttcttctttccatagttgtcttattctaggaggacgagtgcgggtaactaaattctagagcaaacacaatgtagaaccgatcaaataagtttgcagaaggcaacacaatcataccacagataccactgcagtaacttgctagcaagcaaatcctcacggtggtatcaaaatgtgctcataatctactcgaataagttagtgcaaatcagtgtcaaggcagggagatcaataccgagaggaactgcaggctgagcgcggccaagcgacgccaggttacaattggcacgcctgccgtcgatcaccggcgtcgggtcctcgcatgccttcctcgccgactcaggatcgcggaacgtcacctgcacaaggtcaacatgacacttgtataagccaaccactgtttacagccagcaattccacgaacaaacaaacaaacacccggaaaaagcaggatcaacagcggcgaaaaatcgaagggcactgacgaagccgtagcccttggagcggccggagtggcggtcggtgatgacgacggcctcgaggatctccccgaagcggtcgtagaagcggcggagcctctcgctggtggtctcccacgcgagcccgcccacgaacaccttggtgtaggtggtgtccccgaacggcgacgccagcaggtgcagccccgagctggagctcgacgccgacgccgaccccgaccccgacccctgctgctgctgctgctgcgccatccggcgagctacgcagcgatcggctggaatcccttcgaggatcggtggtgcgggtgggctagcttcgctgtccccctctccgaccttgggattggagagggttcgcgagtgggagcgaatcggcggtgggattttggaagggggaaaaggtgggcgagtcggcggaggaggggaaaggggggattgtgactggggccgacggttgggttggcgcgccttcttctgctacgggaacccaagtcacgttcgtttgccagcgaagaagccagtgtgtgtgacagtgtaagagggagagagctgtttgggtttttcaaatggatcacgcggttgacagcgaaattgcgggcgcttcgaaatattagaaacgaatttggaatcgaagtgttcgtggatgatgagcaaatttgctacttgtcgtaagttttggtcgatataaggtaagttggattcggacatgtttgagtagattggcattgcgttgcatcacggtatgataatataattttaaaagttcgttgcatgtttttcgcgtttttatactgttcatatgatctcagttagcatgtaagcaattgattttatataaaacaagttgaagagctacatgcctcttctatttggattcaatggatgtgatgtgtcatttttctttaatttttggttcaaggatattctgatgaggttgtatttataattctaacaaaattaattacaaacatgtatattagagtatatataacatgtaacttactagctatttctttgacttaccaagtcatgagaaaggtgtttttaaggattaattaactatctctatgcgaaggagaaaacatctccatactaaagtggaattgagatgttgaagtggtgttatgctaagataaattactaccacattttccataaatatagggatttctaactatacacttagatgaatttttataatcgtggatagatatagtacattcaatatatctttatacatgatagtgtggttgctgcagtaaacatagcttttcctatagataaattatcttatccgtagaatgacatgaaaaaaagttagggctaaaaattactcattttatcttatccgtagcatatatagagtacgttccatacatccatcttgatacatgatagtatggctgctacagtaaatatggtagcttttcctataaatgaatcattttgtccgaagaatgacatgaaaaaacttagggctaaaagttactcatttgatcttatccgtagcatatcctattttactcactaagttgtcgcaccctttttacgaaaaaagagctaaaagtagaagttatatagaagacctaaagtatgcacttaacacttctaaaaacatctaatgtagtataatagtaacacacaacaattgtcgtgaaacatgtacttcttaattctttatctttattcataagagaaattcaaaattactttagaaagttttatgaccaccattatattgtgtgatcagtaaaagtcctgtgaacgtatgaaataatctcatacgaatttgatcaaaaaaattttagggaatagatcatatactgtactccacctgtctcaaaatatatgattcgtagatatataacttctcatactaaattaatttattttggacgaagtgaatatttgttttaactatgtgccttatgataaagattctgtgttcggcactcactgctgggaacatatatgttgcgcacgaaaaatagagcggtccattagcgcgtgattagttaagtattagttttttccttcaaaaatgaatcaatatgattttttaagcagcttttgtatagaaactttttgaaaaaaaataccatttaacagtttgaaaagcatatgcgcggaatatgagagagaggtgttgggaaccaaatgtaccgaactgggggtttggatggaaccatgtcacatcagatgttggacactaattagatgtattaaacgtagattattgacaaaatccattccataactctaaactaattagcgagacgaatctattaagcctaattaatccatgattagtctatgtgatgttacagtaaacatgtgataattatgaattaattaggctaaaaaatttgtcacgcgaattagctctcatttatataattagttttgtaagtagtatatgtttaataatctaaattagtgtcaaacatcggatccgatgtgacaggtactaagatttagtctctgaacccaaacataactgcctagtcaggatgtaaaatatttccaaggtgagcagtgactgagaccaaaatctcgcacaccattcccatgctcgagcgagttcatcacatcaaccacacatttcatcatagattaccgagtagagagtgcttctcgttcacacttttccaaacgatcgactgcataaaagagagaagaagaaaaaaaaacacatttctcgctgagctccatcgatgacggatgactcacactgctgacaaaagagcagatttgcaatttgcaaacagcatcggacgtggaaaacgcccgagcctctcctgtctcctcccggtcttctgcttggaagaaaagaaagaacccgccgcccatccgcgcgcgggccccgtgccgttccccctcccccgcccacgcctctgcttgcggcttgccgcttagatccccctgtcctgtcctgtcacgccgaacatctgaacgcccgaggcgagcgagagagacaatcccgcggtcacctcccctctctctcgctgcgccttccgtgtacaccaccatcacaccctcccgtccgtccgatccccccctccgatcgcgtaccgagcaaacacgcacacgcacagccgggaggggggaggcgaggtccgcgtcgttcgcgatcgccttgggttgggttgtgtctctctctctgtctccagtgatcctgggccaaggaggcggatggacgtgcgccggggcgggggcggagggcgcatcgtcggggcggcgcggagggcgctcacctggggggcgctgcccctcccgatgcggatcaccaacggcctggccatggtctccctcgtgctctcctcctgcgacctgctccgcctctgcagcgacagggagcggcccctcggcggccgggagttcgccaccgtcgtctacctcgtcagcctcttcgcccaccctgacgcccccgccaccaccaccggcgacgacgacgacggccaggggggctcccgccgcgcgcgccccgccgccgcggagcccgcgccaatgcatgggcatggtggcgggatgatggaggccgacgacgaggagatcgtcgccgcggtggcgtccggcgcgctgccgtcgcaccgcctggagtcgcggctcggggactgccgccgcgcggcgaggctgaggcgggaggcgctgcggcgggtgacggggcggggagtggagggcctccccttcgatgggatggactaccaggccatcctggggcaatgctgcgagatgcccgtcgggtacgtgcagctccccgtgggggtcgccggcccgctgctcctggacggccgcgagtaccatgtccccatggctaccaccgagggatgcctcgtcgccagcgtcaaccgcgggtgcagggccatctccgcttccggcggcgccttcagcgttctgctccgggacgccatgtcccgcgctcctgctgtcaagctgccttccgcaatgcgggcagcggagctcaaggcgtttgctgaggcgcctgcgaattttgagttgctggctgctgtcttcaataggtacactccacatcatccactaatctagtttgttgatttgtgtgcttgctcaaagtgttataagactttgcgcgacaataggcaggcacagtgttaattaatgggggaaaaatgtgatctttcagtgtatcttaaggttgtcgtcttatgtttgagtaatggactgatgttgatagctagcactgaatggtattttaagaccaggtgatttcccacaacggaaagcccttctatcatgtgattgctgacagggtagagcccacagtgtgtaagctagcacatgcactggaggtactggacaatgcattatcaatactatgtttacttgttctaagagctaccagctaaatgcagataatgccagctcatagataatacctttctgaagtgttcaccttgaattgcctttttatgttcgcttaaataataccgaatgtgaatgaatcattggtttgtgctctccaaacttgagaatatgtggatttaagatctcaacctctagtgtgtatctttgcaccttcagatgttcagggactcagggtacacacatctactgacagtttacggtgttagaattttcagattaatgtcatttgtcttttggagtttttctgtgttactgactagtaactgtcgctctgtagtcagtatccttagaggatctattgtctctctctttttttttaaatgtacgatatgttgttttgttttattttgttgtctggaacctttacgtaattgtaggctcatgttcaaaagctttggttactgtcattaagtacactttagataacagtaggcttgtgttccaataagttattgttggttttcatgtttctaattaatgtatcttttcttacattgttttctgtcatttgagagtactgagaaaatatggaggtttttattgaatctctttaaaaaattgtggccgtgtgtttcaaagttccaaataggtccaacagttagttcctaggtatgctgcatttagtatactttcctaatatcctcacttgtgctattttaccacacaagccacttctgtgatttccacaactttgttgtgcagatttttcatattcatatttttctttgatttttcgtatccagttattcagacactgtacatatcggcatattattctaccagtcaaagtcaaaggtgtctatacatcttatttgatttctgatcttttaaactgtacaatgttttatagttgttcttggcagctagaaccatctacccaataccgacgcaactctatgggttgcatatatgggcaagtgtcatggttccatggatacctttttgcatagtgtattctccagggacttttccggagctaagtgtgagtttgccattgacattgttctttcaacctctgcatttcggattgcatatgtttcagtcttagtttttgatgtggcaaatgtcacacaatatggttgctatacagtgttgatttggtactattgtttgaagatccattatactgtgagaatcaatctgtttgtacaacttatctgattgttatcctcctctgtgccctatataagttctaatttagtaaatttcatgcatactttattgttggctgtgtacactcttgtggagtgtagaggccggaatgatatccattatctaaaaaatgtatactttattgtggaaattttcatttgagacaatcacgcagcttgcttatctaaggccccatttaatctccacatttggagataaattttggttgcacgtaaaacgagaaagctcattagcacataattaattaagtattaactattataaatttgaaaaatggatttattttcttttttaaaacaacttctatatagaaactttttttaaaaaaatgtatcatttaacaatttgaaaagcgtgctaacggaaaacaaggaagttgaagaatagaacagggcctaagtcgttcttacatcatcctttttttttcttttttgctctattgtttcgcttccttagtagaaccaataactccatatagaggtcatcttctattagaattgacataaaaactgttttaatcggtgtaggtccagcagatttggtaggcttcaagacattcgttgtgcactcgctgggaggaacctatatatgagatttagctgtatcactggagatgctatgggaatgaacatggtgtcaaaaggtgttgagaatgtcttgggctatctgcagaatgtcttccctgacatggatgtcatcagcgtatctggttttaactcttccccttgaactttgcatgcttcagttagttttgctttcctctctaagtcaatgcctccttttagcagaaaacgaataaaaaatcacattctttaacttctgtttggaaatgttgcgaaggaaatgatgaaaaacatatttcatcagcacccaaaatatttcctctcctattgctttgtaacttaaagaaacatgtccctaattagatttttccgatctagagaggaaacccttggcttcatttacagaaagcagatatcggttcttagaagattcagcaggttataagatggatttttttcatccctaagaagtatttttggatgcctttttatttattttctgctcattgtgcactagcctagttcaattgtaaaatatattctgattaccgaataacagtgaatgtactacttttcatcagactcgcatcaaacatggtctaatattctctgataatatatttgcgtgtatcaattaggcatttgtgccgggggtgctttttttgaaacaatgggtgttcacactatctgttttcatcaattcaccatgtattttcttgtctttgcatgcacattgatgaattaatctgtgtgcatcaggtaactattgctcagacaagaagccgacagctgtaaactggatagaaggccgggggaaatctgttgtttgtgaggctattattaaaggagatgttgtgcagaaagttcttaagacgactgtagaaaaacttgttgagcttaacattatcaaaaatcttgctggatcagctgtagctggggctcttgggggttttaatgcccatgcgagtaatattgttactgcattattcattgctacaggacaggatcctgcacaaaatgttgaaagctcacaatgcatcaccatgttggaagaagtaaatgatggagatgatcttcatatctctgtcaccatgccgtccattgaggtgattatttattcgttttactttccgttcctacctgcattatgtagattatagcataacctgctagccttaaatggagctgcaaaatctatagcatagagatcttcttgtattaactgaagtaatattttgttttagcatgcagtttgatcgtgagagcaatatccgcatcgatttttatttatttaatttcttcatgttagtaaaatggttcattttttctctcaggtaggtacaatcggaggtggtacatgtctggcctcacaggcggcttgtttgaacctgcttggtgtcaagggttcaaatcatggctcacctggtgcaaatgctaaacgtttggctaccatagtagctggcagcgtgctcgctggcgagctctcgctccttgccgctcttgcctctggtcaccttgtcaagagccacatgatgtacaatcgatcaagtaaggatgtcgccaaggctgcttcttgagcagcccttcgcatcattcaaatgctggacatatttagacagggattgccctgagcttgtggagaagcgaatgagcaatgggcttgtacatactgctgataagagagcgattctttagttccaaactcaacctgtattatactagcataatgtgtgaggaggcattaacctatagtgcagcttctgactgtaattttacccttcagttttttttttcattcttctgtaaccaatcaaacttatttttccattttttctggatagcagcaggtcaggttaacttatgcttttgtgcagtatagcagctcagtaatttttgtttacagcatagagaacctgactgtgtatgttcattttactgttcgttctgccttttgttccctccatgtccctcagttctgaattttgtagcctgtattgcatcttgcctgactgcctgttgcctgtgaccgagtgttgatagtgtggatcaaatcagaacgccttctctttttattttttcgcaatggtgtgcctgttgctgtcaggtacttgctttgatttataaggtaagtcgaatatactggtccggttcgttccataagcacacagatttcaaaagccaaatgtgctgtgattccttgagctcacagatttcggtgcgaaaattctcgtgttcaatcacgcctgctttctattgttgttgctgaagaatatcctcgccgcgctatgctggttcctacgccgcactagaaccacttgaaatcttgaatgattctccttatctttaaccaaaatcctactcctagtagctaaataaatcctacctcgaatctacaagtgcacatataataacttctgttcttgtgtagtcgctttcaatacacaagtagaaaaggcagattggatcaaaatcccggaaatttccacgctgttgaagagaaaacgaacagtcttcgggccagatttgtagcccaaaacagcccataaagcaccccaacaattctcccgtcttctctccggcccaagagaccgaaatgaacagactttgggccagatttgtagcccaaaacagcccataaagcacccagtcaattctccttcacctcctcctcctccagtcctccaccgtccagcactatctcctgcaactgctagtgcaagatcaaccagccctcgcacggcacaaaaatacacaatccttgcgaaaagtttgctccaccaccagtacaccacacccccaatgcgcgatcacgtccgcgtgaggcacggacgccgccacaatcccgcacgcgacgacatcggagcgttccgcgccaaggcgatcgagaccgcgatcagcagctgacgcgacggcacgggtgggtggacggatgatggtggcctccggcctcgggctcgcgcgcgcgcggccacagtggccaacgccgctccgggacgcggcatccgccggcatcgtcacgtggccgcgcggcccacggccacggccggcccgtatcaaaaattcgatgtgacatatctcggccccccgtcccctccacccaattcgcctcgccaccgcgcggggccgtcgcccacgtgtggcgcgtgacccattccccgcggcgttacgtgcgctctctctctctctcttcctcctgcagtagcctgtgcggtgcagccaacagtagacgaatccccctgaaaaagaaaaaaactgtaggcgaatcccagggtcgacacctgtcccatatccttggcgtgacacttcacgcatggctttttctgatgccatttcatcattagttagggttcccaaggtttacttatgaataaagattagtaagtactagtactactcctgaacaaacaattatttatgtagtagaattgaatcatcgagccagctttatatatagagagaattaatactgtaagctttgggagccaggcaaattatacgaaatgacaggagacacaaaagaggcacaaatgagtacgtgcttacaaattaatgtgacaattgagaggttgcctgtctctaacccagattaggtcaccgcagattacgacctccccgcgggtggcaactgggcgcatatctcatatcatttcaagtctcttcccgaccgataaagtaatcaactggctgcttaataaggtcattaacaatcaagtgctaaagtcagacggcttcaacgaaaagattagcattatcatcatcaggttaaccatggcgccatgcacggacaagcgagctaccgatcgatcgagagacgcttggcgccgcaacgcgacaggcgagggagctagcacatgcccggcgatgagacagcgcgccgctcggattatcttaatcctgcccccctaatctaatctaatcactcctccccacttgcatccacgcagctttaatcagcctttcgcccaggcactaattcttaattagccggccggccatcggatgctgcctagctagcttagcttatctcttggccatgattggttaaggtgcagaaaatatttaatcatatcatggttctcttgctcccctgtccagtcgcgagctaattagcttaattagcttgactgcagctagctactaagctgatgtacattttttgctgtgctcaaattcgatcggattctgtggttaattaatcaaaactaaagcctagaaatttgcgtggctgggagttaattagtgttaacttattctgatgcactgtccttttcaacgcagtgagttattcccgaaatagatcgtgtgtgttcttttccggcggtagtgtatttttgcatatatatggatcgtacgatctgcagtttcagcatgcatgcacgcgctgatctgcgcgtacggaagggaatcggacgtggaagaaaaagatgaaacaaagctatgagtttcgccttttcacagatttgtatattgcttaagtacttttctggctaataagcgacatcatgacaggctttttgattctgtacgtacagattgattaattaacttggtgcctgcggctagctaggcatatagctgtagttgcttaattggctgctgcctgctttaaccattgtgcgccaaaacaggctgtaaagaatggttttctctaagattaattctggtcgtatagcaatactcctaagcaatgactttagttcatatcttcgtatatcgtacttcctccgtttcatattataagactttctagcattatctatatctagattcattaacatatatatgaacgtgggcaatgctagaaagtcttataatataaaatggatggagtagattcaaattcagttgtactatgctctagtagggtgtgcagactttgactatttagaggcaggcatagtgttatctggtactggagtaagatggctaaattagctatagttatttgagttcaatgaacacataggaaaaactgcacgctctccgaaataagaaaatagctaaataacaagtcatggtataaaagttaatataataattgaataaataaatcagtactccctccgtttcaggttataagatgttttgacttttaacaaagtcaaactgcttcaaatttgaccaagtttgtaaaaaataataataatattttcaattcaacacaaatttattatgaaaatatattcaattattgaattaatgaaactaattaggtattataaatattattatatttatgtataaacttaactaaatttgaagtagtttgactttataaccatgtcttataaccatggaagtggagggagtagtacaaaagttgatatatgaattaaatagtataaaaattaatagatatggaataaaatacggtctcgatatcacaaagctaccttatattctgcgacaaggcaaaagtaagattcatgcatgtattgcctctgaggatcttattgattaattagttattatttcttgtgcttttaaattagtagtaatatactccctcagtgctcagaatataagggcattcccaacccaatgactaggatggtgtctatagcattaaataaactgtcacctatgatgaaaaatgatgtgacaagtgaataaatgaggaaagagaaggaaaccatgtcttgcatgagacatagtttctacacaacatccaagacatcatgtgagataagtagcattaaatttaagtatagaatagtggtgtttgcattggaagagtagtgtctagtactccctccattccaaaatataaggcacaaccacccttaacccaaagaccaagaagtaattattatcatcttgtagtttggatcatcctcgtaaatataatgcatgcattcaataggattagataatatgagagtggaggatttaaaaaagttataatttaatgaagaagatgccatagttaattgcatatttgcatgcatgccttatattatggaacatgtaagaaaagtggttgtgccttatattatggaatggagggagtactagtttcttgatgatgtggagtttatggaaaccatatctagtgtcttaggttgggaatggcctaaaggaagtcgttttggacagcgatacggtctccaaaacacaactttgacttcttgtttctataaaaatattttattgaaaagtgatatacgtataccttcataaagtatttttcaagacaaatctattcatataatttttatatttttaaactcaacaacttaaaagttattcatgatttatattcttagggtttgatttaaacattgttctaaacgactttttttacgagtacgaatggagtaatttacagcaatcgaaacattgaatatagtcctatcttgcctgctggcggtgatattgcgtgtgcgctccatcatatggttaattacattattattcgatacattgatctttgcgaattttagaggcacgtacgccgtacaaattaacatcagtactggatctctgagctatatatccctctatgtccaacttgcggctgtatgggtgtgtttggttgcaagccacactttgccacagtttgccacgcctaagagcatcaccaacagccacccaaaattcaatcccctaaatcattttttttagatctctaaaaaggatttaaggtatgagaataccttttatctccaagagattcccaaaatttaatcctcaaaacaaaaaaagtaggccacatcgacaactaccaacagaatcgtcattcctctcctccactcacgctcgcacacgctgcaatgctgcatcctcctcacggctcctttcaggacattcagtgatcaatctctttgacatcataactgacagtttaagcattgaacaatgtttccattggcttcaggtacgatctgagtatttgccccaaaatgatatttcacttgattattaccacgatctcctgtattttacatggaaaaatattggttctgcaatcatcaacaatggggttttcagcccagaaaaaaaatttcagcttttttagtgtgaacggtgttaacaacttgaagttttcagcagcaagcagcaagatatttcagcagctgcaatagtacttttcagtactagcaagcagcagtttttagcagcaaagaacaacagttttcatcagccagcaaacaacaaatttccagtaccaccaccaagcagttctcagcaatagcaagctccagatttgagcagcagcaacaatcagaaatcgactccgaccgaggtgcacgatgattcgatgaaggccagagactgggcacctccggttgtcgccggctgctggtcgcatcgcatggggcctttgtcgcctgcacattaccggggggagcgcagcgccagtctgacgcgagagacaggctgtgctgcaggatgcggtagggtcgagggacgattggagatgaataggggcgacggccgattcgagtcggtggtggtgctgggggagcgccgacgaaggtccgcccaattgggttggagatgggtctggcgctgccgctgagaaaaaaatgtcgacgctggggaagcttgggggagccatggctgctttcccagacagctgcggggaagatgaggctgctggcgtgatggattgactcacaggtagacgaacgcacaaagaagaacctggtaggaaaattttcacacagcgcgcgcgaagtgcatgcggttgaaggattgggcgccgagtctcttccctacaagtggagaacgaaatatgcgggtttggaaacgccaagcttttaggggtgatttaggtctactgttggagcgattttttccaacaaaactcctcaaaactgatattgggaagagtatcgggaaactgttggccatgctctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttagacaaagtgtggcaacttttgttggcaagtaatggtaaagtgtggctgggaaccaaacagcccctatatctataccggccggctgggcacttgggcagtagtactgctggactactggcattagtgcattaattagagccgtcagacaaattaacttagatctacgcgcacatcaacttactttctttgttaaaaaataaatacatcctgactacgaatctgaacctagcctatatccaaattcgtaatcagaagttgatgattttttcttggacggatggctatgtgcataaattaatgttgaactcgacttaattttccaccaaattattggtgaactagttaattactactcccccgtcccataatataagagattttgagtttttgtttgtattgtttgaatttgtgtaaatataaaaaataaaaagttgtgcttaaagtactttggataataaagtaagtaaaaaaataaataataattttaaaaatttttaaataagacgagtggtcaaacagtgcaattaaaaactttaaatcctttatattatgggacggagggagtaagtaccagcaagctactcgcgggccatgatagtaataatagttttgttggatcttaattatcattgagtttgctgtagatgtttaactattggcagttgaatacctgaacctaattagctgcaggactattcgcctgtacaagctggatatccggaggcaaatgcgtcaaactaaacaaagcagcggagctagtcgcagcgcaccaatcgtcaactctgaaagtctgaagtcgtcatgagttttattatccataacatgcaggcatggatcgattaccttagcactgtcttatatatgcatgcctggtagagtatagtattactacttgatttttcaaacctaccagaagaacatgcaacatgtatctataactgaatttgtttctcgctctctttctgcattcaaaacacaattttctttgcaaccagaaagcagaaaaccttacacgcatataatccgtactacaggtgagcacagattcccttttctttagttgagttgccgctcattgtttatgtccctgtacgtacttgacttaataaacgacgaaataattaaaggcagagctagcatgctcttgcatgcacagccaccaacagtgagaagaattaggtcatggcagtgggcatggcatggcatgtaaggcagtttttgtcgccatccacgcaaggcgtcacatcaaaatatagcttccaagtgtagctaagccgagttggcccggccatctagctcgcctgcccaattttataacccccctagataacttaatcataagctcgaacacataaacaatggtgtttagttgaggaagccaacaccagcactctttggataatgaactcttaatcaagtgcacaactgctcaattattttacaggccagtggagagatcgttccaacgcttttgtccaccctatgtacaattctatatctgcaaaaatacaagcgagagccaataaacccctgccatgtactgtatcgtttgttctggtgtctttgatatgctataaaacttaacgtaccttggaattggattggaagcatgattctcgtagcttcgattcaatactagcactagctagtaaataaatatgccaccaggaagagcaaactacccccccccccctcccctatatgtatgcgcatgaggtcactcatgggtgcattcatggacgatgtttgtcgctttaatttagaggcagagctatagctatatagacaacaaatcaacaatcactattcgctactgcaggataatgttttgatttgatcttgtcacccacccaaattaatactgcacagtaactaaactatggaggagagtaccagcctagctaatcaattaaacgatatccaacaacacaatgcttcaatcgcatgcatgttgccgatctatcagagaggcgctcgatcggcggcctcgcatgcgtaagtgcagtgtggcagcagcagcacgtactgcttgcgaatggatcacactgtgcgtgcgtgcagagtatgctgcaggcagagatcaataaaagagcgtgctagctagctagcgcgcatgcacgggaaagaccgagaaatcaaaggcgctggccgggcggtgatgataattgataatgatattgatacggatgcgagcgcactgtgtgtgtctcgttgcaacagggggccagcggccatgcttgcagcgatcgatcgatcgatgggatgagacatggaggcatgggacgagagagaggggttgggtaggcaccggcgcaccgcgcgagatacgtttacacaggcacaaccgctgatcagggaaagcagatggatatatcacttgcatcgcgtgtttgcaatgcaaatgcatatgcagtgatcacggagagagagagagagagtccaagtagtgaaggctgcagctagcacgggatactatacgggctatatatctagcttgatacagggggcgtcacagctaggtatacagagctcacatttgcgttatcttgctgcagacttgcaggaggaatgggagaggaagatgcagtgataaatagcagttacaatagcaggctattagccagttgtaaacatattttaatgagataaaagatgagagagaagagcagcgggctacagatctatagccagctacagcacgtacttcaagatacaatgtgtgtatgacatgtgggaccatatattaatagtatagtaagcaactattgtataaattgactattagattggctatatataaattgaagctaatagtgggctatactattaaacttgctctaaaacggccgtttgattcaggcgaggccggccgatgccagtgccaccgatgaatttggggatcgcgagagattgatgaggagggcgagatgggcttaactgtggcccgcgtgggcgtggccgcgagggcgatcatatcatatcatcgcggtggctgatcgatctctcgctagctagctgctcgtgctagtagatggtgaccgagacgcgcctgcccgccaccaccacgtgtctgacagctgtacggacggtgtagccgcccatcacccccacattgcgttctcgtttattttgaccggacgagagggtccccctagcttatccttgaccgcacgtgacggtgatctagctagctcttgcagctacgaggctcgatatcggtccaacggagtcctgccagatcggtgcagtagtactttttcttcgcgtgcgtactacggagaaaatcaaatgtacatatataatcatttcatcctaaaataaacaaatctaaaatacaatgcgatgtagtagtactatttgaagtataaatctgtttgtttcggctgatttgggatgaatcggaatggcgatgcatggctttaattttaccacaataccaccgtgtatatagatggatggattcatcttcatatatactagtactgtggagtatcatatgaccgagttaatttatgtgctccgatccagtaaccaattggttatttaatttaggatctaattgatgctagaagtgctgacatgcacgcgtgacatggcactgtgcacagcgctttctttaatttcatggtgccaggtctgcaccaattaactacatgcagctatatactatctccgtcccaaaataaatgcagccgtagaaatccgtgtccaacgtttaaccgtccgttttatttgaaaagtttataaaaaaattttaaaaaatagttacacataaagtactattcatgttttattatctaataacaataaaaatattaatcataaaaatatttcaaataagatgaacagtcaaatgttgaacatgaatagtgtaaaactgcatttaatttagacggagagagtaactcattcttaaaaaaaactgtgaaaaagaataatacaactgctagaggtatccatttgttgacatgatatgttatggtaccgatcactttcaagaagatggttaattaattacgtctgcaccgatggctgttttaatttagggcaaagtggcaaaactgatctataattgatgctacagctattgtaactagcagccgagaagttctgacatgcatgcacgcgtgacatggcactgtgcaccgtgcagaaatgctttttaaaaataaaaaataaatcatgatgcatgctaggccaggtatatgtaccaggtgcatataagagcaagtttaatagtataaccaactactagctctaaatcatctatagccaatataatagccaatttatacaatagttgtttactatagtattaatacctggttctatctatcatacacacattacgtcttgaagtccgtgctgcatctggctacagatttgtagcccgctacttttctctctcttcatttatctctttaaaatatgtttatagctagcttataacctgctattgtacctgctctaatgcaatcaatagttagctggtcaacagttaaacgatctcaagatatcatgatctcttgtcttttaagaattactccgaacaaaagagattcaacttaagagtgtccagcgcgtgtttgtggtacctgcgtttagagtcaaaatttagaaattactagtaacatgcttactccagtatgttactatacggccgctgtcaaaaaaagatggttaattaattggtgtatcaaagtcaacatgtgtactggcccatgcacgtaaaaaacggggaaaaaactggccgaccgaaagacgtactcgcctttggatttcaacctgttttgttgcgtgctagctcctcccttttttatatgctcgtgtagctttcattgacatatacaccattcatgtctccactctgctaatctgtggcgacgatcattaagtcactgttcgtgattgcgcggcactaaactaataccgctgcgtctcgagatccagccaatcaggccgtggtcattcaaatttgtttgctctctctcatgcgtcacatgacaatgacccgtaatccgctattaaaaattaattgaacacttgagagcatacgcaaagcgacaaggttatcttggcttctccacgccgagaaaagcctggtcacaaattgcaaaactcaagttttcgcccagctcgtttgattaatttccagttcctgaatgggacctctcaccaaaccggacctatccatgcatgccacatgccagtatttgggcgcagccgataatacctcgagtcgtccttgattagttgagaaaccacttcatttctaaagttatccaatcttggaattgtgaacagctgcttgtacccatgttgaaatatttccaaacgtaagccgatttcttatcctaaacaggctctagtacatgcagtttggtttaacggaacatatcaaggctagctctagaagcttgcgatacacagcgcatgtatataatcgttggacaattacgtacgtacagtgctccaaatgggggccaaaacggctgcgttctttccacaagtttcccaacccctttccatcgttttccgcgtgcacgcttttcaaactgttaaatggtgtgtttttttgcaaaaagtttctatacgaaagttactttaaaaaaacaaattaatccatttttaaaaaaaattaactaatacttaattaatcacacgctaatggaccgctccgttttccgtgcggtggagttgggttcccaaccccaagtatcaaacacagcctatactagtactaaacgaacccaatactcttggatatgatcgaatgaaaaagccttcatgcgaaacctagctactcctattttatacgcgtcctagctgcaaccccatactatatagtataattaaactacatatatataaaccgggcagattttttttaatataaaaaagcttcacaaatcaggaccggttcgtaggttttcaagtagtagcaggaaggaagcgtacgttgcatacatacttcctccgtcataaaaaaaaaaaagacaaactctagtttacgtgtccatcgtttgatcgtccgtcttatttaaaaaaattataaaaaaaattagaaagacaagtcacgtataaaatattaattatgttttatcatctaacaacaataaaaatacgaattataaaaaaaattatataagacggccagttaaagttggacacggagaccaggttttgtctttttttattttttttttgacggagggagtatgcaggtcccgtgtagtattatcttatgcggattgcttgtacttgcccgggtgtatataaaaatcaccggtacagtaaaaagcgacgacccaattgtttaacacgccttgtaggtccaattatttgcttgcttgtctgcctactgtccagtgactgaccgagccctgcacaccctacgtgacagcaccactaccctcgacttggcaccgatcgatcggtgcatgcacatgcaccgcgctgccgctaccgcgcacgcatttgggcggccgcctgcgcgcgagagcaacggcgcgcccgcgaatttcacgacgacccgcgtcgaccacgacgtcgtgggcgaacgcgtcgcgtgcagctgcagtgcgggcgcgtcccgtgggcgcgcgcgggggagggagacgtactccacgttttttatgttcaacgaacgcgacaaacgagtccacggcgcggcgggcgcctcgttcgctcgctttggcgtacgtggcctctgctacttcgggttgcccccacacgcgcgcgcgcgcggtggcctggcctgggcggggcaggccggcctttccgttccccgagcgagcgagctgctagtaaaaaccggggagttggtgtgggtgggattggcattgtatcgtgagagagattgatagagagagaggcggacctccctgaccttatcggcagcgccatcccatcccttgccgtccccccaagagctcacccctccgcctcgcttcttcatctcctctcctttaattcggccccgcgccgcccgcttcacccccatcctacaccgcgtgcctccttaccttctctttgttggaataacgatcgtttcgcttgctgctccggggaggtttttcttgggcgatcgatcggctgggcaggttcgtcggagggaggtttctgccgcgcgccgccggggtgtcgacgtgtcgagcggtgcgtggaggaggagaagcgtgcggcggaggtaaggaaaacatgctagctacagcgatcgatcgttttgagagcttcatcattgctgggtagcttagctatgctagctagagctagctgctagatgtgtggacaagtcaaaggccaaagctttgctgttgatgaaaagatctcccatttcgctttggttgctttgctttgcttcgctgtttgggtttgggctgcactactgtgccatgcaaattacttcgagattctttacaaggggcttaatctcgctttgtcttggcaggttgtggtggtgatggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcagaagccatagcaatccaatgcagatatgcaagctaagctaatggtacaaaattgcgacatgcatgttggattgttgattggacgatcgacaggcctttgtactgggtgcaacatacgtatgcatctatcatgcatgcgttgcaaattaagatttcaattcatattcatgaggaggtttatcatatacacatattttaacatctgtgggggcaagaagctagaggagagttgcaagagcaagctcggaataaaccaaaggtcagtgagattatccaatgttttgtgtttaattctaccaagtgtttttttttcatttttttctcttttgcattctgtaatatggtactatcctattctagtttgtatcttttgatcggtagaaccatgtttctgaaaaactcttgttcccttttttcaacctctgaaacatgtgcaacaccagaactgtcttatggtcactttcactggtctgaattcaagctcacgatttggtggcgttgaatattattttttatttttattttttgttttggaaccagatggtgatattgaatggttctcgacctggtcaaaatttcgaaccctagctaagctaggtcgatctgaagcatgcattttgaacaccattttttttgcaagaaagtaggagtagtagtatactcctagcttaaagtttgctctcaacaaattcaggatagtatacgatcaagtactgtactatcctgtgcttaattttggcgttcttgtactgctactcctactatactgtactgtacttagttttggcattcagtatataggtccagaaggaaccagccaccaggaggcaggagccttctgccctccctctttttgtttcacctgcagcttttataatggcctctgaatctctgacatcttcagtcatgtttttggcgtttcattgcttggaattatatgtgtgattgaatactgtagtatatatagcaatacttaagactgtgtctaggtgaggttccgtttaaccaacaggcaaagctgtagcaaggcagtggcagtgaggttccgtttaaccagcagggcagagctgcaaaatctggaaagctgctggccatgagatgccaagcccaaaattgacactagctgcaagattctcaccatctgctatggtacttgtactatcatgcatcttgcattctcgaagtacaaatctggaaatagggtctcggtcccttaatgggaaataaagaggagagggacgtttcacactttcgcataatttgtggggggagagagaaggcccagagctttggaacttgctcatagctttgcaacctttgtcctctcggagtcctggagatcagatgccagagcatccccacaccaatatctggtggtcaagcctctccaaatccgggatactaagctagtgccatactgtcatagtatctctcccccctttatttggagcatcatcatgtccatttgttcagtacactttagttttcagatgtcgatgtgttcagccacctttccaaagcaactgtttagattatgaagtatattttctgaattaaattagctggagtaatccaaaccagcacaagtgttaattaagtttttgcacccatgcatgcatagcactagcttgttggcattatatatctttcaatgttactagctagctagtactatatgcgagttatagtagacatgatttggtctctaattggatatattattaatgaaatgcaagttgcgaaaggaaaacttaagacgaggtctaaccgtctaatagtactagctaagtgctaataacagtgcatatatattagggtaaattgtattagcatgcaccttgtctctagttgggtgctgccatctacaagactacaactaaatcttgtggaattccattgagtggcattggatgttgtgtcatctacaactaaatcttgcagcaagcgagcaaactgtatttgctattgtctagaggcctagtattcagattaaacataaaatatcgatgcagaacatgcaaaaacaggattaaaatatgcagtcggcaatagttcaacctacattcatcttatgaatgataactgtaccttgcaactttgccttaaacagaatatttttgtgatgaatgaaatacttaacttggtggttaaaaaaccactatatattattgtttgttcaccataatgccggccgtttatttgcttggtaatgggtggtagtgataatcatgtggattaatttttaattttcatggctttaatcagcttatgttttaaagagatgatcatactaaataatgtactgtttcacctgatttgatcccgttaatttatatagagttttgttaacatttctatgttatttgttcccggtacattgacaataatgtaagactaagatcttgctcgattttctacctgatgatgcacctcttatgacttctttcgtcaagaaggcctttgtcaaatcacattggagtcaagcatcagattgccaagttttcctaatttggtcctatatatacatgttgttctctatattatggtacattaaatttgaaagaaactaaaggaacttagtagcaagggcagatccagaataagactataggggggacttatcttctaagaactagcttgggatttcatggttgctgaagctagtctcttttcttttactagaaaaaatgcccatgcgttgcaatgggtaaaaatattttttatcgcctatacattatactccttatttggttttggaccgaaagcccattattttcttccttttcagccctatcgtcttcaacctccggaagtgcatgtacgataccggagccgatcctcccatcaaattcggtcgaatctttcacgatgggttagttgagggtttttatccactcgatctcctcttttcctttttaaaaaatggagcaatccacaaaactcagaataaaaatagtgattgagattaaatccggtgaattaaagacgaattttaaggagaaatcaaggggaaaatgatgagggagttgtggggaatcaatttttgcaatcaattagaggaggaaacgcatagagggatagatcaacgtggcggctgagctagggttcagcccgacgacagaagaaaacctagttgataaaaaaacgaatccttaccgcatgcgaaaaaacgtaatgtaaaaaaattgggatgaaaaaaaagcgtgccaaaaagaccgcgatgtaaaaaaaagtggatgaaaaaaaccctgaaaaaatggcaaaaaaacatgtgaagagaaaactgcgatgaaaaaagtagatgaaaaaaaagcggggggatcggcgaaataatacggatggaaaaataccgagaagccttatgtatctttttattagccttatgtatattttattatgtatttttttattaggtatatagagatatatatttgttagcatcatgcggttctaatacatgcacagataaaccaatacaatttttctttatctttatatgcgatgacaagatgagtggagttggatggataaatttgttatggaggaggcataataggaataggggaggaaataaattgaaggtgaagtagatcttagcgtgacactcggtgcaacctagcttccagctaagttagctagctcccaactgtaacatggacattgttttttttaaaaaaaatcatttcctagaaaactaacaaaacaagaaattttgtgcactcactgggtaatggataatgtgagccagatgactctggtagagaaaccatctttgctcgatcggtcaaattccacaatagttctggttctaataaaacctgggattaaaaagtatctttagttccagtttaaaagttgaggggtactttttgatctttagtagatcatttttagtctcggtttaagaagttgttgagttcaagacagaccccgattatttttactcccggttggtataaacaaccggggactacaaatagatctttagtcccggttgtttataccaaccgggagcaaagagtaccccgagccgtgcaccatctcgatattatccgcgcgtctcctctcgatttcctcccctcttaatatctcctcctccatcccttcctctccccttcattcccttcctcacccgttcctccccttcccctctattttgtgatgtgatgtatttgtgatctctgatgtatttcttttcaatctgtgatgcatttctttccagatctgtgatgctatgatttgtggatgatttggggatatatagggagcagatcaatttgagcaaagaaacaaaaaaaaaaagaaaaaaactagggatcaaccggactgcttccaccattaccaactgggattaaagatacccggatttatagttccggttgtatagggggttcccaactaggattaaagcccctttttccactagggtgaggtacgtttcgtagggtctaaaatttcagcaacgctatatcaacgcacgtacgtacaggtagcctagctacccggccattacccagtgagcacacaaaatttatcatgcccagatgatcaggcgtacgatgggaagaagaggaagactggaagaggaaagtaggaacttaccgcgtgtactgctgcccgcccagatgatcaggcgtacgctgcgggcgcaggtacggaaactccctcccccagaacgtacgccgggccttccgccgtgcagcttgccgctaccgcgacgagatgcgtcgcacactcgcacgcgcccgccgcgccgggatgcctggtatagttgtacggtgggcggccgccggccggcgctgcgcaatcacgcagaaatccggtcggttagattttgtagggggcaccggccggtgtccggtggccaagggctaaagccagtagaggccgcgatatgatctgggctgagcgtacccagcctgcgagccctgtaacataggctggctgggccgcacaggtagttgggccgtgaaggtgaagagaagatgtccatgcagaggcctctgatagccccgcaagcaggtgtacactgttacatacatgtctagactctagagatggcaacagggtgctatgacccgacacctgactggtttttactctattagaagctaattatctattatatgctaattatgttttaactcttatacccatgagtttaccgacgggcgaaaattcttacctattaggtacatgggtatgggtctattctttatctactcgtacctaccaacccgagggtgaaaaaacctgtagattaagcctaaatccatgagtaacataaaacttctttcttatcttaagttctattctagttatatgaaattattatttgatttcttgattatgtaatatggttgtagattttttttactcgactttgagcgctaatgttaatagcattgttgccagaagaattattgatgggttacggttcaaaaatagctaattatagaacaaaactataaatggtatgagtcaattatatgggtatgggtacccgttacctgcacgggagtgggtacagggatgatatcgaaagcaatactgttttgagatccaatgtgatccgattttgtataattaagaatgtgttatatcttgtattccggctcaggaatggttttgaaacttgacaataaaatgaaggagctcaaatgaacattttcctaggctggctaggctgcataggtcgtttggttcgtgaaatgtccacagggtttctcaggcgcaaacatgtcctggtgttttctctcaaaaaaaagcgcgcgtgcatgcacagggggagagagacagagccatccattaagattgtactaaatctactaactaataacaacgtagtaaagcatctgtaaactaggcaaggcactactagatggaactaccaattttgtttagattttggagtcggaactcctatccgatcgagtacgtgtatgtttcggcaaaatttttttttacctaatccctttcctgttcggtcagcccggatgtaaaagatacagtacagtgcctgcttttctctgcagcagttttgcacagagggtccaattttgagtggcatcttatattcttatacgtgcggcctgcctccggttcgtcgggtctagatatggtaacggggaattccccatcggaggttactccaccatacccgcctccgcggtggagaattttccccatcaccatcaccgtgaaatgcaacggggcaacatctttccccatcaccgcctccgtgcgggtaatttatccccgtggagcctccatccccgctatcaacttactcaacagtcaacatgtatgcatttctcatatcaaacaataatttagatacaaaagattaacactcaaaataacaattctagccatcaatttcagcacatcaacaacaactacaagaacacaagttcacaaattcgcaaatgcacatcatcagttcacaaatgcacatcatcaattcatcacttacaacaacagtgcagcaacaagcagtgcaacaaaagtgtgcccaagaatacaatatccatcatattcccagattaagcaacaacacaataatacatgatcattcatcattcatcagtcatcactcattagttatcaccacattgcagcagcaacacatgttgtccaggcatacacaaaaccatagtcggagtaggtcttttgtgccaaatatccaaaagcattgccatggtttacaagtttatcatgacacataacaggggttacaaacatccaaaatcattgcgagaacagtgcatgtccatacattcatggcttcaaacaagagcaagtccctaaattaaagaagtagcaaaagatattcaattagtcaagtactagaaaaaaaatgcccgtgcgttgcaacgggtaaaaatattttaaaattgatatacattatccagcttgctcggtttttttagttgaatactccttggttttaggctgaaagtcccattcatttcttttcaaccctcagccttgttcgctagctccatccgctcggcttgcctctttggcacggccagtgttggacacaggatgttgcggatgaaaaaatttaggtaaggacggacgaatccttacatacttttttattattaggtacatattaacaccataaaaagtgaccgtgggtcctttgcatgtgcagcaaccttttgtttctttcatggaaagaaagggcattaattttgtatacttgaatatgtattacatcctatatatcggtaagcatatatttatatatatttttgtgtatataatatgattatctttacttttcgaattaaaaaatggttcattataagatttcagaatcaataatttcgaattaaaaaatggttcattataagatttcagaagcaatctgttgaagaaagaggtgcaatactttttatttttcagcaatgggatgtgcatggtaatatgatttgacacgagggaaggaaagtagacttattctaggatgggcccatagacatagtgccagcaataataggtgaaaaaatgcgggagatttgacacgagggagggaaagtagacttattctaggaggggcccattagcccataggcatagtgctagcaataataggtgaaaaaatgcgggagaggaaggtgggaatcgaaccctggtcgccgggatgaaaactttcgatgttaaccatgtaggcagattactatatgtgctacgagattacatggaacttacatatagtatataaacctcggttttggagtagattgaaaactgtccgatccgtctattaatcagattaaaacggatttagctacacgtgtgggacagacgaaaaaaacgcccagaatccttacatattttttaattaggtatatagattttataaggatataacaaataatggcggtaggagtttgattgctaattttaagttgttgaaagaatagctcaatccgatcttggatatcttgaaggcaactccaaaagcttgctgcttcttcgttatcagctacaagataacaattataagaattattttgcatccattgcattgtaaaatctatgctaagcatgatgtatgaataaaacagcatatgtacctcgatacttgttttgcagccaatcttgtgagcacattaaggcctccaagagttctgaagtaagccggctacgatgctcactaagaacccttccacttgtgctaaatgcagattcagatgcaacagtgctaacaggaatagcaaatatatctcgtgctaccttcctcaatgtaggaaagcttgtcccaaccactttccaccaatcaagaatcttaaagttttctgtattaattgaaaccaactcatcctctaggtacctgtctagctctgatttaacgcgtattgctgctggtgtcctactagtaacacgtgctgtgattgaagacaataaatcagaattgacaagtggaggagctgaagattccgtgttatcctcatcatcttccacttcatactccatcaaatcatatagagtgtctttcacctcagcaactttcgttgcacactcttcacttgactgaccagtgatggtttcaatgaacccaaggagatagtcaatcttaaacctaggatcaagaatggtggccaaccccattggcccttgaatatctttccagtacttatcaaacttttgaatcatttcaactgacatttcctctatagtagaatcaccacaaacagcccacttcctaatttgctctttagcctacagattttaagtagttgaatattggaagtcacataatttgtgccagaaaatactgcagtgatgtcattaaacaacttgagcctatcaactacctcactagcaaaagcccattcttcttcactaggagcacaaatcttcgaaagccaatatggtcaacaatagataaaggatactcatgtaatattgaacctcaatgaagattgtgcaagtgtctttggccccatcttgatctttctcaatgtgcaaattttcaaatggtcatgtagatgtgaagtcccattgctgctcttccctccaagccgcttgtggcaatgaaggcattcagtcttgacatcaccacagactttgactttcttgaaatccttccaaacaacagaagtaagcttcctctttgtgccaaaattctcagaatcatcttctggctcatcatcttcaacttgtattggctcagaatcattaacagactctgcttgtggtggaagtgattgtgattcttgctggctgctactcccacaaccagtaccagcagttgaattcgtggtaaatctgacaattgacaaataaatatagatcaatatatctttcagcctatagaataatcttggaaaacttgaaatgaagaatctctacacataaagcatactgaaatctgctacagcctatagaataataaaatttttatgagctacactacacagattcagattcctttaatttcaaaaacttaagttcataacatatttataacttaacaacattcaatgtacaaccatacaatatacatgtaaagatatctaattttctacagatactctaaatacaacattcaatatctaagaaaatcaagcaagctgcaaattaataaattgcacatgctaaattgttaggaacttaggattacaaaagtgaagctacaatatataaagggttagcgtgaaatcgaaccccatggatttgaataagcgcacgccgttggtggaagatgaagcttctggagttcttggagcagaaggagctcctgccttagtcgaagcagaaggtgctcctgcaagatggctttttgcctagtggtggtcctttttataggtggttgcggcggccgactgcaggcctttgcaccggagttggaggaaccagatctgcccacatgaacaatggcagatccagcaacaggcacaacggcaggtgtggctgcagctgcagcgcttatagcatgcgatggctggtccaactccgcattggcgtcccttattgtggatcgccgaacgtgagttagtgactcaacgagacaacgatgtagccatggaagaggaatttagtggagggggagggggatatggtactgtagttaggcgtctagggaggggtactgagttgggagtaggacagctagatgtgctcaccttgcatcgtcgtcggagcttagcagtggtgaaggcgaagccatggtggactcgagcggctggtcgtcgtgtggactcgtcgttttcccctttcttgccaccgaagccttcacctacatccaccatcagcaaaacaaataagcctacatgacggatcagatattgacagagggtggaggaggaggccgacgtccggtggccggtgccgagtccacggcgtcctcggacctgggaggctgcgagtgaagggaacgggacggcgcggcgtggcgctgggacctggccacggggctcgggagctgggagctgggccacctgggaccgggcggctcggcgctggtgcggtcaccgacacggcgggcgcggcggcccggcgctggcgcggtcgccggcacggcgggcgcggcggccctgcgcgtgcgggtgcgagatcgggagtcggcgccgcttagccgctgtggccgacggacggtggcgtggcgcgtggcggcgtggggattgggacgagcggggcggacggtggcgtgtggactggggaatggggacgaaggggataaggattggaatggttagggttacacaactgctttatatactctatgctttgggcctggtttttatgggccatatgggccaaatgcacaggatattactacacacatacttttatatcgggcctccacggagggcggggacgggggacggtgaactaaacccgcccccgccagacccgacggagactactttctctccatttgattccccatggagacacaattgataccatcaccatcacataatgggagaattctccacgggggaccggggaccgggtacccattgccatctctagtcgggtccttcgcttcttcccgtggacgccaatcgtcaacccggtaagttggtactaccttcccttcttcttctttgctagtgttgctgttgtcttgtttatgacagcgcggcgcggcgtgctttgtatggtatcgtgaaggggatgtttgtttaatgcataacattgctataatttagattagttgtggcgtggtgacgcaagtagcttaaagatagtgccacaaataataaaaaaaatactatgatatcacttcagatgaaaataaactttatagaagagttattgatatcattgagatctacaactttgtagtgtattaccttttcatttcaaatcatttggagtatcaaataagcattagtatttcttaaataaaacaattaaaaccagtgaaaagaatttggatacaaataaaataaattacatttagatctctctggaagggctttttttttaaaggacgtgagacctctaaatttgtaaattttcaaaacaaaaatttattttttaaatatttcaacaaaatctctatctctatctctactacttaaaaaataagatgtgcttccatcgtccgtaaaaaaaaaccagacgaaaaaatccatccgatccaaaacaaaacgggctaaaaaaaccggacaaaaaacgggcaaaaaagaaaagaaaaaccaaatctgtcccatcaaaaaagggcaaaaaaaagaaaggaaaaacgaatccgattccgtggtaaaaaaaagggagaaaagaaataaaaaaggaatctgtccgattccttaaaaaaggggcgcaaaaaaaaccaggtgaaaaaaagaccggccaaaaaaaacgaatccgcgtggatgcggtaaaaaaaagagaaaaaaaaaacaaatctaaaaaaaaagaattatatgtggtgcagtaaaaaaatcgaatcctattatatttgacatggtactatatctctattttctctatctctactacttaaaaaaattaaaaacgtttccgttgtccgtaataacgaaagaagggcgaaaaaaacattaaaacagaaaaaagaaagttcgattcaatttacttccattgtccgtaaaaatcttatcttatcttaatctcaatctttccaaggggacgagcagcaccctccatccccgcccgcgcgatgaaacaccagccaaagaaaaaaaacaaaattaagcagagggataaactagattgaagttcccaaaattaaaagaggataaacgatattgaaactcccctaactcgaaaagagggaataaaatatattgaaatttcccgacaaaattctctaaattcgaagaaccctaatttcgggtaagaaccataagagtcaaatccaaatcaattaagccaagggtccgggttacttaccggacttgaagcccctgagctcattggagctttccgggaagtggcactgccgcaccttcacctcctcgcagtcgtgtcgggttccctgcatgcgcgctgtcctggagcacccctccaccgtcctttgccgaagacgggaagcgtcggcttggcgtcgcccctaccgccgatgaggtcaggccgctcggcgcttgtcgccgtttgcacgcccaccttgccggaccgctgacgtcatggcatggctttgcgcgccctcgtgtgcgccccccagccggcgaagcaggagccactcagcggtcatcgctgcacgcgcgcaccagcttgccggaccactgtcgttccgctctctcgtcgccggagagaaatgggatcaggagagagggatttgggagctagggttttgcccctctcctcggtcggcgcttcatccggcgcggggacgattggagccgtccatcagatcagacggctcagattcgcccagtgtcgggccgtcgtcgccgttgattacgctgcgcctaatgggccacggaagtgcatcggaccgtccccgcatatgtgggccgcgctcagctgctcagcttgcgggccatcgaatggactcaactcgccgaagatgggccagcccaagtttgggctggcttgggaagacctgggccgaaagcaaatttgatcaaacaatgtggctcacatttttcaaattaaagtccgtcggataaactcttaagtaggcttgaaaaataaatctaaaactaaatcctaaatcctatgctaattgatcaaattagactcggttctacctatttgttaatatatcaaattatacttgatttttacaaatttgaggtttttagggtgacactatcaaacggcgtttttcccgttgcaacgcacgggcactattgctagtaatataaaaataaaaaaatcgagcgaaaccggtccataatagggacaacagattttgtgcccatggcccatggggtgaatggtagagggcttcgttgctttaccaaccctagggccgagcttttttcttttcttttttttttgactaaacatctgaattgtcattgcataaaagggagaaaaatagttttgttacaatggatttagagtttgtagacaggaagagaaaatgtgtttccaatcatctattacggatctattctgcaccgctagtgtttgtccccaaaaacctgcctcgcttatccctcgttgaaggcatgcagctacagaaggttgttgccccctgaaaaccacatcatgcctatgattccatagcacccaaaagcagaggaggtagaagacatggcagtgctttgccggcagaagctgcgtgtgacttagccggtagaagaactgaaggtcttggattgagggttgcactccaatatttgtccagaaactgaccacaaaagggcaagtgaagcacaaatggtttgccgtctcgtcgccactgttgcagatcacgcaagacgctgactgaacaatcttcttcttcaagagatttttcattgtggacagtctatttcgaaccagcagccaagcaaacagttttaccttcaacagtgctctgctgctccaggtgaacttccaatttggcgaggtaatacctgcaggaaattttgcctcataaatttgtttagatgtgagtgtgccagaacgatcgtcttgctctctccggtcgccgacggccgctactcgccgccgctagtccgccaccttccctccttccctctctaagctaaatcggggcctttgtacctggtcgccgaccacctctccaagctaaatcaggccatctgtccctctacctctgctagtaccgagtaacagtctccaacccaaatttcgacattatcgatttgattcagttgaatcgaggcaaggtagaatcgtttaagatcaatccaacgtatccggcgcctgtttttttaattttcactctctcttctacctaattgctgcctctcgtcggcggtaagtatctctctgtttttttttctgtatgctgaattgctgattgaggtctcctgagcgatctatttggaatcacatacctccggttttcccacctaaattgacaaagtatagtatttacttaatttcgttttgaatacggaaagacacaatccaatttcaatcaatgaaacgtgtcgtttttcaggtccggtgacctgttttattcggtttatcatcaatctgcaatggctaacaagggagggtatctaagcgtgttagcgcccattgaaactacaccaaccatcaagcaagaccacattacttccgtaagcgttttattttgtaaatctacgtcattcttccccctcccccgtccatgaatcctccaacttttccttcgaatttttctgcggtcatatagttcccttctttgactgtggtcggtatttcagatttcatctttaagtttgcttaatgttttcgcaccaaatgcagaatgctgacctacaagacaggattagccagttgccagatgatattttgctagccatccttgatggactcaatgtccgagatgctgcaagaacaagcctcctctcaaagcgttggaggccactccccactatgatatcacatcttacaatagatgtttctgactttgatcccaagagcatgtccagcttctctgatgatgaactgggtcggatcaatgcaacagtggttaaggcaacgaagagcatattggcatgcaggaagtcaaatgagcacactatcagcctcctatccatgagattctacttgagagacgatgactgcatatcctttggacacactgttggccacgttatggcaacccaaaaagttgagatgattgaatttacaattttgacagagaaagatgacaatcagtgcattgacgatgatttcatcgtctatgggagacgttttgcgttgttcttcagttattgtccaaatacattcggaggtctcacaggactccaacttgagaatttgagatttggtgaaccagaaatcattgatgtcctcaacacttgcaagcgattaaactatttgcgtttgtataactgcagctcaggaatttccacttttttggaagttgaacacttgcaactcagtgaacttagtattattaattgccgttttggaataatcaaacttagttcactcccaaaactcacacggatgatctttggtggttggatagctttccaagatccactttcttttggacatgttccattactggagtctgtaaccctcaccaatgttggtcttagttggcacaatgcggtgaagttgagcgaatttctgagcaatatctctataagagatctgactttagattttaatagtgaaaaggtatatcaatgttattcttatagttccatctaaaaaggattattcttctgctctgatggctttacttgtatgtttgtaccatgtcatgtactcatgtgttcttttccttgttgcatatttgggttcaaccagaaggcccaaaagcacttgcatctgcattccacaaactaagggttgtgaatttagttgatcttcctgaagggtatgatccctcgtggacaatgttctttcttgaggctgcaccctccttgagggagctatacgtggcggtaagcacctgcaactgatgcttgattatctgctaagccttttacatcaggggcgtagccagctaggtggcaccgtggttcacggaccatctaaaaatttgaaattatagtatatgtgctggttaatatagtaaaaattgtatagtggaccacccttttaattgacatattacatatagatggactacttttaatttaaattttaactacgccactgttttacattttgcattgactgcaatttctgagatatgttttgcggcctgcaggtatgggatcatctctgcgaaatagagacggatgatgagaggaggaaagcctactcatacagcgagaataagaacgcggattggaatgcgtctgcgtcagatttcaagaaccacagcctgtcaacgttagtcatgtttggctttcagtcgaacgacgaaaacttgattaggtatatcagacttgtcatggatgcagcggtgaaccttgaggatatattcctgtataagaggatggcgtgtgaaaagtgcaagggcaagaatccaaggcccttgaggtacccgtcgaccaagaaacagagacaggcactgaggaacagaattgctctggggacacattcgcttgctacgatccatttcccaactgtattaagggctaatcactatgcaaaactgttgtattaagggctcaaagccgcgtactaagttatcaattttttttttcatacttcctttttaagctctaataaatgtcatcggcgagcgtctaaaaaataccataccattgtactccctctgtcccctaatataaggtattttaacatcttgcttgtattatttgatcattcgtcttattcaaaaaaaattaaaattattatttattttatttgtgacttactttattatcctttattatccaaagtattttaaatataactttttattttatatttgtataatttttttaataaaacgtgtggttaaatgttaaaagaaaaagtgaatatctcttctattagggtatggaggtatccatctttcctaaagaaatgtcatcgccgtcggttttccattaatagccaatcgtgtttactgtcggtcaacacggtcaaaatccgccgtaacaaaggggagctagatgcatctgaagaatgccgtaaacgctgagatcgactgcatcctctccatgtctggccgaacgcgagtttgccgattgctttgcagctggtgatctagcggccgattcctcgcacgttgcatcgacatggaggagccccattgccggcaacgagaggagggtgggaggagaaagggaaggagagatttgtacacagctgcagccaggtgagacccaccatggtacgttgcgccgcgccggcttccgcgcggcggcaacatgccgtggcggtggccgcagatgcctcgactgcaaagcatgtcggcgcggggtgcagcggccagctgcagccgtggtcgtcttaccgcgcgcggtccgcggtgcttgccgtgccaagacgtggagctatgccagtatgcctctcgtgcgtgctatgttatgagcaaacaccacgtagcatcaatataatccctccattttatattataaaactttctagtattatccatatttatataaatatttataaatctagacatacatatatatatatacatatatacatatacatatatatatacatatatatatatatacatatacatatacatatatattcattaacatctatatgaatgtgggcaatgttaaaaagtcttataatatgaaaaaggggaagtatgtcgcaaacaccacatagcatcaatatatgtcgcagagttaacgttgcaggtgcggtacgcctcaccaaaacacgtaaagaataagtacgtggctttaacctagtagtaacagataaagttctcgttgtcactgctgagacttcacatagcccggcaataacctagaggccgcgatatgatatgggctgggcgccctgcctgcgagcccctgtaacataggctggctgggcaagtaggtgtacaccgctacatacatgtctctgtattctctcagggttagcaacctgctagtgaacttctaattactcctctttccaggaaaacaatagtgatatccaccatatcagtagcattgatcggaatggtcttcagaatacacaattccttgctagtttggtactaaaaacgccaaatgtcacaataactcaatcataagcaaatgcagaaaatgcggatacccgcaagcaatacgtcgtcttcagcgtaaatacagataaatctccagcacatcaaataatacgacgctaataaggggcaggaaaatccggtagaagcattcagaagtcagaacagcccatggcataaacgttcagagtgtagctttcagcagcgacaacgttggacttcttgaaacgctggtggtcgcttcctcctgagatagtcaatcggccttgccctcctgtgcaccgacctcctgcagatagtgctccgcgtccaaagcagccatgcaccctggatacaatgatgagttagaagtctgccacaaaaattttatgctcagcagtagccatcaatgatgagttagaattgatcttgtcgacagagtcatgcatatagacaatttctctctttttttgaagtgcatgtctattggatcaaactcctgaaacaagctagcacaaaataatagtaataataataaggcttcatcatgtactaaccatactgaccatgtatcaaccaacatgaaaatcacaaaggaaaaactctgtatgctgcttctgagatgaaaatcttatcatcaggctttttcctttcacacgacaggtaacaaggtagttctttctgaagtatatagaaatggcatactgctttcattctacatcagcagtactggccttattccctgattccaatttttgctaaacaaccagacatcaggattaaaatcagtctcctatgactgtgtccatcaaaaatgccaatttggattgtttctgaccaagaccatacttggtaacattattactccctccttccctaaatgtttgacgccgttaactttttacaacatgtttgaccgttcatcttattcaaaaacttttgttaaatatgtaaaactatatgtatatataaaagtatatttaacaatgaatcaaatgataggaaaagaattaataattacttaaattttttgaataagacgaacggtcaaacatgtttaaaaaagtcaacggcgtcaaacatttagggatcgagggagtactttgtttatgaccatccggaactcaagtttacagagcatgcatggaaagtgaacccagtctctgcttattcctccactatgttgtccatcaaaaaggtcaatttatttcagcaagtccatacttggtaacatattagtttactttgtttatgcccatccggaacacatgttcacagcacgcagggaaagtgaacccagtctctgtttattccaattcattcttttatgcaataataagttcaaactccatctctgacaggatcaagaagggagaatggcgaaacatgaccaattattgaagtttgagcatggagaattttgcatgtgccctctaaccacatgaaaatgtaacttgcactctagtaaaaatacttgctgcaacatcagttagcatgtaaacgcttaacaaagttaactcacatcacaggagtgacagagtgatgtactgaccatacttctgtttttgatttttttgcaaaaatacagtccgtactttgtagtgtagaaattgaaatgcactcttctatactaaatgggaagtagcacttttttttattcctaacaatatttggaatgccttaactatgaaaatcccagaatagcttgaaagtcacttatcccagttcaacaaattccatgattaactaccagctacttattagtcaaacatatgaacctacatggtactttggaagcattaaccggcctcaaatacacctaactttttttaggactaatacacccaatcctagcttggaaacagagcacgcattcaacatgcccaaaaggtagttagtatatctaatcaactatgctagatacataatgaaagcacttatttcagaaactcaaacacgttaactctatgatagcttaaaaaggttctaattttgaccatcatcattcgctcactacatactcaagccctgaacaatttctattgcaattcgcactagcaaatagcaacccatgaagcgactgatctctaagaaagtgcagaaaaaaattaatcacaggtaacctgaaaaatcatcaattcacaaacctgatccagcggcagtaatagcctggcgatacttcttgtcctgcacatccccagcagcaaagacccccttcacactggtgtgcgtggagcctggcttggtggccacatacccatcagcatcgagctcaagctgcccgccgagaaacttcgtcgccggttcatgtccgatggcgaagaagagaccggacacctgaaggtcggagatcttcccagtaaccaagttcttcaccttgacaccagccaatggacctccaccctcgccgccgtaggcctcgacgacctcagagtcccagaaaacctggatcttggggtttgacaacgccctggcctgcatgatcttggaggcgcggaaggtgttgcggcggtggatgatgtacacatgggagccgtacttggtgaggaagttggactcctccatggcggagtcgccgccgccgatgacggcgatgggtttgttcctgaagattggggcggccccgtcgcagacggcgcaggcggagatgccgcggttccagtaggcgtcggagccggcgaagtggagtcgccgggcgacggcgccggtggcgacgacgacggcgtcggcgagcacggtggtggagtcggaggcgacgcggaaggggcgggcggagaagtcgaccgcggtgacggtctcggagatgatgctggtgccgaaccggagggactgggcgcggcaccgatccatgagctcgccgccgaggatcccctcggggaaccccgggaagttctcgacgtcggtggtggtggtgagctggccccccgccgcgatgtcgttggcgagccagccctcgaagagcacgggcttgagctccgcgcgggcggcgtagatcgccgccgtgtgcgccgacggcccgctcccgatgatgcacacgcgcgtgcggagcggcgccccggcggatccctccatggcttggctgcggcggcggcggcgcgggtcggagtctctcctcaaaattacgcttcctacccggcactggtcagaccgtcagaccgagaagggaggaggcgacgagccaatcaacggccaccgcgctcggtcggtcatacccccagatggatgttgagttgttgaccgaaactattttctttttctttggacaacaagttgcagaaaatccacaataattgacaaatggcaatttttttttaaagaaacacacaaacactcacaacacgatgcataccacacttttaaacgcgccgtactcctataaacacctccaaaaaaactgaactgatatatctccatatgaacacacattttatctctattagcacatttagaaatctggattaacatatcttgagtttcatgaagttgttgcgagtgcattactatcaacggctatattgtctactgttgaaagaataattaaccgtaaaagcgagcatatgtgtcaactttataacttcgatctgagttggatttgagctacgctcacttgacggcaaacttttcaactgcacagtatgcacgcactagattcacagatcgcaagcgagagcgatcaagtgatgttaacaaactaagctcaaaaatagagtttgtggtgtgacgacacaagcaaaatcatgtcggagtattaggattcgtggtgcgatttgcacatacgtggatctgcaaatcttgctccttccgaccagcttcattcagatgaggcccgccaaaaaaagaagggcttcattcagatgatggcgagaaatagtggcttccatcttttatctttcggatggaaacccaaacagatcgatcgaaacttccgctgcgtgacacagccaaagtgaatcactctcttcccatcactacttccactctccgtgcagtttcgttaagataatggccagtacgtgcgccatgtttatttggatttggtcgttctaatgatgatgaattgatgatgatgtcctcctccattgctgcattacctgtcgagcttttcaggattcaggcaggagagacacgagcacaggaacatgctgccgactgcccactgctttaatcctttttgttcatgcagccgatcaaatctcgctttcgatccctttgctgtaaacaaaaaattcagaggcagcgtttcgttcaaacggaccagaataaacaacactagccgctggcccatgagcagatttttctctcgaccaaatccacgatactaattgtagcaacgggcttttctactactacccgtgggcttttggctaatgacccagccttgtctcagcttcagcatttttaccatttattcacgctacatcattgaaaattttaaatgcagttctttcaggatgatgcaatggcactttcagacaaagaaaaacctgatcgatagcagtgtcggtgtccggctgtccgctgctcccgtgctttcactaactagttgacaaagataaaccagcattgtccacagaacagctagtgacaaacaaattaagccgataagaaaaatcagtaacaggtgagacgcaaagatttgtttggccagactagctatgtgtttctgactttctgtaattggtgagaaattaaccccatccatttgggcatgcattaatttttttgccaaaaaaaaagacagatatcgtcaaactgactctccatcgacacttactttcagcagaagaaaatggagtacactcacacggcagaacaaagaaattggcatgcaccattaaaaaaagagagagcatgcacgctgcatggaaagttttttttttttgaaggaaatcgctgcatggaaagtatatctgtaacagtctgaaacgttaacacgtatttgaatattcagttgtattattcttgccccgtccttttctatcgaataaaatcccatggacctggacggctagacggccgttcgtggaagaaaaattttgtcacacaaaattaaggtctactctaatacagatggcagttggaaaacaagtgttaatatctatcttgaaccaatgagcatggcaaaaaaattcagattatgcggctcacatttcacgccctgttaattacatcctcatgtgtattaagacatgagtgtcgtcaatccaaaaactagtttcacatcttaatttagacttcattcgaagcacacatttacaaccttttaactaatctgtatctttgttccaaaaaaaattgcagccattccagactttgatcagattgttgtcaggtctaccgatgatctcctgccgctggagctggcgtagtcctcgaccgggactgagttccgcttgatgaactcgaggcagtcggcgatcgcctgcgcgtagaacgagttggaccgcatgaacgacggcggcactgtccgccgcccgccgtcgacgtgatgcttcccgccgccgacgaggaacctcgtgctgctgctccgtgagcagccgcctccagccgacgacgaagacgacgacgacgaccgcggccgcctcaccgccagcagctggcgcacgtaccggccgacgaggccgaggaacgtgagcagcttggcccgcagccgccgcaccgagaaccggttcctcgggcacagccggaaccccctcgccggcggccgccgcctccgccacctcctccctatcctcacgtagctctccggcgaagacgcacaaccctccatctctcttcgaatcttcgatctcctttacgtgcgtgtgtgaattgcgatcgattctgtacggcctcctggatcgcgagctatactctgcttgatgctgccgctgccggctgccgctgctgctgctggtcaagtggcagcaagcgaagcaaactggggtatatatagctctcgcgcgcgggtgtcgggggagaggaacgaggcaggaaggtaggtttgaatcgagccttttcgcgagagcgacatgcgcggggagtagcttaattaagctgctactccactaattaacacgcgatgtgaagccggtacggacaagcaaacagccagtgaagccagggggggcagtgtgacgtgtccgtgtaaaatgtgaaacgggtggccagcctgcacgccaaatttcgccgcgtgattggttgggtcatcgaccaagcagatcaaacagcagctgctgacagtgttactactagtagacatgagtgaattaattagtgggcatgcgtccgtgcgtgcgccctgctcagttctacgtaactgcgtagagattacgtatagaatagtgatgtttcgtccagcagagtgagtggacttgtaggggttaagcgcagcagttaaccataaacatgcgagttggcaggagtttggcagggctagttaaaaactcaaaagagccattaacaaatgtactggcatgacggatctgtcaggagatctctcggcacacggtatatggggaggtggatggagtttgttcgtaccggcatgaggccagttgctgcagacagtttgattcttgtgaccccatgaacttgaataataaactgtgtgcgtatcagcgaagagctagtatatctattgaaatactatgaaatgatgtgcgtggatactctgatatccagctggtgtgtacgtctttgtcccgaccaacaacccaaatattttcgtgttgctgtcctctcgattcagttttcatgcatacatatattcagctcaacgaacgttaacacgtaacaccacagcaagaacacacgtcagatcatatccttgacaatctccctcttgacgtacaatgcatgcattccagaacttttttcaagcagatcgatggaaaaatccgtccgtacataaattagagtcttggatcgattagtcaaaccgttgagcttgaggtcacaggagagccacacgtaccgcatgccacgcacctgccgatcgatcgagccgcacgcaacgcaggcacgggggctcgcgcgatccgcaaagtcgcgatcgatcgatggtggccgcgcgcgcgcggttaggtacgccgtgagccggcgaaacggccggagccgaacacatggcgcgcgcgcgtgcgcgatgcgagattgcgaggaaataatcgtattctcatgccgaggctaccacgggagacggagttggtcgtacgtgcgccggtgcgccctgcggaatctcgcggctcggcacgagggcggacggggcgtggcatgcgcggccgctcacctacgaccgcgaccgtgcgtgcgtgtgtgtgtgtgtgaaggagacacggcttcgcatggaggggaaagggggcgtgagtgaaggggacacgtgtggtggactgggggctgggactgacggccgtgtgggtgagtggcgtggcgccatgtcgtttttgcctttttgtgtccgtgttgggccgatgagtgaaaagcaggagtagcacgttttgtttggagcacgagccacaaggtgtgcgtataattaaagaaaaggggatggtttacttttggactttttgagtctaatggcatttgagtacatgcagcactgagtaggagtacgttttaagctgctgattagtagtatatactttgctcttagagcaggtacaatagcaggatataagccagctgcaaagatattttaaagagataaataaggagagagaagagcagcgggctacaaatttgtagccagttatagcacggactccaaaacgcagtgtgtttatgataggtgggactagatattaatagtgtagtatgtaaatattgtatgaataaactactagattggctatagatgaattagagatagtatttggctacactattaaacttgctcttacacggttacacctattgtgttcttccggaaacacggaagtgtgttgacgacctagagccgatgttctccctgaagactgaagaccgaaaagagtacagctaaggtaagctactgattatagttggccataaggcccgaggcccgaaggcccggcccacggcacgcctttttggcccggcccaagcacggcacggcccgacttgggtcgggcccgtgccggcccggcccgactgtcgggtcgtgcctgggcctccccaccagcacgctgggctggcccggcacggtcgggccgacccggcacgatgggctggcaggccaggcccggtacacaaagtatagggactaaaaatagacatataaatgtcaatgtctaaagaatagggaccttaaatagacttattttagctatttatataccacagcacaaagaagagggaggtaaaatagactttttttagctatacaatgtcacagcccaataggagggagaaaatttagacttattctgaggaaaagcacgatggcccatcgtgccttcgggccggcccggcacggcccgaggcgtgttgggccgtgcctgggctgtgagtgcggcacgtgggctggcacggcacggcccggtgcgtcggtcgggccgtgccggcccgacaagcctcggcccaggcacggccgggcctgggccgtgccgtgccgggcggcccacatggccatctatactactgatggagctgttgtgccgattcgtcaaaaaaaactaatggagctgttgtgcagcacatggcaaccgacagggccgaatctgacgtcaaatgccaataggccagatggaggcccaaaagtgattacggcccattataaactggagcccaccaaaacgttcagcttggcctgcaacgctacgagagggcccacaactcgcgaaaaaagtacacccaaggtccctcaacttgtcatcgagatacaaaatcatccccaaccgcaaaaccaaatatatgacatccttcaacttacaaaaccattcactttagatccttcggtagttttgaccccggttttgtctaacgtggcagctgagtcagtatgggtccccatatgggccccacatgtcagtgtccacgtcagcaccttctctctttttttccatcttctctctcttcctcctctctcacattcttcttgttctcattgccatcgcggtgctgcatttggatgcagaggatctcgccctgtgcgacggcgagctgcatctgtagctgtgacacctggttctgcatgaaggagatggccccgacgcagccgtagactgggtcccgcatccggtcgttcgcctcatacaccaggctgctcaccgcgtcgccttgctgccgcgccagcagctcctgcattggaaacacgcatcagacgcaagcatgcatgcacggtggcgtgggcgccgccattgatgacgaccttatacgtgttcgtgcataggccatgcaatgccaatggacatatacacatatatgtatgttgggtaagaagaagtttgatttaatatacctggaggctggagcatcttgctaacattgctgtgttagacttcaggagtcttttattgcttggcttcactattctatttgggatttgggcctgatggccttgtaaggtggctggtgcgtgagtgaaggcccagctgtgagctgtgtactagctggaacctttatatactttgccgaagcgctggtcgtaggcaacgaataagaaaatacaatatcaccaacctcctctccaagtcaattccccactctgttcttgctcagttcctcttttcttcctcccgagttgctcgatccgtgcctagtttggcgtttcgccaagggagatctcactgattcgtgacaaatctggtatcagagcagtggattttagggcagcttggcaaggaagaaggcgaatccaaccttgacggagcgcatggcggcggtggaaggagaggttgaatcgctgacgacgagggtggcggagctcaccacaagcctcaactccatcctgggatccctacaaggtatggagaagtggattccggcggtggatgaaggcatcaaggacctgcgtcaagctgtagaacaagttgcctcgcgggtgaccacgctggaggcaaaggcgccggcgacaactatgccggtgactattccgcccgttgggcacggcgcagctttgaaccaccagggagctgcaactggtaccccagtggaccaggggcgcgccctggtcaagggtaagctgcaatttcacaactcgccagttcattttgatttgggggattgctctgaaaaagggatgggaggattgcagagtcctggaaggtctagtggatctaggttacccaaaactgatttcccaaaatttgatggagacaacccaaagctatggaaaactaatagtgagaagtatttcagtatgtaccaggttccttatgaaacttggtcatcctttgccacactccactttgtagggaatgcagcgttatggttacaaacctatgaggagttgcactgtgtagagagctggccagaattgtgtgtagtagtgcatgggaagtttggtaaggacaagtaccaacaacatttagaggagttagaagggttgagtcaagttgggggagttgatgagtattatactaaatttgaggagttgatgcatagggtcttagtttacaacaagagatatgatgagacattttttgttactagattcatggggggtttaaaaactgagatcaaaacaactataaagttacacaaaccaagaacggttgatctgacattatctttggcaaaaacgcaggaggaattattgctggagagtagcaggaagaactactccaaagaaggatacaaggatgcttacaagccggtgattaaacctgtttatcaaggcaaagggattctgggagcatcaccagaggaggctaagaagcctgaggagaaacccaagtgggaggaaagatttgacacactgaaggcagcaaggagagctaggggagagtgcttcaagtgtggagaaaagtatggcctagggcacaagtgtcctaagtctgtacaattacatgttttggaagaattgcttgaagtgctccaattgcaggaggatggttcccaaggtgatgatgaagaagaacataaaagtgatgaagagctagttttgtctgagtttgctgtggctggaaccatgggaaggaagacgattcgatttcatgggatgatacagaaacaacaactgctgatactgctagattcaggtagttccagcaactttttagcagagaatgtggtgaacaagttgggacttcagtgtgaaactgtgccagcaactcaggtgaccattgctgatggtgggaaaatgcagtgcaatcagcttgtatctggtgtggaatggtggtgtcaggggcatactttcaccattgattttaaggtactgaatttggggggatatgacatgattctgggtatggaatggttagaatcattcagtcccatgtggatagattggagaaggaagaggatcagattcacatatatgggagatagggtgtcactaaatggagttaaaccaaacctctcccagaccacaatgctatctgttaagcagttgaagggcttgcataaagatggggcaatatcacagatggtgcaactttgtgcaatagaggaagttcctgatattaagcaagagttaccagcagcagttgagcttgtagtgaaggagtttcaagataggttcaagaaaccaactgagctgcctccacaccgccagtttcaccatcacataccactgcttccaacagctaaatcggttactaagaaaccttataggtatgcccctcagcagaaggatgagatagaacaacaagttgtacagatgctacagcagggaattattcaggccagttctagtccttttgcttcccaatgttgctggtaaagaagaagaatggctcttggaggttttgtgtggattatagggggctcaatgacataacagtaaagaataaatatccaatgccagtggttgatgagttgctagatgaactagcaggggctaaatggttcactaaactggatctaaggtcaggataccatcagataaggttggctgaacaagatgaacataagactgccttcaggactcatcaaggtctatatgagttcagggtgatgccatttgggcttacaaatgcaccagcaacctttcaggggttaatgaacaccatattcactgctgccatcagaaagtttgtgctagtatttgtggatgacattctaatctatagcaggactctctctgaacatgtggagcatttgagatgggtgttcactctgctaagacagcatcaactctttatgaaggcaagtaaatgctcttttgcacaacaggaattggagtatctgggccacataattggggtcagaggtgtggctactgatccttagaaactgaaggctgtacaaatgtggcaagttcctaagaatttgaaacaactcaggggattccttggtctggcagggtattatagaaagttcattcaaggttatggcctgatgacaaaacctcttacaaatctgcttaaaaaagaagtcaagtttgtttgggaggaaacccatcagcaagcatttgagtctgtcaagaaggctttaaccacagctccagttctagcacttccagatttctctcaggaatttgtggtggaaattgatgctagtgacaaggggataggggcagtgcttatgcagcaaggtcatccattggctttcattagtaaagcattgggggtcaaagcgcaagccatgtcaacttatgaaaaggaatgtttggcaatattgttggcagtcaataaatggagaccatatttactgcactctgcatttgtgattcaaactgatcacaaaagcctaacacatctgggagagcagcagttgaacacatcaatgcagcataaagcttttgtcaaattaatgggcttgcagtacaagattcgatacaaaaaaggggtagataatcaggtggcagatgctctttccaggaaagttgaggatgaagaggtgctggtcatgtctattagttcaccaaaatggatggagattgtaactgaaggttatgagtgtcggtgacatgggatcaggagtatcatgactagaggtttgaggcagacacaatcgcccacgtggcctggcaccctcgggggacgtcgggcccgagggtaatgtgttcgccctcctcttagtccccccgagggggtcggaccgcacccgcctcagccccgagggccgaggcgccctgacccctcgtggattttttgctctgtgtgtatgggttaggtgagcacagcggggctcacctaaccacatttattgcggtttggctgagcgtgtcacgctgcatgtaacgcagtgcagtgcactcatttatccggtctgtgaccagtcacagaccggtcagatcgcgggttaggtggcgacaggcgatctgacgcacgcctcgccccatcccgtcaggacgagggcttctaggcgcttgtccccagctggagctagcgtgttacctcccagagatggcacgttagccctggtcagatatatgccaggcttcatcctaaccattacaggcaagatgttgtgtgaagaaggacgaacatatagattgctaagctgacacgtggtggacaagaatgaccgacgtgactggtctgacaccggtcatgtcgtcagtagacagccacgattccacgtcgcatctgctcccggcgaaagtggaggtagttgtggaccgtcccatcagaaggtgactcggatggcaactatacaaatctccgtccatttatgaaaagggtgcatgtggtatccccttaagataaaaaaggaggaccttgcccacttagagggaggaggagacttttccagattgggaacctagaacgagggagaggctggctcatactttgtagttccttcatacacaaatccaccaaaacacaggagtagggtattacgcttctgagcggcccgaacctgtatacatcgccggcgtcttgtgtgcttcctgtctcgcgaaccttccacagattgggagcttagagtctcacccagagtccccggccgaaccggcaaaggggggccagcgcggtctcccggtgaggagccccacgctccgtcatctggcgcgccaggtagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggcctcgcgcccggccgtacagcaagacggtgctcaatcacctccctggggaccccgggcatatccgccggtctccatgcgaagacgtcagcgtttgcccgtaggaaagagacgagcgcgtcttcctatttgccgtccagaagaccaccgatccgtgtggtctttgacgggccgtcgcccagggcaacctccttgaccgggacctcattgcacgtgactatccgctgcctcggggcggcgggggtggatgtgccaagcctctcgccgccaccctcgggcttggacacgacggcgaggcggtccgcgcgctgctccatacaagcgagcgcgactttgaggtcgccatggacagagatggggccaccggggcccggcatcttcatctgtaggtaggcgtagtggaccgccgccatgaacttcaccaacgcgggcctcctcaggaccgcgttgtagggcagactgaggtctgccacatcgaagttcacccgctccgtgcggaagttggcgggtccaccgaaggtgaccgggagatcgatgtgacctaacggccacgtgtgccctggcgtcacaccgataatcggctgggatggccggagcatcatccccggggccttgatagcgtcaaaggctgcgggggaaaggatgttgagggccgctcctccatcaatgaggacacgccccagcttcacgttgcaaacagtgggggaaaccaccattgcgatctgtcctccccgggcaacgcatggtgggtggtcggtctggtcgaaggtgagggcaacctccgaccatcgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggccatcatcgccgtcatcgatgtcctcggcgggggccttctgcttggcctcacttcgccgattgccggaaggaaccgccggggacttgccctctcggcgctcctgcctcctctcctcctcccacttcctcgttcgctcagccaaacttttgaccgcacggcagtccacgaggtcgtggagggaggtgttgtggacggtgcaccacttgccggctgggcgctccctgctgggagcgccggcctttttctttttgtcgctcgcaggcctccccttttgggtggcccgcgaagcgccctcgacggcgaggacatgaccctcgtcatcggaatggactgacctcttcttcctcctcctgtcacgccgccctgtctgagcggcggatccaggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcatgccccccctgaacgcgtagattaccgcgtgtgcagggatgcatggtatggtgttgcggacttgacagaaccgctgaatgtattagcgaagtgactcatcatcccttcgctgtactgcgtgtaagtccgcttcttcacctgggcgcggatatgtgccctgaaagttcatggtgaactgttggcacaaatcctcccaggagtggactgacgtgggtggcaagttcattagccaaccccgcgcctgcccctttagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgtcgatcattacgccgccgctcgatgctggtgcgggcgtccggccccccacgcagatcttcccgggttgaaggagtcgacgaaggagtggtggccgaatggcgaacggcagctgccgctcgccgcgcccttcgtcttgacgacgcggagccggtggtagcagcaccagaggccttggtggcggaggaccgcccaccagcatctagacgctgccttgcagtcatgaccaatttggccacatcgtccagccaacgttgggctggagactccgggtcatgggcgacgggcgggtgacgtaggagcgcgcccgcagcttggagcgcgccctggggcgtgctgccgtcaccgtagacgaggaggcgacgctccccatctcgccgtttttctccatcgcccgcaatcggtgaagtcgcggatctttcgaccctctcgagtgcctccccccgcttaggactttggcgtggagggggcggtggagtacgagctcgacggcgtgggttcggctccccgtcgtcaccactcggcagggcggctgttccccgggcccctgtcgcgggacccagaagcacgaccccctcccggggtagattgttccccctgcggctcccgcctgcgccgtcgtggccctttggagctcgctcctctgaggccccgaccgccatcataatggtcaggatggagacgcggtctggatcgctgcagagggggaggattccttggggaatgagggacgcctccacggagttgagattcagcacccgttggaccaatatcttgaagtcctcaggagcccagtcccatctcactccctggtgggtcctcatgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcaaggggggtgtagaaccagtcgctcttccagtcgtcccacttcttgcggagggcgcaggggatgtagcgattcagcaccggctcccgtggctggaagtagcagccaccaactaccgatggcggcgacaccgactgtacggtgaagaaccaccggaacagccgaagagatgggcgcaccccaatgaacatctcgcacagatgcgcgaagatggccaaagtcatcaccgcattgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagatcccggcatgaaacggcgcgccagcccagcctgcctctcgctcacaatgcgggaaggcggcagcacgctaccatcgagcagagcggagccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccagcgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcatgcgtgcgttaattacgctcgccgaccgaagcgacgttaccatatctccagacgaaatgaatcgccatgtccagattcgtgtgctactcgagtaatgtggcagtctcgaagagaccgctcattattgacagccgagttaccactgccgatgtgcgtgatttgtgaccgttgggtttctgcccaattgaggagaccggtcccgcctgtcaccgggccttaggagtggcgtcacgcccaaccgcttcccttaaagagggcgatcgccctggcataacgccgggggctactgtcggtgacatgggatcaggagtatcatgactagaggtttgaggcagacacaatcgcccacgtggcctggcaccctcgggggacgtcgggcccgagggtaatgtgttcgccctcctcttagtccccccgagggggtcggaccgcacccgcctcagccccgagggtcgaggcgccctgacccctcgtggattttttgctctgtgtgtatgggttaggtgagcacagcggggctcacctaaccacatttattgcggtttggctgagcgtgtcacgctgcatgtaacgcagtgcagtgcactcatttatccggtctgtgaccagtcacagaccggtcagatcgcgggttaggtggcgacaggcgatctgacgcacgcctcgccccatcccgtcaggacgagggcttctaggcgcttgtccccagctggagctagcgtgttacctcccagagatggcacgttagccctggtcagatatatgccaggcttcatcctaaccattacaggcaagatgttgtgtgaagaaggacgaacatatagattgctaagctgacacgtggtggacaagaatgaccgacatgactggtctgacaccggtcatgtcgtcagcagacagccacgattccacgtcgcatctgctcccggcgaaagtggaggtagttgtggaccgtcccatcagaaggtgactcggacggcaactatacaaatctccgtccatttatgaaaagggtgcatgtggtatccccttaagataaaaaaggaggatcttccccacttagagggaggaggagacttttccagattgggaacctagaacgagggagaggctggctcatactttgtagttccttcatacacaaatccaccaaaacacaggagtagggtattacgcttctgagcggcccgaacctgtatacatcgccggcgtcttgtgtgcttcctgtctcgcgaaccttccacagattgggagcttagagtctcacccagagtccccggccgaaccggcaaaggggggccagcgcggtctcccggtgaggagccccacgctccgtcaatgagcatgatccaaaaactaaacagctcttggaaattctgccccttcagcctaaaggatgtgaccacttccagttggttaatggggtaattcgatacaaaggaagaatatggcttgggcatcataaggaagcacaacaggcagttttgcttgcattacacaacagtggggttggtgggcattctggtgttacagctacctatcagagaatcaaaaatctgtttgcatggacagggttgcaaaaggatgtgcagcaatatgttgctcagtgtactacttgtcagcaggccaaagttgaacactgcaagtctccaggtctgttgcaaccattgccagtccctatgcaagcttggatgactgtcagtatggacttcatagagggactgcctaagtcaggcaaatatgacacaatcatggtagtcgtggacaaattttccaagtttgctaaatttatccctcttgcacacccttttactgcttatacagttgcttaggcatttatccagcaggtgtatgatgtctttgggatgcctcaggttatcatttctgtcagagacaggatttttactagtgctttctagcaggagctgttcaaactagcggatgtcaaacttaacatgagctcttcttaccatccacaaaccgatggacaaactgagcgcttaaccagtgtttggaaggtttcctcagatgcacagttcactttgctccatctaaatggtccagttggctgtcccaggctcaacactggtataacacctcctaccacaatgtgctgaataaatctccatatgaggtcttgtttgccagaaagcctacacattttggccttgtggatgtgggtgcaagtacagtgccggatgtgcagctttggctccaagagagagctcatatgaatgaacttttacatcaacaattactaagggctcaacagaggatgaaaagtcaggctgataagaagcgttctgagaggcaatttgctgttggagatcgagtttatctgaaattgcaaccatttgtacagatgtctgttgcccgaagatcttgtcagaaactgagctttcggtattttggaccgtatacagtgttggaaagggttggcgctgttgcttaccgcttggatttacctgctactagtcagatacatccggtggtgcatgtttccttactcaaggcggcaatcaaaccaggcacccaggtcagttctgatctccctctcaactattctgacgaacaatctaccattcagcctgaagcggttcttcgtcgaagtctgattaaacgtggcaagagtgttgttccctgtgggctgatcaagtggattggcatgcctgaggagctggctacttgggagaacctgcgccaactccggacacgttttcctgatgctactgcttggggtcaagcaggttcttaaggggaagggaattgttagactccaggagtcttttattgcttggcttcactattctatttgggatttgggcctgatggccttgtaaggtggctggtgcgtgagtgaaggcctagttgtgagctgtgtactagctggaacctttatatactttgccgaagcgctggtcgtaggcaacgaataagaaaatacaatatcaccaacctcctctccaagtcaattctccactctgttcttactcagttcctcttttcttcctcccgaattgctcgatccgtgcccagtttggcgtttcgccaagggagatctcactgattcgtgacatgctggcgccgaagaccttgtggactatggtgaacttgtggggttcgtcggccgggaagaagggcgcaaagatgcaatccttggtgcaccgccgccgcagcagcttgcacgacgcgcacggcgacccactgcacatcgtcccaatcctctctatctaatgttcacacacgtataaaacgcttatacgaatgacagtggcggtcagtgacgggccacgtggcggcggcggcggcaacgacaacgtgggagaaggagacgcgcctctgctgtggggatcggctccgacggcggattgctacctctccgcccgctgccgcgctgctccgcccctttggcttcgagcgccgtcgctccacccgccgccacccaatccgcccctttggcttcgcgcgtcgttgctccgccctgctggctttcgccagcctgcgccgtcgccccgccggctttgggcgcatcgccattccgcccgccgtcgccccacttcgccttcctacgccatcaccccactccacccgccgccaccctgccacccccgcttgcttcgcgtgcgtcgccgctccgcccgccgtcgccccgcttcgcctgcctgcgcgccatcagcccgctccgtcgttgctcgcctgctccgccgttcccctcatcgcccaacgctgcggggccgcttcgccgccggtggtgacacaacaccattcgtgaccggccgccgccctcgccttctctcgcgtcgcagccgccgcctcctcctttctcgcctcgccccggcggcctcctccccagcagcgccgctggcttgccagagaagagaagagaagagtgagagagagaggaggaggaagggagaggagaatgaagagggagggtgctgatgtggcatcttgacaatgtggggctgttaacaaccaaatttggtaacatctatgtcaggaaagaagattggatcaaagcaaagttggaggcggagatcgagttcggaaacagagcaggaatcggctgaagtccaaatcggctacgattaggatcagctgggtctgagtcgggttgagtaagccgatacagccgattccgacaatacgaatcgtacgcgacatcgggttcaagttaatgtatttcaagatgattgccacgcacgaatagagtcctgggaaggcaattgtatctattaattagaatattttatgtaaattccttatagataaatgtcggtgacatggggccgggggtatcgtgactagaggcttgggtagccgcggtcacccacatggcctgaccccctcggggggggggggtcgggcccgagggtgacgtggccacccctccctctgtctccccgaggggtcgggccgctcccgtttcggccccgagggctagggcgcccccgtttcggccccgagggctggggcgccccgaccccctgtggttttggcgccacgtgtgtgggttaggtgagcacagcggggctcacctaaccgcatttatagcgggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcgaaatgatgagagcttcctggctctcgtccctagccggagccggcgtgctaactcttggagttggtatgtcagtcccggtcagatccattccaggcttcagcgcaagcatggcaaggaagtcgctggccattgaatgaaggttgaaatgggcgtccaccgggaaagctggcgagcggggcaggaggcgtgtgctctgcttgtcagaggtcacttccggctgtagactagccctcattgtaaaaagcatgtttcctttcttaggcagctggaggcccatgtggtgacccctgaccagataaaaaggaggcccaggcctaggagagggagaggagggagaaaaaaacaggagaaaaagaggaagaggggttgggactctggcgaatgggggctagagcctgaactctctctcgctctccggctctctgtattccttcacgcacagatccaccagaacacaggagtagggtgttacgcttctcagcggcccaaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcaataaatataggcaaaagtctgccgcaaagacttgtggtatcttagagtttgatagagataatagtcgtgtccggtatgggcatatcttgtaattctcaggtataaatagaccccgagccttatgtaattaacaacacacgttcaatacaatcttggcgcatcgccacccttttgctttagttttgtttcgacgagttcttgctttcgggttgagctgcattggtttcgatcttcaacaagaggtaaaactcgttatgacggattatgtttttacgattagtgcttccatctttatgatactctaatcttatttatataattcgtcgagttatcatatatcttatataatctctagcaatatcgccacctaatctactatcggctaacatctgtacgcagagggcagctgattgggttagatcttgatgttgatctagattataagagatatctaccattctatgaaacttctagcggcttgattgtctagatatcgttattcttttcatacttaatgttgtatcagttgagtttgacctattgagtcgtgcttagaataccgatctatagcctgccttctagttgccgattagaatagcgtcagagtttcagccgatcttatctgatttacttatatttgttctatatgcttcattgacatgttaaatctgccctctatatcaagatattgttgtgtctaagtatattaggctcttgttcagtatattattcttactttaatatcctgatatagagtagtatcggagtattagccgatacatgctagatctatctgatcggctatgctataaacatatatagtcctgttattgatatatatttcgatctaagtgatttatactgtctcggcatgatgaccgatctatcccaatcacttgatttaagtatacatcgatataaggagtatatatcgtgaatatctacagccgatcgagtagatttagttcttctttacttattcatgactgtcgatcgatgcacagatgacatcggcttaaagataaatgatatgtcatcggcatctagccgatcggctatcatttatagatttaaccacggttcctttgcttatatttcttgttgattacaggatcaaatcaactggcacgctaacacatctgaaggcgagctttggatctgcactggagttaagcagatctcctaggccacgtgttttctgtcaacagaggcccacgtgggtctcacgttgactcagccgccacgtgggacaaaaccggggtcaaaaccactgaaggacccaaagtgaatggtttttataaagggggctactatataacggaatcccgttttcgaacgggatgatcccgagtaggtatcaggtgtaatacctatcaggtatcagacgattctacacatgtttcaggtgatacttgcaaagtatcatgtgatacttatcaagtatcatacgatttctaccatgtatcgcgtgatactcgcaaggtatcatgtgatacctatcaggtatcagacgatttctaccacgtattgtgtaatactcgcgaggtatcatgtgatacctgtaagatatcagacgatttctaccacgtatcgcgtgatactcacgaggtatcatgtcagatatcgatgatttctactatgtatcacgcgatacttactaggtatcggatgatacctaccaggtattaggtgattcctactagatataactggacatctcgttggggagaggagcatctcgacgcgcggccggccacctgcagtcgtcccttgtagacggcgacgacggcggcggcagcgatggacgggcgcagcggcgacggcggcagcgggcgcggcggcgacgacggcggcggtgagggacgggcgcggcggcggcggcggcgagggacggcgacggcagcggtgggggcgggcgcggcggcgatggcggcggcgatgggggacgtggacggcggcggcgggggacgggcgcgcgttgatgccttcagccgcgtcgcatggatgagaatcgcatctgtggaggaggagtatcctgctaggggacgggataaccctagcattcccgtttataaattgagggatgccatatatctggttttgtggttggggaacgttttgtaactcgatgacaggttgagggaccttcggtgtactttttccacaactcgcagggcgacagggtctagcagatcaagcgaggccgaggcccaatcgagtttgacgagccggggacgcagaatccaactcctcccggtggaagtcaggttgggctaggctggctagccaagagggcttttataggctcctgggacgcatcgccctgcttcggcagtacggcgtcaacttctccgcggatttgttcgtctctcatctcttccgcacgccgctgctcctctgcctgttcgtccatctccgaattctcttctcctttcgactctctttgattctctctctgataaaaaggtcgttttttctcggtttgttttctcatctacgtggatgttgccgatcacaatcgctcgcggaacaccgctgtgtctagcttcatgcccctgcggtgttcgtcgaattgcccggctgggcatcgatgtgtgaccagcggttcaaatgatcaaattccagtgtcgttttcaggtattgcgctttcactctagaatcacgcgtttatctcagcaatttcttccgttggactgcataaaatctggatgtgatgctcggcagtatcgcgctgttcaggttggtggcatgtcgcgacattgacttgtgcctcgcggcgggttgatttcctctgctgcttggacgcatttaactacaaattgacatgaatagtactaaattagcatggcctttttaatggttgctggactcaactgctcattagctacgtccgttatgaaactttgagtttggtataatcgaacgtggctatttgctgtttcaatggtagttgatgataagatcctcttttttttttctaatatacgagacattaggtaatgcacaggacaaaagctaattggccatataagattgatttgactacttgcttattcgtgatacaattgtgacacaagctgcatacgcttgcagctcttatgtctgagcagtgttataataattaggtgactaggatgacaaagtagccaagcttatccttgttttttttgtatgattcaacccttcaacgatgttaatcttgttgaagcagtaaatcggcagctcttaagaagtgagtgcactgggctctaaaacacttttcaactgaaagactgaaatgcagaactttttaccatatttcctcctgataccactgtggcaaccaactaccatagactactgttttttttaataaaaaaaatgacaccagtcacatgctttttcttgatgccaagccatcaagataccgaaatcaaaagaagcaggtgatctagtcatttttgatcgatgtgcatcttcatttcattggtttgttgacctttcttgataaattattttcagaagagaccttttgcaaaaaaaacaagtgtttgtcatgtatgctgtgattttgcttgaactgagcgggattaattggatggaatcactgaaagtatgttattttttaagttttatggttagatgacaaaaatactatatcactgaaacacttgctcagagagaaatctaattaattacgcgtgtgggtacctcattattgaagaaatcagttgattaaatatgccatgctgactttattctcctgttcatatgaaatagtacagatttggttgcatcatttatggtgacttcctaaaggtatgactccacaggcttagttaaactgagacaattcagttgtgttcacaagggaaattgttgcctcttattattatataaatcaaccagttgcacattactagttggttctttgctcagtttaaatggactctgaataaataagtacaactgattcatgttctgtgaggattactgatcagtcttcctgatatttcagtaaaatgtactgaaagtgtacaagcaggactataccaggtattcggtagaactaattttaactcggtggagtgtacatctccaccagaccaccaccttggttcgagttgtttaatactttgatccaatttgtgtgctttttatctgttttgttaataagaaatgtagttttcctacatgttttaattttcatctttgttccaattatttacttaaaaaatcaataattcaaattattgctgatgttgcttaccaatctccccagtattaattaaaaggtgtgtcatgtaatcacaaaatgaaagggggcttgtctatttgtattcagaggtaaagataaacgacacaggtacacaaatttaaaccacagctgatgccattatgagctgtcgttgaattgttattgcatggttgacaggtttttaagttgctctcttgatgtccagcaggtgaagcaaggtaatttctcaagtgatgccttggacataaacatgtcaagctgtcaactcttcttagttgagaggcagtacctgacatttaactcaagaagaagagaagcaatttgtattagagaactacaaaacctgctgaatttctgggctatggtacattcatgttctcgtaccaaggtttgcagtcactttacttagaacttacctctactaaaatctgcttcacttactagaagaagtcgtttcgctgactggccgaaccgtgcttgtcggggtttgagtggcactattttcttagagatagtaacagctatgcatgaactcatacaattgacgcccccatgtgccgtagtgtattgatgcctgtgcagttggccttcccgtatgtgtgtactcgaactgttaagtggatagtaaaatgcacagcttcagggtaaataggtgtaaaaaatagtgtgtgacagacttgacaatgctagtgctattgtggttacccagcatacttgctagaaaagggtgtgtttagttcacgccaaaattagaagtttggttgaaattaaaacgatgtgatggaaacgttgaaagtttatgtgtgtaggaaagttttgatgtgatggaaaagttggaagtttgaagaaaaaatttgtaactaaacaaggccttaggaaaatggataatcattcgtcatgatcatatacgtcagatttgcaatttttattgtagcttgctgacgcaggatttgccggccagagcagtgaaaggcacctccaggtccggactccagatgagagctacctcgaaagataatgcctatccagcaggcttcgcagaagggtccatgcgaaggaatttccctaatccagacactttaggtaaccggtcacatcaaactcaaaaactacatttgggctgagtttagatccaaactttttcttcaaacgtccaacttatccatcacatcaaaactttcctacacgtacaaacttccaacttttccgtcacatcattccaatttcaaccaaactttcaattttgatatgaactaaacacacccttggtctagtcatatgatgttgtatatctatgtactaatacatgacagtgattgaactagtataagaagtctacaaggcacgtatgttctctgtacttgagcatgtagatgcgcatacatctgaaagaaaacacataataagggagattgagggaggggcttctaaattctcgaaggaacattccgtcgttatttatatatcattcaaatggttgaaaaaaaataaaaaaaattcaaccaaatagattaatatgagatagatcactccacaaatatgcaagttaaaattcaacttctacatgttgaaaaaaaaatagaaaacactatggctagttaacgtgttttcacagtcaaatttgtttttttcgttacaacttgtgaaagttaaatttgaccctacatatttgtggagtgatttatcacatattaatctatcttattaatttttttttaatttttttataatcatttagatgacatgtaaataataagggatatcgccttgagaatttataatagtttcccgggagattgatcagggtgtacattgcttgctcattgggcaaaaccctgtttgaaatttgagaaagagatagagagatgatcacaagggtttgactttgaccagggatagaggaaggcgcaacgctgggagcaaatgaaaattgaccattgaccggccgatcggtatgacgagagattagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctgaaattgatatatgccttgacatttactattttatttcccattgacagattatacagtgacatgccgagcaacaaaccggcctactatttttcttctttccggatggagtcacgatcgctgttgcacggacattttgtctatgacgcggtaagagggagggaaaaaaaacagtacatattatggacgtttgcgttgcagccttgcagttgcgggttagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctgaaattgatatatgccttgacatttactattttatttcccattgacagattatacagtgacatgccgagcaacaaaccggcctactatttttcttctttccggatggagtcacgatcgctgttgcacggacattttgtctatgacgcggtaagagggagggaaaaaaaacagtacatattatggacgtttgcgttgcagccttgcagttgcgggttagttggatcagtaggaaggtcagagagtttctgcaagcagagaatcagatctggggaatggaatggcgcgagcaaggaagcaaccaaccgtccacttccatttataagtcgcggctcgcgagctagcaaaccccccttgctacatcaccaacccccacccttttctccatttcgtggccaactcctccgcagacctgcccttccgtatgggccttcccggccgtcgccaccgcggcgccatggccggccgcgccctcgtcgtgctgctgtggtgcgtgtccgcctccgtgttcctcccctccgcccgcgcgcagaccaccaccttcaccagcgccatcgacggcaagaaggcgaccaccttctccttccccacgttcgacaagtccctgatgcagctcggcgccaacctgaccttctccagcaacgc

SEQ ID NO: 67555 - DNA, 27355 bp, Oryza sativa
tgattacgctttctacgtccattgtacatccaactgcgatcctcttccatccttttttgctgcaaagaaatacaacgaaacaaaaactaagggttgattcatatattgaatttttgggaatgagaaagagagaaaaataaaaatggctactgctcacttacacagtgttctttcaggagaggccacaggctccagtgctccagatggcgatggtggccagcagcgtcgttgcggccgatgagggcgtcctgcggctgcgctccgcgcggaggctcccagcaggagaggggcctgcgactccgacgaaggaggctgacgaccgcgcaggccaagaaaacggggctgacggagggtctccgagaagaaaggtggctgcaatccggacggacggagaaggcagccgacggcgttgaagctggagaaagcagccggtcgcgttgcaggcaggcgccgcgcgcgggagaggaaagaggtgggcggcggcggaatcgattctagggttggctgtgagggagttcgcgcgaaaacaaaattggggaaagcgtgttcggctgatagaacaagctgcagtagagaaacatatggcggggggatttctgacattgtgggccactgtgtcatatttacctgcagtacagaaaaattacatatttctgtttctatcttaactagttctatttctatttcgttactattcattctaatcaactagtttgacttctacagtatttcattattatacattcccctgtgtataataattaatttgtgcctttgtaataatgattagataacatctatgatttatgagaacaactaaaaatgttttttatttgctaaaatatcatttgataagattctctaaatatatttattctaatcaactagtttagatatcatatcattgactaatttcgtttttgttatttagtacttatcaaaacccaaggttaacggtattgggatacgtcattatcgtacgatattatccgggtaaaacgacacgtgtcggttgtagtatcgttttcgggtggtatcgctctagtgtcgggatacgaagcatagaataattagaagcgcacaaaaatcagtatactgatagtttccatcgaaacaatattactatattttgtaggatcctacgagattttttttatttttgaacttatttctaaaatatgaaccttttaaccacgccaatctgcctggcgtcgcaaaacaacattgacacggcttacattgcgattgttacagttcaaaattttaaaaagttaaaaagaaaataaaataattcaattatacaattcaatactactttaggaaaaaaaaacaatactaactagaatctcgatactaacaactttatcaaaacccttttagatttttgcaactataactataataccgcggtgtcaaatttactctattgataacttgatcctcacattgaaaccctatggactctcctaatatttgtaactagcatggtggcccgcgcagattgcgtcgctagcatcattatattttctccgaatttcaactatttctaaattgtatttctatatggactctgtttttctttttctctaattaatatgagaatttctaggccgtgaaagcgaacgttaaggctcttttttctattccttaaataagttaatagatagatgttaaatccaaaatatagatatttataaattactttccactactttccacatttttctatactttctatagccacttggttaattgcaaattcaccgtgttcaatattcacacgtaaccatatttgtaaactatgatcaagtgtcgaattgaaaaccatgtcactgtgatttcagattgagccagtattgtgcagacaagtttgacatggtctcaacaccacatctggctatcaacattttccaaatcaatttacatctttctgagaatcaaattccatgcgcataacataatgaagttcataagcttcattaatactttccatcagcataggttcttccctacaaagtacttaagttaccaccactaaatgtgcatctcaccacagcgcacagcaccgttaggcatacacaaaatatacaacttcatcagctgataacgactacacaaaatatactacctcatcagctggtaccaattagtactgctcaacaaacctacagataattagtgggaacaaccaatgggtaccaacatgagcccatcacaacaaccaggacatacaccagaacaaacaggacttggcacagtcctacttcacagttacatcacaccaaaacacccacaagtttctggtatcacaaaagacttcccaatttctagttctttcggtgaagagcgattttcagatactgcacgcctaaagctgctgcctgctattactggcaccaacatccaggttaacttgcactgggatatttggctcatggaccagtcactcagtggtggtaactggatttccaatagagacttcagatccagatgtagcctgaattagcaatgtttgttagaaaacaaacaacaagtttgtattaatcatacaggacatgtctatcctgcaacattacactcaccggatgagtcaacgtaggtgtgcaaggaggcagaaagtttatgttgagctttctttgcagtacctgcaatttattcagacaatgttttaggttaaaattatcaccagttcaaggcactcacaattaattgattcagcagcaaacaatgcggacagttgtgtaaacaggatactaccagttacctccaaagcacatgtaaaatagcttgttttctcctggaacaactcgtgctcacgtacccgctccacacgtgcctgctctctctcctgctccatctccttgcgtgtccgctccatttcctcaagtgcccgctccctctcctcacgtgcccgctccctctcctgctccctctcctcgcgtgcccgctccctctcctgctccctctcctcacgctcacactgaagttgacgctcaagctcctcaatccgggcactatcatcagggtttggcctcagccgtctgctaggccgtggatcatcaagtgagcacctgcttctcccaacatcagcaagaacatctggtgtcttaaggagtccattaagcaggaagaagcgtccatgtttcttgccaccaccagccatgtgcacagccacaccatcaatgggttcagtccgccaattactgtcttctccgtgcctctcagtaaaagcgcgagcataggcctcctattacagattcaaatgaaaatggcagttaaccaaatggaatgtagacaatagagtagtacaacacaaatttcaatgtgtaaggcacttacgagcaacatattctgagatgaatcttcatcacagtagccctcgtctgggtctaccctattggcatgagcataagccttcaatacatgcactggtgtgcccattttcttctcctacattcaaaataaatagtttaacactattaataatgtgctgctgcaattcaatgaacaccgtacaattaaagtctaaagctatgcaggtcttggtattatgtctaagaaaaactaacgaaccaaattcttgtggtaacgatgaaggttagcactgccttggcgatgggctggcgttttcatctttgccctgcgttcgctacaagcacgggagtaagcctgccattctggattgcaccacctcaaatctgacaataatgcccacgcacgaccagcatttaggaaccaccatggcttagcctataacaaacaaacttgcgcttagtcactaatatgttcaaaagctaagcatctaataacattttcttgttcaagcgagcttactttcatatactccgcctttgtgagataagtcctgcaagcagttggccgatctatatctgttttcagaatcttcttgtgataagtaatcacagctaggatacgagcctcatagaatatatcaacaaagagtttcttgacgcagttgtgcacaactcttctagcctccacttctgtcccctctgcccacctatagaacccctgcaactaccaaaagttaaccaaacaatacatgatctatgtaacttgaaagaaactaagttggtaaagaaatacccagaattcttcctcaacgcgatggaggaggcttggcaagcgtgcttgattagcttttgcattatcaggtttaagcaagtaatgttccggagaccatgcaggctcatctctacccttgaatttcaccacaccagggaaattttcttttatcaatgtagtcaggataccattggggactctagtactctgaccataatcttgtacctcccattgcctgcacaaatcccaaccaaaagctagatattagcttcatacttgaaataacagcaatatatagcacaagcaacacacttacatatcccctattggcctaagcacaggtttatcctcctctcgtgtaggtcgtggtggcacccttgtagggccacaaaaccagaactcatcatcttcctgctcctcttcttgaacaggatcagtaggttgctgagaggaagatgaccttgtcctattcctagatgagatggcagcactagctgaaccatctgcagaactggaggcccctctagagcccgagcttaatcgtcgcatcctcctgcaaaacatttcagcatatttagagaacaaacaatttttgattgcacggctttaggaaaagcccaaacatagaccctttacacgaaaaggtcaaacaaatagaacaaacagatgctcggattgcaagctttctaacagcaggactacagatgtttccctccaccaaactcccaaaagtagacatctaactgaaacccaagcacataaccatcccgacaggatataacaatcatctcttgttacaagaagaaaggcaccaaaaacacatcctttaatagaacatcaggcaggacatccataggcaccaaaacaatctagaattgcaaggctaaataggaacagtatacaactgcaatacttcttcaacttcacaagtattggtaggtcagaattacttcagaaataacagcatgccatcacattaaaatcctaaagctaaaaagactgctagaggacacaagcattttagtctacgatctaaagcaaaacatgagattactgaagcaataatcaagagactatatttcttatttgataaatccagagaacaaagggattaatttctcctttcttatttcttcatcaaacatcaagagactatacaagctagccaacattcgacaatcacataccttgatgttgggcagattgcgtgcaggtgcggagagaagagggcggcgtgcaggtgcggcgagggaagggggcggcgcaggtgcggcgagggaagggggcggcgcaggtgcggcgaggaaggggcggcgcgcaggtgccgcgaggagggagagaaggagaagggcagcagtggcgaggtgtttgggactgtggcggcgtgggctgtgggagccggtggggttttagggttaggatttgttttcctttttcttttttttatccaatcgacatgtgggccatcactcacttcccgtgcgctgaatgaaaaaaaaacacgggaacaccccttctgtttcgcgccagcgaaaaattgggccgcgccaaacggagctaggcgcgcgccaaaagaaatccgttcgcgccaaagagaaaaatactactcgcgccaacagagtttgacgcgcacagacggaaagtaggtggattccggtgttcccgtgagtcatctctaacacacggtaagcgcttgatggttcccgagtttattgttctactcacggtaagttaccgtgtgttcagagaaacacccggtaatattcgcatgcacacgggagccttcccatctccagtagtgcgccattatcgcatgcatgcgccatgcaccacgcacaggatagagttaggttgtttcacagcccctcctgaaggaactgacagtgactttgtaaacccattagcaacttgatctcctgaaggaacaaaatcaatctctaaaagcttatgtgacactcgttctcttacaaaatgataatcaacctctatatgctttgtccttgcatgaaacacaggattagctgataaatatttggctcctaagttatcaccaaatcttgacagctttaggagactcaattcccaattctcttaacaaggtttgtacccacattaactcagctgtagtattcgccacagccttatattctgcctcagtgctcgaccttgacacagtggattgtttcctagcactccaggacacaagattagaccccacaaatatagcaaatcctcctgttgattttctgtcatctatactacctgcccagtctgcattagaatatccatgaacaagagtagacgcactcttatgtatattaagtcctagacttgtgcactgattcaagtatctgagaattctttttactcctgtccaatgacgggtagtaggagcatgaagaaactgacaaactttatttactgaataagctatgtcaggtctagtcaaggtcaagtattgtaaagcaccaactatacttctatattgtgttgcatcattaggtcccaagggtgatccttcatataaagttaatttttcactgacagagagaggagtactaactggcttgcagtttgacatattaactctttttaataaatcattagcatacttctcttgagtcaaaataataccattggaaactttagttacctcaattccaaggaagtaatgcaggtcacccaaatccttaagtgcaaactccttgtttaaatccttcagaagtgctgtagttgccttctctgtagaactagctacaattatatcatcaacataaaccaatacaaacataattatccctcctttgttaagaaagaataatgaagtatcggcctttgaagcttcaaaaccaagttcaacaagtttcttactcagcctggaataccatgcccttgttgcttgttttaaaccatacaatgctttatccaatttacatacataattaggtttagaggatgactcaaaaccaggaggttgttgcatatagacttcttcttgtaagaatccatgaagaaagacattttgaacatctagctgtctaagactccaacctctagaaatagcaatagacaggatgattctaatagtagcagctttaacaacagaactaaaggtatcctcatagtcaataccatatctttgtttaaagccctttgctacaagtctagctttgtatctgtcaagtgttccatctgcctttcttttaatcttatatacccatttacacccaataatattttgtcctttctcatacggaactaggtgccatgtattattttttatcaaagcatcatactcagcttgcattgcagctatccagtttttatctcctagagcctctctattattttgtggcctctctatcattttgtggttcacgagtagtgtggagattatggatatctcatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacagttggcgcgccaggtaggggggcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggagtcagaccagtcgggagagaaccggatttcagtcccgtttggactcccaaacgcggctgaaagttacttcaagaccatctcaatcgagttggcttcaaaccactcgggcgagatcgcatcttctccaatgtcaccagatcaagatgatgaggcttacccaccgatcctgatgaagctccccgacgatttggcggccgtctccatcacgacagcgtctccatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgtcccaccgacatcgtagagtacgacgagtttagctctcgctacaacgacccggatctcgacgacttcgacggaagcctagatgacaactacacccctctctacttcggcgtcttcatggccgataacgagacggaggagcaacgccaagcccgggaaaccgaagcacgtcgcgagactgagcgtcgccgactggaggaggagcgtcaagcacaagaacaagaacggctacggcgtgagcagcaggagcgtgagcgaaccgcgaaggaggctgaggaccgacggcagcgagccttggaagcagggcgccgagcgcgtgatttcaacggccaacaagatgttgaagggacaccggttttccgcacccctcaacagaatgcggttgccgcgatcaccctcctcgacaccctcctcaaggaaaacgagctcaatcaatctgatcacgtcgtcaacatcttgaaccagacaaagaccatgattgcggcttcggtcccagttaactccgaaagcgtccgcacgccgactggcagccgactcccccacttccgatctcatgactaccgtcatccaagcctcagcatcactggcgcaggatccaatcgcaggagcaggggtcacgacgagcggtccgttcattcgcctcccgaccatcatagggagcgccgagtggaacggcctcgctcaccacctcgtcgccgccccgtcgatcttcgcgacacaatcatacagcgccgagcagctcgaggccatcatcattcgccggaccgccacgacgacgaccttgatggagtagcagccttcaccgacgacctgcgtcgagtggattggccagccggcttcaagccgactggaatagagaagtacgacggtaccaccaacccagaatcgtggcttaccgtctacggtctcgcgatccgcgcagcaggaggagatagcaaggccatggcgaactatttaccagtggctttagcggattccgcccgatcttggctccatggattgccccgtggtacgattggatcttgggccgaattacgcgaccacttcatcgccaacttccaaggcaccttcgagcgtcccggcacacaattcgacctctacaacgttgttcagaagtccggagaatcccttcgagattacatccggcgattttctgaacaacgtaacaagatctccgacatcaccgacgacgttatcatcgccgcattcaccaaagggattcgccacgaagaattggtcggcaagttcgggcgtaaacctcccaggacagtcaaacttatgtttgaaaaagtcaacgagtacgccaaagccgaagacgccgtcaccgcatcaaagcagtcgggtcccagttggaagccaaaaaaggatacgccggctacgggaggaggtggaagtaacaatcataaggaccgcaagcgtaagcctgaggaacttgttgcaaccgccattcactcttctcgacagcgttcgcgcgtcaacacgttcgacaagatcatgaactcccaatgcccgcaccatcctaactccaaccacgtggccaaagattgtttcgtctacaagcaattcgcggagcaatacaccaagactacacggaagaactccgacgaagaacaaagcacgtcgaggaagaaggacgacggcgacaccccggtaggatttcaagaccaccgcaaggagctcaaccatatcttcggcggccccctggcttatgagtctaaaaggaagcaaaagttgaccgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggaggcagtgcactcaatatcctcttcgccaagaccttggatgatatgcagattcctcgctccaagctaaaaccaagcaatgcgccttttcacggagtaattccaggattatccgcaactccactcggccagatcaccctcccggtcacttttggcactcgggaaaacttccgcacagagaatatcagctttgaagtcaccgattttgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagacttcaaaaagtggagaaagcgaagccaagactaagaagattcccctagatccttctaatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcggcaggcttcatcaaagaagtccatcatcccgactggctggcaaacccggttctagttcggaagaaaacggggcaatggcgcatgtgtgttgattatactgacctcaacaagtcttgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggagcatactgctatgtcaccatgccgttcggactaaaaaacgcaggagcaacttatcaacgtatgatccagagatgcttctcaacgcagatcggccgcaacgttgaagcctatgtggatgatgtagtcgtcaagaccaaacaaaaggatgatttaatctcggatctagaagaaaccttcgcgagcatccgcgctttcaggatgaaattaaaccctgaaaagtgcaccttcggagtaccgtcagggaagctgcttggttttatggtgtctcacaggggtatccaagccaacccggagaaagttactgctatcctcaacatgaaaccgccaagtacccagaaagatgttcagaagctgactggatgcatggcggcgctcagccgatttgtttcgagacttggcgagcgggggatgcccttctttaagctactgaagaaaacagatgatttccaatggggacccgaagcacagaaggccttcgaagattttaagaaactcctcaccgagccaccggtcttagcctcaccacacccgcaggagccgttgttgctgtatgtatcagccacctcccaggttgtgagcacagtcttggtcgttgagcgtgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcataaccgcggagcaaacggacggattgctaagtgggctttggagttgatgtctttggacatatcattcaagccccgaatttcaatcaagtcccaagcgttagctgattttgtcaccgaatagaccgagtgccaggaggatacccccgcggagaagatggagcactggaccatgcattttgacggatcaaaaagactttcgggcactggagcaggagtggttctaatttccccaactggagaaagattaagctatgtgctttggatacatttttcggcgtcccacaacgtcgccgagtatgaggcgctccttcatggactgcgaattgcgatctccctagggataaagcgtctaatagttcgaggcgattcacagctggtcgtcaaccaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggtggcgccctccgatgttttcgtcgaacacctttatacgccgacagtacctcacaaagatactactcaagttgcgggcactcatgacgtagctatggtttcagccgactggcgagagcccctcatacgattcttgacttctcaagaactcccccaagacaaagatgaagccgagcggatttcaagacgaagcaaactttatgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctactgcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacagcagataacgctcgagacttcttcatcaacattgtgcatagatttggagtgcccaatcggatcatcactgataatgacagataattcactggcggagtttttaaagacttttgtgaagactttggaattaagatttgctatgcctcagtggcacatcccatgagcaatggacaggtggagtgagccaatggcatgatacttcaagggattaaagcgcgagtttttgaccggctaaaaccctatgccggcaaatgggtggaacagctaccatcagtactttggtctttgcgtactacacccagtcggaccacaggccagtcaccttttttccttgtctatggggcagaagcaatgttgccgagtgaagttgaattcgagtctttgcgctttcgtaatttccgcgaagaacgctacgaggaggaccgagtggatgacttgcaccgactggaagaagtccgcgaagcagctttgattcagtcggctcgatacttacaagggttgcgacgttattataatcgcaatgttcgatcccgtgcctttctagtcggcgacctcgttttgaggaaaattcaaactacacgagatcggcacaagttatctcctctatgggaagggccatttatcatctctgcagtcacccggccaggttcctatcgactcaagcgcgaagacggtacactcgtcgacaactcttggaacatcgaacatcttcgtcgtttctacgcttaagcttatcactgtacttccctatcttgactgtcaacatcaagttttcttcttgaagttgtcagtcgggggctatcatcataataacggagtgtgattttttatcaattcaatttgcttccttggtctatcattgccttgtttgatttttctacttagtctgcgaggactgaaagtttttaatagcttctttgggttttaggctcaacaaagcttgataaaagcttttaagaaatcaaagacttggctagaattatcaagcacagcataaatacaccagtattgtacaagttatgcctccatttgctacatttatgctcagtcagaatcagtcctttcatcatcagagttattactactcggctgaaggtcggtgttgcggaattgatctacgacgtcacttgcaatcttgtcagccgcattttgagcattgctgataagatcaagagcagcctctacgcttgtcccgtctgcaaagccatcaatggcgtcaatttcaatcctcgggtacaaggatttggtcatcgccaatgccgtgctagctcccatacttccagctttcttgatattcttgaaatatacatccggagcaactctcagcttgtcgaagatttcggttgcgtcgagtgcactcggaccactgttattgaggaacatagcttggacgagtggtgtagcgacattagcgacttcatctcttgctccttcaagcctcttgatcttaccaaccaggacgtcaaattgagcttgagatttgattttgcggtctacaaaacacatttatgataaaaatctactgcattaaaaagagagaagttcagattgtcagctggcagtaccttcaacctccttcaaggccgagtccctttgcgcagccagttctaccttgtctctttccagggcttcaatttgtttctccatttgagccatcctggcggcttgcgctgtttgaaatccaaatggttgaggatacagttacgacagcgtaaattaatgggacagatctagagattaccttttgatgaaccactcagctcgaagtttgaatcctggagctgagcaattcggtcccttaattccttctctgtctttttggcgagctccttggcctcgtgtagctggtccctaactgcttcaagagttcccaaatgaggaaccagcttttctaaagttgcggtcttggcctcattgcgaagatggattctctgcatgatggttcatggtttagttttgctgaagagaaaacaaagtcatcaaaggcagtcacccggaagatttacattcacaatgcgagtggcttctccaagtgccttcttcaactggcacacttcctcatcttctttttgacgatttatgacgatgccggcagcttgtgagttctcgtcccaccatttgagcaagataggaggacgagagtcatcagctgcctttatgcgaggaatttcttcttcgtcatcgcctggtggtcctgatgtatttccaagatattagacgaataagctgaagttatttaaatcggcatcacttgagaagatgagttacttgaggatgttcctagctgagcgtggggtgatccttgttctttatctggagacccaatcatcgagtcgttaccagcctctggtccttgagaagttgttgtctgcgcttcaacttcgggagtttcttgatctggacctacatccgactggtttccagtcgggggctcttgggttgttgtagtttcagttgctgccgactggtttccagtcggaggctggtcactcggattggccttatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaaaaggtttatacctggaagatgttctaatctttggccttggacgactagccagttttttcctgggagtggtatgctttgggagtttattgggcgagcctttgtccccagatttgttgccgtcgtcgcctttgtcgtcattaagcaccagctttctcttgcgagaacctgtctgcccagtcggattggaggtttgaggttgcggatctgatctgattgtcggccctccacctccctgaacggtgtgctggcgaggagaccggcgctgagtgattggggggtcagacttcatcaatacatattcctgaatgagatgcctccacggttagttaactcaacatgaagacaagattatgttttggtcatgggttgaagatttcggatacgtacctgcggaggcggattgaatgcgttatatggcacaactggcagctgatgtgagtagctgacgacaatagcatttgagaagattttacacattctctccttcatgattttaaaatccagagaatctggttcttcacgattaggatcatgcttgccgtcaaactcgaatgccgtacgggatctttctttaattggtgccaatcggcatttgatgaagtgtcgagtaatctgctctccttgtaagccttgttctttgagttttagcatgcgatccatcagctccaaggcttgggctgcttcatccccaatcggaagagagttccaggcatcttggtacaccggaggaagacaagagtactcgggaagagcaggctcaggattctgaatataaaaccagtttgcatgccaccctttgtttgaggtcttgaagggcatagagaagtacttctggctcagagtccccctcagctgaaatccggcccctccgactacacatggcttactcttgtttggttggggcttgagaaagaagattcggcgaaacagagcgaagtggggcttaattcccaagaaggcttcacaaacatggacgaaattggcgatgtgaactatggaatttgggtttaggtgatgcaagctgattccatagaagcttaatatcccgcggaaaaattttgaggtcggaagagcgaagccgccatagaagaaatgggagaagaccacagcctcgtgtatatcgggggtcggaaaagcctcaccgcacgctggccgccacccgatgatttccttggcagggagaacgccgtgcgccaccatctccttcaggttctcctccgtcacgtcggatggcgcccattggccttcaaagctttccttctcttccgccattgattttttccgaatgcgctgatttgattcgagggatggctagggagaggtgagggattgaggcggtggatcacgggaaggattttgatgaacttttcgaaggtggattcgagtggaatggtgaaccctagtttgccggcgtagctctgtactgtagcagggagtggggaaaatggcgagagttccggcggggaagatgaagtgtcgcttggatctcgggatttcttgttaagggtatcggaggtgcgaatgggcttaggcctgaacagtacctcagcccagtacttttaacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttggaatgacttgtttttaccatagtcatttccttggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagagtgttaaccactcggattccttttaattatggctaaaaagcagtcggctaagaatgcttctttaggcgccgtgtatgcttttgtcatatgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacaagtagaattaaaacaaccatatttaacagttcgatcaatatatatcttttcttttctaataccactcagcaggcgagtgtgtggtctcggtgcacgggctgctgtagctgtcacatcaggctgcaccggctgggaatctgcactgctagcttcgccacttgctgctgcgccatttgcttcggcatctcccagactgacactgtcccctccagcgccagaggctgcagcagaggctgcgccactgctgtcagcgtcctggtcaggcacagtgctgctgtcctgtagcgtcgattccagtgccgcctccccatgcacgatgttgccatgcacgtccccatgcatggtattctccatttcctgctcatgtgttgtaccattttctccagaaacaacatcatcagcatcagacacaattaaattattactaggtaatggaatattagccactggtgtaactacatgtgtgccccctggactagtcgtattataatttgtcatggaggaaggcaatagaagaatttcagacctaagtcttgctcctgcatttgagtgaagagtagaaaagggaaatatattttcatcaaagataacatctcttaagatgtagacatggcctgatgacacatcaagacatttaaatcctttgtggtgagtactaaaacctaggaacacgcactgtttggaacggaattggagtttatgtgtgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatgccctctagagggcctcctgcccaccttatatagaatggggggcaggattacaagatagaaaccttatccaatacggtatcggtttcctaactctactttacaatcttatcaaaccaggactttaggccgttccgtaatatacaaggaaacgtaatacccaagtcataatctgttacatattccatacatataagttatcccctataactagtcggataaccatgccgtgtgggtatggggtacccataatctccacagtagcccctgagaccttcacagtcgaaaagataatcttctctcgaaccagattactccaaggccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaaccaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagcttgtatgttgtgaataaagaaatttccaaagtattgggcatacgccatgcgcacactgctttaacagatgtgcttaagtccctagaagacacatggttccaccacacctggaaatatacggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtaaccaatcaattgctttaaaacccaaacagcaccatgactatattaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgttcttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgaagatgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttggaaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagaagaagtcgctccaccatgatgacaaagttgcatcgccgtgatgaagtgaacacgagtcggcagcaacagaagcaaactggtagcgaagacgcgcagttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataacaggccagccgtgcaggcggtgacaccagtcagcggcggatgcggcggccggtcggtgaagacgtagacgcccaacaacggcagcataataagtctgccgtgcaggcggaagcaccaatcggtagcggcgaaggcaagccggtcggtgaagacgtagacgcccaacaacggcggcataataggccagccgtgcaggcggaaacaccagtcggcggcggcaaaggcaagccggtcggtgaagacgtaggcgcccaacaacggcggcataataggccagccgtgcaggcgaggacaccagtcggcggcagcgaaggcaagccggtcggtgaagacgtaggcgcccaacaacggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcgacgaaggcgagccggtcggtgaagacgtaggcgcccaacaacggcggcataataggccagccgtgcaggcgtggacaccagtcggcggcgacgaaggcgagccggtcggtgaagacgtaggcgcccaacaacggcggcataataggccagctgtgcaggcggaagcaccaatcggcagcggcgaaggcaagccggtcggtgaagacgtagacgcccaacaatggcggcataaaggccagccgtgcaggcggaaacaccaatcggcagcggcgaaggcaagccggtcggtgaagacgtagacgcccaacaacggcggcataaaggccagccgtgcaggcggaaacaccagtcggcggcggcaaaggcgagccggtcggtgaagacgtaggcgcccaacagcggcggcataataggccagccgtgcaggcgaggacaccagtcggcggcgacatatgagtgacatgagttcgtcaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtagccgatgtgggaacgaagcagtccatcaatggtgacaaaaacgccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccatgaacggtggtgtgaccgaccaaccgtataggcggggacaccagtcggcggcgacgaaggccagccggtcggcgaagtcgtagacaccgaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcagcccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgctgagtgtgtattgatctgacgatcaggttgtctcatgccctctagagggcctcctgcccaccttatatagaatggggggcaggattacaagatagaaacattatccaatacggtatcggtttcctaactctactttacaatcttatcaaaccaggactttaggccgttccgtaatatacaaggaaacgtaatacccaagtcataatctgttacatattccatacatataagttatcccctataactagtcggataaccatgccgtgtgggtatggggtacccataatctccacaatgtgtattgtaaggacgaagatgaggccaacaagcacaaccaaacactctcaaggatgagtagtcaggtttttgtttgaacaatttttctagaggtgtagaattttggatgattctactaggcacacgattgatgagataagtggctgcaacaaaggcttcatcccaaaatttaagaggcattgatgcataagataaaagagagagacccacttcaacaatatgccagtgttttctctcagctgacccattcagttgacgagtgtgaggacatgacacatgatgatcaattcctatttttgcaaaaaaaggaattaagtttttgatattctcccccccaatcagtctgcatggcaataatctttctatcaaacattcgttcaactagaacctgaaattctttaaacttctcaaagacttgagacttatattttagcactaaaatcatcaataaaactcacataatatttatttctcccaacagactctggggcagggccccaaacatcagaaaaaacaagttcaaggggaaattgagacacactagtagatctaacataaggtaactgatgactctttgcttcttggcaagcattacacacagactgatcgactgactcaactaagcatgggagattatttttgctaataactttcttaacaataggaagagacggatgtcctagacggctatgccacctggacaaggatagcttgacggtgccaagggcttgtttgctggttgatcagccaaaggagttagggatcaggtagagaccatgcctacatttcccttcaagcaaaatgtccttcgttaccagatcctttatggaaaagaatttcgagtgaagttcaagaaaagcagaattatcagcggctaactgactagcagatataagatttttcttagcttgaggaaaataaagaacattatttagatgaatgttacgactaggggtatgcacaatagtatgaccaatgtgactaatatccatacctgctccgctagccgtgtgaatctgctcgccgccgttgtacttttccttggtggtaagtttctctagctcaccggtaatatgatctgtagcacctgtatcaatataccaatttgtatctataccatatgagttagtagcagcagcggcaagcttttcatctgcgacgtagtcctcgtcgaagcgataccagcagtctgctgcggtatgcccgcgcttgaagcagacctggcaggtggggcacctgtcttggccctggatttttcacattttggtccttttgaaaaacttatttcgcaagtagacccctagaaaaacttatccaaaaaatggtcctttttgaggcgccagagtggctggcgccgtcgttcaacaggacggcgccagcctctttggcgccgtccccctgccgacgtggcggggtgatgctgaggtggctaagggga

SEQ ID NO: 67556 - DNA, 23319 bp, Oryza sativa
aatcaatctagggtttgcctcctactctgtactgcgccgtcgctcgtagactactccatcccgctcgccggcgtgcaccggcgatcgggagagcaggtctccggaacctctgccttcgacgttctgcaccgggagaaggcggcaataaggtttttggaaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacagtaattttacaatatttcataagaactgatttattttatgtaaaatttctcgataccaaagaaaaccttagtagcagtaggtcagtatgcaggtgcagatgtgcagtcgcctatcaacaagtgatgttgctgcaacaagatctcgaaatacccgggaccatgtgctgcaaacttgcattctataccgtctaagaaaagtctttcagtaaaaataagctcttcacggtatatggacgacaagacgagagaaaataatatactctctccatctcataatataattttttttgcgatgtgatatccctgttcgtgatattagtaagtgtcacatcccaccaaaatcttttatactatagaacagagggagtattcattaagaatttattaaacttaactctgtcgaagtgaagggaaagtagcttgttagaagtatggacgttaggtcattttcacccggatttttttttcttctaggtgagaaagttttctttttagaaaaaacctaacattttcttgtgggtgcagggttgaattttcatgcctttctcaatcctcaccgtcgcagcagagaagaatagtcacagagcaatgttcacttgtttagagtcacagagcaatatcgaaatggttccctgcaataatattttagatgagcggccggccggtgagagcgagagtgagaggaaaatgtcaattcagtgtgacaaatacaataaatatataagtgagagatagatagagaagaagaaaattatagcaaattttattgctaatctattactaaatgttagttttaagattgattaatagtagtaaatgagctttaatattatccttgctcttactgatgtaaatactactcctactaactttcacctcctagaaacgagcccacgaaatgacaagtttataacgttgttgtctgcaaccgatgaccaataaggccgtaacacgcactctctttctcttcccttgtcgacacggtcagcacagtaactgtcgcgcttcacttccttgtctggttagcagagcacagctgcacaggagagcatccagtgccgtcaattttgtcaaaagagaaaaaaacagaggtaattaccggacgtccagggtgatctgatgctctaagtaagctaggctaaagtagctttagactttacgcttactcattcctcacatgatttgagtgccactataggcagtagaagagaggagcggagtaaagtagacagtgaaatccacatcggaggtgatgagcatacttaattaccgcaagtcactagctttaactagcccagataactttgcttcaactgctagtggagtagtacacgagtcgcgtagcaacgtatctggcgtaatcctcacttgctccactgctccacacaccattggcctaagcttatgggctgatcaaagtatggaaattagtagcagtgggaagaaatgtgagctcgaatcaagcgtggttatcaggttaagtcgcattcagcgccataattgagctgcctgcccggttggtttggcctggccaatctgaatttactgagtatgcagtacaccagtagtaccctttcaattctttcgcctgtctccatgaatgatctaaacatgaaccctgctctgcaacgccggaatagtgcgcacacggcatggatcaacaggaggagtatttactagcccaagaatgtgaatcaatgcaacgccggaattgcagctgagaaatggagataaaaagatgatttgtcagcgttttctgtttgcatgtagtagtccatcatcgttacaatggtcaacaaaagagggtaattgacccaggacgggatcactggtagaccaggtggtcaaagtatgaagtagggaaagcagcctatgggcctgtttggtatagctctaactcctaaatttagcttcaggagttgggtctggagtggagttgtggagctgcctaaacccagctccacaactctagttcattttgtgagagagctccacccagctccactcccagttttagtggagctgaaactgtttggctgagctccagctccaggaggggtggagctggagctggagctgtgccaaacaggccctatgtttcagtaatccagtctacgacaggttgatccgttgatgtggtacaccatctagccggccatactgagctgccgttgaagtgttgaacgcgatgcagtgctgctgactttgctgcgccgatcagtgcagcctgcagcgacggcatgcagcgtgctaacatacctttcgctttaaactcgtggagtactcttacttcctatccatgagacaagaaaaagccttaggccttctttagatatcactctaaaatttttcatcatatcacatcgaacatttgaacacctgcataaaataataaatataggctaaaaaaataattacacggattacgactaatttatgagacgaatctttgaagcctaattgctaaatgatttgacaatgtggtgctacagtaaatatttgctaataacagattaatcatgcttaataaatttgtctcgtggtttactcaagtattctgtttttttattagtgcctgaacacctcatacgataccctatataatatccgatatgacacgctgaaactttacatcccttatctgaaattggggagaagtttgggaaaagttgttagtctagaaaaaaaagttataagtttatatgtgtaggaaagttttggatgtgatgtgatgtgatgtaatggaaagttgggagtagaggtggatagcgagccagctcggctcggctcggtcgagctcattaagataacgagctggctcggctctgctcgttatcttaacgagctaaaaacctagctcgagctggctcgtttggctcgtgagctaatgccctgaaacactgacccaaacaattttttcaatggatacacagggtaagtgcgtaagtgcaatgaggtgctgaaactggacctataattgaagaactaaagtactgaatataagattaacaacaacaaatcgcgcatttgctctgggatctggttgaggtagctcctgatcctccatggcagccagcggcgcagccacacagccagcagcggaccatggacgtggatgatgagtggcgcggcgtggggcggcgtcgtggaatcatgggcgatgagcggcggcgcgagcgcatgacactcgctgctagagcgctggtgcctagcgcggaggtggattggcggcggcagagcgacggtggattggtggcagcggagcagtggagtgaagaggagagggagatccggagaggcagtggcgcacgggatggtggcgtcgtggtgggttggcggcgccgcacggagtgaagagaagaggaaaggggacgcgagtcgcgaactcgcgatggtgggtggcgcggagcgaacaggaagaggagggcgagactcatgtggtggtaggtcagctagggttgtccttatatgatgggccattcgtctatgggctttgtggcctttgtggcctgctgttgttgggctgttggctaatgaaagctcgttaaggctcgcgagcagctagctcgagctggctcgttatctctaacgagctttagagccagctcggttcgttacgaaatttaaatgagccgagccgagccgagccgagcgagctaacgagccacgagcttcctgtccacccctagttgggagttgagagaaagtagcttcctgtccacccctagttaggagttgagggaaagtttggtgtgaactaaacctaaaccgggccaggacacccctaaacacgagatgcaaatgcgttgcaaatccacctacaagggcgacgtaatatcacgcgcgaattgaatggcatttgctgcttcctggggagaaagatggagtacaaaaattaatgccatctattactactccctcgcacctcatgtgtttgctgcctggagcaaaggatttttaccggtccaattcggggcacacggacgagtagcatgagcttctgggactctcacacgcccatggcctcgcatgagtcactgacgtgtgtggtggtgcaagactctagctctaggactgtgcgccaacctgcaacagacgccgaagcgaagctcctagactgatactcctagatcctagcacaactccttgggatctcactgaccggtgggccccagcagggctcggctccaaagcagcgtcaaagaacgccgcggggcccgcatgacctagcgatcccgagatgggcccacggttacagaagcaaggagcgctcgtgaaaaaacagcaaaaagaaattaaaagccctcgaaaaagaaaagaaggccggtgcggggcccagaaggcaacggatcccactagccaacaccgtcaggtgggccccgcgtacgggcccaccacccacccttttctccccctcaaccttaataaaaccacctcccaccgcctgtctcccctttaaacgcagcagcacgaacacttccccgtgcccgcgcctcgcgacgggcccaaatccaacacgacgacgaggaggaggagatcgagtgcgccaccgaatcgaataaccacaagccgcggaagatttcccctccccccggtggatccctcctcctcctcctcctcctcctcctcctccggggtcgcctcctcccctccgatggagtccgggagcgagagcggcagcgggagcgggagccgaggggagatcacgctggccatcggcggtggcggcgcgtcggcggcggcgtggactcggctggtcagctccggcgtggaggacgtgctggtggtggggggcgcgggtggctggcgtggaggaggaggaggagatggagcgggtgggctgctgccgtacgggcacttcctggaggcctgcttcctctgccggaagccgctcgccagcaaccgcgatatctacatgtacaggtaatccctccctccgctcgacgccgatgcctgattcggttcgtgttcttctgctgggttagtttggtgtatttggtagcggtgggtcccgtggccgggacttctccggcgtcattggaagctttgttttgtatatgaagaaaaggaaattttgccgctgattccagctgaagcctgcgggaaaagtgagagttagtgcatactccgatggagtatttctcagggttttttttgtcgtctgcaccgtccgttttttttattggtgcgttaggttgctacgcttctgagctgaagggaagaaatttgtgcgagtatccttcaaaagagaaaattatgcgacttgttttttcccttctgccggattttgcgttggtgtaaaggttttgtcgttcatattgtgttcgtacaagcccttgtttactttggcgcgtgaatatattaaatccttagtgggtgggcttatttatgatcatgctgtcatcaagagtagataccaactactgtttgctctttgtttatgaagcgtctgattcgggagggagttggatgctaggcacggacgatttcttgctctttttcccccttccaacgaaaataatgaacgtttttgctgcttaaccatgttagtttcgaacaggtggatgaattgaaccgaactgcggctattttttgttctccgatcttttggtttctttcttaattgtgatctagtggtggtggtggatacagctatcgaagagagccgtccttttgaatttattttcaatttttcatgtaagaaaattaattgttcattgatgtgtgctcacgggaacttctgatgaaagggacctgcaacctaactggatctttctgaatcttaagactttgaatttttcctgttaaagaaaatgcttgttagcttatttaaactggatgttgtgacttgaacacaccgtgtacagcaatacagcatgatatatcatagaagaagaaataattcagacatgtaactagtgtgaagacttatcagttaaacagtaaaatgcaatttctttttttagataatggaatcgattctctgttaaatgaaattcttcgacgtaattgccctcgtccttttatagctggtaggctagtagctattgtcacattcatgtcactaagtttgctaattgatgatcctacggatcctttggttgagcaggggggacattccgttctgcagcgaggagtgcaggagggagcagatcgaaatggacgacgagatggagaggaaggagaagaagaacatctccaagaaggtggcgccacgtactcccgaccccagagaggtggagtccactccgaggcctccgaaagctcgcgccggctcgatcctcgccgggtgacaactgacaaggaggagggactgaaagtgaggaaactcctccgggattgtgctgctcgttttccggcaagccaagaccagatgatcctcacaccttaccaccagaaaactatcacttacaaagttacatatgggtttgtgtttttgtttaaaccccctttgctcttttggtggtgtttgttagcgcctccctaatatcggtgatcgatgatgtatagagacggatggaaaggaagatcagcgctggttattagtaggagtgactggctgactgcagctttctgtaatctgtgttatcaagggggggggggggggggtttcctgaccttcgtcttgggggtgttgtgaatttttcctacgtgtagctgattactgtggtaggtgtaaggttttttctaatgaatctgaggaaacatatgcctatagaagaaatagacatatggacgaatgaatccttgactttttttcatgtactgtaatcttttcgttgaagatcttgtatgagctgtgacaggaagctcaggaaagatcttgtgtgtgcttgttgctatggttgatggagcatgtgcagcagtttattgacccttaactcggtacaattctccaaaatcaattggaagcatatttttatcaaatgaccactgaactttcatggtagaaccatgaacctcataaactttcaaacatgtacttatgcacaatcacatactatttcaacaaaatacacaccgtaaaatgataggctcttaagacagtaaaatgatgttatacgtagtactacgagcacttgacctgcaaacagaaaaggcattcatcctctgatgtgtcaacgagacgaggacaaaaacaaatcaatcggcaattaaagaatactagcagtacaacgtacagtcatgaccaaatctagaaggacagcagagcagacgtactcacagtttcacagtgcaggctaaacgacagcctctcccaggctacgctccctttgacccctagcatctaccggtagccgagtactccctctatttcataaaaaaccaacttagcactgaatgtgcaccattgtaatttgtttttttttaaaacggagatagttcctatgtaccactgcactgtactagtagtacgagtagattagagtacggagtagaatagtagtactccgtattgtattttactacactactgcagctgccacagtgccacttcaattctctctttcccgtccgtcacgagccttgtggaagaataggaaaggaattgaatgccacttgacgcgaaggtgcagatcgagcaggtgaggtgaaggtgatgtgatgaggtgaacgatttcctttccacgaaccgcgccgactttatggaatggaaatcagagggaacgattcggccggccccacctgtctgtctcccacgcgcctggacaacggggaaagcttccggcgggggaaaggcagaggcgggcgcgcgcgcgccgacggccatgtgcttgctgttgctgcctcccgcttcagagaaaaagcgagcgtgcggtgaagtgaaacgacatcggggaggaggaggaggaggaggaggaggggttggtcacttggggtgtgttcggacctctaggttcccaacccaaatctctcgtttttcgcgtgcacgcttttcaaactgctaaatggtgtattttttacaaaaagtttctatacaaaagttgtttaaaaaatcaaattaatttatttttgaaaaaaattaactaatacttaattaatcacgtgctaatggattgctccgttttccgtgcggagtcactatgttcccatcatccacatgcgaacacagccttggttggttgcgatgctttgatcagagttcacgaggacgaagctttggtcggtggcagcgccccccccccctctctctctctctctctctcctcccttttactgctaccgcacgcccgcctcgctcgctacctcacttccgccgcggagaacgaccaaccaacgaaccaaaagtttgatcacatttgcgtcatctcctccggtttggggggagtacctttttctccgagtggttgggttgaccttttttttttctcttgcggacaacttgtttaaacgtttcggttgctttgcgaaacgttactgttgtgagtaagtgagttcgtgacaaactatattacattttgtagcaacgtcgggttgtcaaatactgccgtaggttctggagttttgttttaattccgttgacagcttgtttggcaacttgagggaaggggattgagagtttacacgagggaattgatggtgagattaagatgggaatttgatttttattcccaatatcttgtttggcagaggtggtgaaaattgacagggagtttagttggagattagtttattaatggaaacggttggctgagatttgtttagacagagtaaaggagaaattccctcccaattactactcctacccaggtattgaaaatgagggagtttcttcctcaattcctcatcctcatcccaccaaaattctcatgtctcccaatcaaacaaaacagttaatagtctcatccctctaaactcccaatcccttctaaaaactccctccaaccaaacggacatttggtgaactgaactgtctcgcgcgaatatacttgcagtgttcagcactatgctccattgctcctacggctacgttcgtggatgtggacaagtggatgggtgcctttttgtcaaagtcatggatggcgtcaaccatgactcggtagtgtgcaactctgccgcaacagcagggatggaccgatattgatggtgaggcccattgaccagggattggacaggctgggcattaaatggctctgaagtctaggcccgacaataattaattggaccgttcggagtttgttttctggcccaaaactcatggcccgtgtgagggattaatcggcaactaggactaggatgcgcgatcgcctcttgaaggcgtaaacttgagctttccacatccgtcgaaggcggaaaggggctttcccttaccaaccttgcctggtttgctctgccctgctctcccagcaacgccaaccccgatgctagccgccgccgccgccctccgcccgcccttccgccgcgcccgcctgagcacctcccatggaggaggcggaggagtgacgcaccctctgcgcccgcgcctgcagcggcgtgctttggcctgccgggctgacctgcagcaggacgcgccgttcgccgccgccatcggcgcctgcttgctagcctccctcgtgctcccgacgtcgagaggccgacgagatgacgacgaggaggaaggggagtttggcgcgacggacacgaggatgggcgtcatggggatcatctccttgctgccttacttcaactggctggtgagagcttaaggatagtcttgctgcccctctttgttccttctgcttagatttgaccccttctttttttttgtcttttacttcacgattagagctggatcttcgcgtggctggacagcgggaagcggcgttatctgttctacgccgctgcatacttggctccttatctgaggtttgaaattccaaactatgaactgctaatatggttaccctttgtcatgctggatgtggctatgcactgggattaattgagtttgtttgctgtgttggcttaatttgatcatgaccaacacttttgcaatgaccaattagacctccactttgtaatgtatggcgtcttgggtagctgttagtagtgttacttatcactggatcttctctggttgagaaaatgcttgtaataacgatccgattgtagaatctataaaaaaatagtcttgaggatcaataatctcttgggcctccttcgagtaagatcaaattgcttgagtgtttcatgtgaaattatggggaaccactgaaccatgtatgttggttgatcttgttttatatggactgttctacactttatggagttttcctgtcttattagatactggactcatgctgtctgctaaggtaaccaacaaaaactagcatcaattttcagaacaaatttatcactgtcgcccgaagagagctggttacctatagctagcatctttgcctgcattctccatgttcaggtcagtgagcaagcaattccagtattctggcaagctatagcttctttgctgatattttttcccttgcagctagaggcaagcatcaggactggtgatatcgagaccttcaggtttgttcagagagcttggaggcttattttccctagtgctctgaaggaggatgttcaacatagaaacaagggaaaatcaatcagaatggtacaatataaatgaactttataatctgatgttatgaatctctattcaactaaattttggcaatcttctcctacaatggttcagggcagcggtaacaggagaattccatcagcacatgaatctagagaaaagcttcgtaattcagatatcttcaaaaggagacttgatgagcccaacgacgagaaacaaaacaaatcagattggaactgaactcaaacagtgtcgtcctttctcttgtcaagctgtttaaggaagatccacatccttgtggaaaactcctgtggctgcttgcaaaaccgatgtgcagtatgtcaaattaggcttaggtgtagttagtttccaagttagtccacgaccacgagttgttggatcaagcaggcaaccaggctgatcagagtgaggcacctgctgttttcaggtttctgcaaattatgttttgtttgttgtgtgtagcattcagcaagaataattaacgttgcatgcttgctctatctgaaattctgaatgaaagtagctttatgcctggtttgtctctctctcatccgtggttagaactcagaacaaaccgctgcctgcttccctagcttgcttggctgttgctgattactgtgagcacctttgatcatacgttgtcatggactcctgaagcctcatctttccgcttatgcttatgcctatcaaccaaaatttaaatttttaaccttaaatttggagttgatttcggggttttttcatcgaagtttatttttaatccttgttttagatagttaaaaacacacatatatataaatttattcacaaattatttttcatttacaaatatgccgatggtagatgttagctagctttgttcatcggggagggcaggtctttggtacgtttccgcgtgttccgtttcacagcaaatcactgtgaaaactaaattgtacacagaatgatgcgaataccacgttttagatgaagattttttttcccggtttggaaggttcggaaaggaggattagtgaggactcagtgaggtgttggcatgttgccgtgttggagcatttgttcctggatgccaatcgtgaatattgatgtcgaaatgcacctgcggccactagtatgttcttccgttccgtccattttgctgctattgcgcatcagtttcatatcacactagccactgggtctcatcgtattcgttgattgacataaccacgcgacatctagccaattgtttgatgcttcaaaacaaaaaacagtttaaaatgcatacatcaaactcattgttcaagccaaattctgtgcttaccatccgattaatcaaccaagagtaaaatgcaccagcggtttttaaacttgtcataaggtttcacttaggtccacgaacttacaaaacgcacatcgagatctctaaacttggtttattgtatcatcctaatccaaagtctcgtttgaccgtggtctttcctacgtggcacaccatgtggacgatgacatggcccttttttttcctttttccccgttttctttttcctcatcttcttttatcttattcctccgcttagcacgacggtggctagggtgtcggcgacgcgcggccagaagacggtggcgagagggagcggcatggaggatgcgatagagggtacgatgagcttggggagttgggaaaatggtggaggggagcaggggtggacattatatccttgggaggctggaattgtgcccagggtgagcagatttgaagcgggaggggaaggcgggacaatatctcgggcggcttgggtcagccgccggtttgtgtggggaagtgggggaggtgggcgatgaccgtgtcccctgcacgtgcggacgagtcgggaaggcgcgaggacagtgacgtcgtggggagcgacgtgcacaggaggggtgtccatggcggttgccggtcggaggaggaagaaggccctgacaggtcggcggcggaagggagaaaaaataaaaaaaaaattacatgtcatcatccatgtagtatgccacgtaggcaagaccacagtcaaataaggttttggactgggatgagatattaaatcaagtttacgaatttcgatacgtgttttgtaagtttatggatcttagtaagtactcgccgtcagtaggggtggataaaaagctcgggctcgtgagcttagctcgggcttggcttgagctcgtaaagcttggctcggcttgaaaactaaacgagccgagctcgagctgcctccatggctcgcttctaaatcgagccgagcccaagctgctcgcaagccgctcgtgaagcttgtcgagcttgtgaaaaaaatggcctggcccattaacagctgatttggcccatgaaaaactctaacctcaccgttcctctcccactccctcgtcatttccttccctagaccccttctcacgccgccagcccgtcacaccgagtccaacgcctttcaacgcgcgcgcgacaggcgacaccgctcgaggcctagggcgcgaccgcgcgaggctccctgcgccgcctccctcccctatgctttcctccccagctccgctcgacgctccctgcgccgaccttccctgactcgatgttgttcatcacctcgccgagacaccaacccaccgacggcagttttcgctgcgacgagcccaggatgaagaggttttgggatgtgttttcttatttttcttatgcatgtagcaatagcatgttgtggtcttagcacttgtggtctattggtcttgtgattgtagagcaatagtacgtgtagtatgtgcgtgatgaattgataatagaaagattaaggcaaataaatcaaaattgtcgtaccagtagtgtatgtatgatgtatctgtgactttgtgttactgttagtgctatacttcactcttttttagttgttcttgctactgcattgcaatttgcattatttgaggcctacatgacctgtaggagtttgatcctgatgcatacttgacgtttacttgttgaaaattgattgctttgttgttgtagtgtttacttactgctagcatcacaagccggctcgagctggctcgagctttgaaacgagccgagccaagctgctgttttagttcgtttagttaatcaaaccgagccaatccaagcctgttctttgccaagctttcctcggctcgtttccacccctagccgtcagtgtatttcactcatcaattaaattaggcggttgatactgagtacgaatagccacgagtcagtccgcgtactttactatactttagccattccacatcagtccgtgccgctctctgcccattctcttctccacggcaaaccaccaccggcgtcaccagcccaccaccggtctccaccgccacccttttctccgaatcccgacatggagaggcctccgcgcaggccctccgccgcgcgcccgcgcccgcgctccctccagcgagccgccgcggcgctcttcctcgccatcttcgtcgcgctgcccttcgccgtgctgtaccgtggccccgtgtcgcggtcgctgcacgactcgtgggagtgggacccgctgccttcgctcgacgcatccgaggaggacggcgccgcccgggatgatgatctggtaatcctgccccctcccttcctactgatggcgttcgtttggttcccaatttttagtgtaactgctctggaactggaatgatatccactgttaaaccatgaacgaacaacgataaattttggtagtacttctgctcaaaaaggagaaaaaaaaacattggtcctctcctcttagttttgtgaatgtcaggtagggtttaataagttcgcagtgcggtgttgttcgtggattcatttatgatcagttcatgtggttggattttgcgatctcgtgtagtgtagtctaatttagagctgttactgccaatgcgtaatgacatattgtgttcacaatacttagtagtggctgcactagagatgtgttatcttgaagggtttatcttaggatgaagcaattctatccagttgggtttagatgttatagtaaacacacacgagtaaatgcagatggtgttgttgtgttaaaagacagaagaacagtgaacacatatgtgatagccagaaccttccaatctgtttttcagtttgaacatgggaatcacttccacctagtgaaatactccctctgtttgggacggtgggagtagatgttactgacgcggtagtgtctgctctaggtgtcattgacatgtggataacttcattgaattttgtaagagaagtagattactgtttttctccaccatagtaatgtcagaaagtttggtaccttacatatttgctttgtttcagctgattattaacggatgttttcacattgaacaattgactaggttggcaattgaaaggccaacatggcttttgattgcaggactttaggaaaatttaagaaagtaataatgaccctaagtttttttattgtttatcttagctgtcaatgttacatttcagatttcattttagctgtatgtttcatgtattcattgtcccctaggccctaatagtccaaattcagaataaccatcttaatttttgaactactttttatgtgatcatttgcgcggccactttccagttaactttctccttttatttaattgtatccttctaggacagtcaagatctgaaactcgagcaagtcctgcagaaagcctcaatgggagataacacggttatattgaccactcttaattctgcatgggcttctcctggctcagtgatagacctattcattgacagttttcgatctggtgttagaacaagttcacttataaaccatcttgtcattatagcatttgattggaatgcttacaagcaatgtctcaagatccatccttattgctttgctctcggaactgatggtgtggatttctctgaggagaagaggttcttgacttctgggtatctggagatgatgtggaaaaggatagatttcttgcggctggtcctggaaagtggttttagcttcatattctcggtaaattctgttgcatgcagttcagtcaccattgataaatagttattcccattttgcaaattccaacagcaagtgattcggctttgttactaaccatgatgagattactattttcttttgttcataatatgatcgctagttgtttcaaaacaatgatgaaatggaggtgtcttttggttgtcactttcatatacttattttccatttattttgataaatttcaggatgcagatatcatgtggtttcgcagtccgtttccttatttttatcctgatggcgattttcagattgcttgtgaccactattttgggaatgcaactgatctgagaaacattgctaatggaggcttcaactacgtgaaatcaaatgaacgaagcatagagttttacagtttctggtattcctcacgattgagatatcctggccttcatgatcaggatgtatttaatgtcatcaagcacgacccttatgtttcagatattggactgaaaattaagtttttgagtacttcatactttggtggattttgtgaaccaagcagagatctaaacaaagtttgcaccatgcacgctaactgttgcattggactgcaaagcaaggtacatgatctaagagttatgatggaagattggaggagttatttgtccttacctccaagcttgaaaagattgagtgcattggcatggagggtgccgcaaaattgcaggtattagaaccaaccttgaaatccaatttagattgtttcaaatggaaaatacaattaaatgaagttcaactaaaatctttctttcacattgttttcatgttgcatctgagcattttttttggcagcctttcttggtcacaccaataaaacgtccttatggacagcaaaaagaaatgaaaatggtgaagcccgccgaaagcgctctgccttccccccgaaagaaccttcagctaaacatctaaacagtgtgacgagattctgattgaaaggtcgcggtaagttttgccaaacacttcggagatccttgacaatatagagcggagttgccggaccgctctggaaaaatacactacaaggatggagcggccttagcactgctcctcagctccgctggctgtaccgaacgggccttcagacttcagtgacaaccagcttcatttggctacgagaaaaggagtgcctgcttcttcaaggaaaactgaagcaattacaccgtcttgaaaagcaagactgctgcaatggatctgtcaagagtaaaatggaaaaaaaagaatgtatatcctggttgatttcataggtaagtttgaaaactggatgctcttttttttcctgtgttagaacaattttgttagatggatagatgtatgaaatatgaaaaaaatgaatggcctagtctcgcgattttcaaatatgaattcaagttcagctgtgttagatggctagatgcacgccaagccgccgagtaccgtgcacctttgcaaagcatattgaaagctgcataactgggtgagccatccttgggccagatcaagtaattgggcggactctagaccgaaattgttgttggcgaggggtaatattttgggcctgtggcatagcccatggggccgaattacagacccattttccttcattctaggcctttgccttatggccctaactgacatatgggacccagttgccagtgtcatccgtcaataaaccccagaacccgcgtccgcgaacaattcctctccccagcctcgccgcccggccgcacctcgtcccctcgcctcgccgccgcctcctcccccacgcgcgcggtcgtccagccatggggagatcgtcgtcggcgacggcggcgggaagtaagaagcggaggtccaaaaccggagctctaaccctaggggaggtgaagacgcttggcgaggagctcctctcgtcgcgcgccaacctcaaccacgcccccaccctcctcgcgctcctctccccctccgcgccgctggacctcgcgctggaggcgctcatctcgctccagtcgttcttcgtgcccctcctcccttccatcccctccgccgccgccacggccgccgcggccgcgggggatgcagaccccgagcttgtgtttaggtcctggttgcggaagcgtttcgacgagctcgttgcggcgctcgtcgagctcaccgtgtctccgcacagtgatgatgcaatcagggtgagtgctgctgcagcacctattcatttgtgtgctcggttgatggtttgatggtgaatggttcgattagcatgctcctttgttcactgtaggatctggcacttgatgcgctcatggatttcgtgaagctgggcaaggatgggagattccagtcggcaatttaccacaagtttatccacaatttggtgagtttttatcctctcatgctgttgcatcggtgtgaaattggggaaatactataatactagcagtatttaggggtggtttggctgagaagtgaactcgtggactagtttttactgttcgcttgctgctaagtttgcctgtttttgtgcagattcatgctaccgactcaattgatcctttgctagagttgcttggaccaaagtacttcatatacactgatgtttggtatgtcgtggtcaccttttgagtaatttttgctgtactttagtatctggtcctgataatcttaccttgagtgctttgctaacttgttctgcagtatttctaccatgcatttttttaatgttttcttgtaatatacttaattgttttctccatttgcttctgtagttacttcacttacactagcttagacaagatcgccagcagtataggcaataaagccaccggtaataccctctctcgttaaaaaatataacttattacaaactagttacctcattctattcttatcaggttctgaaaagagtgtcttgcatagtggcgatgatgggccagaagacaggtatgcttaagctcttttacatgatacatatattaagattggatgattgtgatcataaattcatagtattacctatggtaagatccaaccaatataccattgtgcattgcattaaatgagcgtttcaaatgcctgcacgcaaatgttttgcagtattgcttcgaaagaaaaaggtaagctgggaaagctttgttgttgttttacatgttcatgtgatccatctctgcctgttaaggaacaattggtactctgatgtgttgcttgtacttcatgcttgcatttctgtgttggtgtgttcttggaaagtacaatggcatgtgcttttcaaagttttacccctgcaatatcatttgaagacttgcaggtagtgatctatgttgtgaattattttgatcgtgtaattgtttgatttagatatcccataaaacacttgtagtgtgatttgccaatgtttatacatttctagtttttaacaactttcttagtcccatttatattcttctgatcttctctcttgctataacagaggcactatttatgtacgcaatatatacaatactttggcgcatattcctgccttggattttcaggagtcaaagtttaatatgtggagtactgttggtgagtcttttaactcttttgaaggctctattttccagtatgtaaaaatacttacagttgtccttttatacattgcattccctttttcatgtatgtccttatctattgaagaaccttgagacccattttctgttaggggtaggcagatataaaccattaactgaaggctgaacgaacttaagtagcagtttgtctggtggcaggtttggtttttataattggctgcttcggtgtttggttggaagatcagtacttatctcccgtaaatctcctataaaccgagcctcctgataaaaccgaggacagtgttctcaacagatagagcgcgtgggagaccgtgccctttcgtcgcatgatttttgctgacggtggctccacgcacacgccctcgcatgattcaagcagcggacccttgtgggatctggcagactactgcccaatggccatcacacataggtggggcggaagcagattgttcggtcggtttctttagtaaaaaaaacaaaaccaaatcgaagtagtttggtttttccctgatgagatcggttggtgtttcttaaaagccaaaaatccaccaagcggtaaaaatcgaaccgaagaacctggacgcccacccctactttctgtaattgttgaattctctctcacaaagacacccacatgtctcatagtcattgttccttttgaatgttctacttgcctacttcacttatccatctccgctccttttcatttgttggtctttgctatgcaacattgttggaatagtgatgttattctgacttctcttttttgtttgtgaaggcctttcttccaaaggagaaaagaactcatctgaggtacttcatatacacttcatgaagtaaactgcaactttgcctagtgactaagctttaacgttctgcaggactgctctgctacttacattaacaaaaaactcaaatcaaagttcagcaaagcctggatatcctttctcaagctgccacttccgcttgatgtgtacaaggaggttaatctctaatttatcttaaagcaattagaaatgatgtgatgctgctatctctctctttttttttcttggcttgaaaccagaccttcgccctttcaacattctacaataagtagcaattggtctcaattgcttcatctttaactttttatgaatggtataagtgttgcatgagcactcttgcaacagcaatttttccgaggatgtaatttacttatttacatgtagccttatggacttagtttacttggagtactgtaataattcaatggccaattagggtgatgtaactatttgttcaacaaattttgttgtttgctgttgccacactaagaattttggtcttgttttgtgatactgccttcttttagtgcacattaactgcgagtactgagcagtgatgatctataaattgcaggtccttgcaacaattcataagaatgtaattccttcaatgtcgaacccggccatcttgtggtaggttattccatttgatctgcatatttgtttgacaccattaatagaattctcataacctctgtattttggtgttgaagtgatttcttgactagatcatatgacattggtggtgttatcagtgtgatggccctaagtggtcttttcattcttatgacacaacatggcctggaatatccaaaattctatgacaaactctatgcattactgactcctgctgttttcatggcgaaacatcgggcagttttcttgcaagtaagtatctcagtaaatatgatgtggcattatcatctgttaatcaagtcatgtcaagtgtaaactgattgcagcttggactgttactccaccaacactttctatcgtcttaataaaatgactgccacacccagcatcacgtttttgaaggcgttctgtaggatttctataaatctaatttttgtagatatccattttccagcaatctgtaatatacttggttaggtcttaggcagtaatcactcgtcaggcggtacagtagcagaatacccaatcttgatgtgatagctaaaaagagaattaatcatgcaaaaggtttataccagttatggcatattagacttgttgactaacctgatgcctgcagcctcccacatccaaatacacctgtggtctttttaatatccatcggattggataatgggaaccaaggaggggtatgtttgccacctgctttggcattgtttgtcactcgctttattctcttaagccacaacttgcagccattgagtgacattctataaattgtggttgtggaaaaagagatggcacttgacacccttaattcatgtagactcatgggtgcaactaagcgaatcaaggcactaaattgtcacccatatgtttgagctatgaaccaccaatcttcaatccatgaatcaactcgataatacaagttaatatgagattttttttgtgcatatttctttttttaaggattattttattattcttaccatctattatggatttcctttttacattttttgactttttttttaaaattgcagcttctggatgcatgtctgaaatcttcatatcttcctgcatatcttgctgccgcgtttgcaaaaagattgagtagactaaccctttcagttccacctgctggcgctcttattattattgctttaattcacaatctactgcggagacacccgtcaataaattttttggtccattgggtatgttacttgttgtaccctttggtgcatatatataatatatagtagctgctgattgatatccttccctgggcagccactttgtgccaacaaagtgaatggcatcatgttcatgtagtccacattctatgttcttttttgtgttgttccgtaagctgtttgtattgctcttctgaataattttcaggaaattgatgcaaatgattctgaaatctttaacgaagctagtcaacgtaagaaggttggcgctgatcctttcaacaatgaagagactgaccctgcaaagtctggtgcaatgcgtaagtgatacctgtatcaaacatatttttcttcatttcatttctttgcaatcctgaattcctaagttgtcagtggttttctgcataccatgtactaatacttgaaaatgcacaacaggaagttctctatgggaaatagacacactgcgccatcattactctcctgctgtttcaaggtaccgggaagcttgatgccctgtttctatgacatctacatttcttgtttgattgtttagctcatttattgtgatactgttaactattgtcagattcgttgcttcacttgaaaatgatctcactgttcgggccaaaactactgagatgaaaataacggactttagttcaggctcctacgcaacagttttcagagatgaggtttgtctgtccgataccttacactatactcaccctcgtatgtatgcctgtatgcatgcacatgtattttacaccaatgcgcaaaatattagggatatgttacatccagcgtacctttcactagatttcaccatgtgttctatgcatatacatatgaaccatgtttacatggttttttctattgaaatgaatccgacaaacctgcttgtttttggagttattgttaaaccaaagtttagtcttgtcacttgtcttatccgctgccatttgagtgtctattattaaataatcactgggaatttactaaaaatctaccaaccctggttttgaattgtaggtacgacggcg

SEQ ID NO: 67557 - DNA, 14622 bp, Oryza sativa
ccggtgcacgccggcgagcgggatggagtagtctacgagcgacggcgcagtacagagtaggaggcaaaccctagattgatttttcgtgagttgcgtgaagacggcaagtcggtttatatagagaagggtcgcttgatcagggcgcccgcacgatctctactgcgcgtaaccgaaccggataagtcgcgcgtaacttatccggactccatgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgcccggcccggcccggccaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaatcttcctagaagattcacccaaaatcttcatagactgcgaccaacagtcaagctcacaaaggtgagttctttcaagaatgctctgcaggacaacatcttcgctaattaaagccaacagaactcattaaggcatagtcaacctgccttgcagctcacaagagtatatgcatcttcacttggagagggtatatatattggtactctcctctagtttattaatggtttgttcttcccaggatctaattcacgggatctccgatcacatagactgggttaccaccatagtataactcacatgggtctcaagcccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcctggattagaggtaaatcggctcaacttgctcacagcaaaggagatatcaggcctagttgcactagccaggtacatcaacgatccaatgatttgggagtattccagttgattcctagcaattctcttgttcttgcgaagcaacaagctaggatcataaggtgttggagaaggcttactatcaatgtagccaaagcgatttaagatcttctccacataatgggactgcaagagtgtaatcccattctcacctctaattagcttaatgtttaagataatatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggtgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgtaccccacaggtttacacccatagggtcgctctatcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcagatttaactaataaaaatctataggcaatgctatgataagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcctattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcgaaacaggcctccgcactcataacctttaccaataaaatatccatgtttagacacgactactttattagactcaaaaaccaacttaaatccgtttctagtcagacgggagccactaacaagattcctgtcgatagaagggacatgttgcacgttcttcagctgcacgatctttcccgaagtaaacttcagatctaccgtgccaacaccatgaacagaagcatgtgacccattccccattagaacggtggaaccccgtgcgacctgataagaagaaaacaatgagatgtcagcacaaaaatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcctgttcgactacaaaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcaccaagaatgctaagaatgcatcccacaaagagagtagtggcttcctcaaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacggtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgctttccaaaaaccttattgccgccttctcccggtgcagaacgtcgaaggcagaggttccggagacctgctctcccgatcgccggtgcacgccggcgagcgggatggagtagtctacgagcgacggcgcagtacagagtaggaggcaaaccctagattgatttttcgtgagttgcgtgaagacggcaagtcggtttatatagagaagggttgcttgatcagggcgcccgcacgatctctactgcgcgtaaccgaaccggataagtcgcgcgtaacttatccgaactccatgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcaacgcgtacgtcgtgcacgcgcgccgccggcccggccaggcgagcgagcgcgcgcgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaattactgcgctatggactatgaagaaaccctaaacgctgtgaattgaaggtgattataagagctcactgttccaacatcgtgctgtcctagtgtcctaaatgaccactgtttttttctataataccattaaagactcttaatagctccctgacaaaactggactcttaatagttactaatcgtccttttaggtcggccactccagcgcaagataatgaccgtttgttgagcacattccttcatttttcttaggtgaatatgtttgttgttttatgtactaattctagagcaacgcccttttgttggttgaaatgttcaattagtatatcggacatgctcatgtgtcccggtggtccttttgatttgtttgattcgggatgcaaacaaagtttgggggacacctgccctgtattttagattgtggatccaatgtcaccgtcagaataatcaatttcagtttcggtgactccatatgaaaatcttttagtgattctaatgatatactgacccgtaagaaaaatatgggaaaaaaaagggtgttcccaatctcaaacttatgaatatccttttcactaaaaccatcgaatgatatttgctgcagcataagttgcctagttgcaatgcaacacagagcggagcaagacctttggacacggtgagaccctccatttttccacagagaacggaaagggacgcagcggcgaaagcaaaagggcccggaaaagtgcaccgcggagggcccacatgtcatggagcacgaaaccggggcttggaaaggacacgggacttttaaacgcgcagcggagcagtagcaagacgaaagcgacggtggagacgcgcagcaccggttccacgctccctttgtccggtgggcccgtggcctgtgtgcgcggtgggtacgccttgggtggtccgccatctcggtataaaacgacagccacagatattttgtgcacacacacacgtagctgtaccgctccaccatatgcaaatgcaatcctactctacgtgcctatatacgtgtaataaaaaattcgtgtggtgtatatatacacacggttgaaaaagtctctgctggtatatccgtgtgcataaaacatacgaataatacatgtttactgtaacacatatactctggtatttggtgcggtggtatgtttgttcaagaaaaagggatatgctacgagcctattgagtctatgactgttcctcttattgcttctttttgctggactcgaaaatgatccgagctactagtactttttttttctccaggtccacggatgcaaaccacgataattgaagtctgtgttcagtgacgacacttacttttttttttcctttgattcgataattgaagtctgtgttcagtgatgacacttactgaatattttccgaaaaagaaaatcacttctagaacgtttttaatctactgatttatgattgctagtttgctacgtacgtagttttatatccgaagtgacccgaattaggtagagttccaatatcccgtgaggccgtgaccaatcgccttcttccatggccattaaaaacttttaacgctacaaaacgatagaggtaagcactatctctcgatgctctgcgtatctgaagctcaagccatcaaaatggctgagacgcacatttgccatcagttgcttcgcttccaatcgcagtaacgtttcagagatttttgggatcaagccctttggcatgctaagtgactctttaaacaagggacaagacatcacacacaacgtaattcacctaactagttcatgtttgatttaacccttcatcaccattttttttccttttcgcaagaacatgcacctagacgagacgtacggagtactattgaatccattttctactcaccctgttcctagtctctgtacacgactgtaccgtattcgccgccttgaaagttgaaacactctacaggacggtaaattcaccatcatcactactagcgactatatctaatcgcgacctgtgatgctggctaccgtttaagtcaagcgagacaggtgccaaaaacaaaagcgacggtgtttgacaacgggatgtggtgagatcgccgtcagggcagtacagcgtgggagggagcttgccccagatgtaacgttacaattgtacactagctacatagatccctcccttccatgtcaaaacaatctgtggacagtgagccatcatgtagatgcagctagctaatgggttgggcctaatgcatcgatctaaagcctaaacccatggctaatcgtgactcaccagctaatcaaattttataatctgtagtaccaagaatccaagattaggtgatctaatctacctctacaaaggacattaaataaataaattaaataagtgggcgcagtacgtaagctaactccaatgccgctagtagtaagtacataattttaacggcattcacatttcataatcccagcattcattaatcaactgtgtgctattaccgcatgtactgtgtattcgggatttctgatggcatatgcctccccaacgaccagcaggtccccggtacagccagcagctagcattagcatggggttaagttttacgccgccggttgagcgcgtctccaggcactggcttacactataattttgctgagaccaccatcgagattcgtgcgtacgatcctgttacaaaacagaagaaatcgcagtgcccaacaaaagtgagcaaattattggtgatgggcagcactagttaattgtgtgtacagtaatcttggtggtattgtggtcacctttggacgctgtggcaataaacgtctaaagaaattgcgatcaaagcacggacctactacttgtactaggctagtagcaaggtcagtaaagtatcccatgtggagtaaaataaggacaagctgaccccaaaatttggtctcctggattccaaccgggccgcgtctctcgctggggagacattcagtgatacagctggatggacccaacgatctcgcgtttttcttttaagcagcacaaatctgcttttgccttgctttgaactgttcggtttggtaaatcgcggtaatattcgctcgtctcatacaaaaaccttgctgtgctagaaaagtttgtgcattgattcgtttgctaccacaagagaagtatacgaatctagtctaggaggggaaaaaaaaagttaaaattatggaggcacgtaaaaccaggatcggttgggacagtcaaagctgaagaagagctgtgcacttgtgctcctcgccatcgccggaaaaatgctcctgcttttccctgtcgaacgtggcaaggaaaaagatgccggaaaatcaggcaggaaatcccacacagaatcatgggctttggttgtattcctttaacaatactcgggagcatctaatcctacgcatctaatggaacttttaaaagtagctataatgtcagtttggcacaaattatatatctgtgtttgcatcatcaccggctccaatttgccggtcagtttttttattctgttgtgtttttctttctatcattgttgagctaatcctgttttgattgtagatcgatctcatcgacatgtatgtatgtagtagtttatgggattcctgattgctccgttccatccttgatctttcaatatgactcaggttgccatcagtgagattgcaaaggggacaggaaatcattcatttgagactcggacgttgccggatcgacagcatctcaattctgaaactgtggcaaaagctagcgaccaaacctgtaatttgcaggtaaaggatgggttacagctaaccgtatcagacttttcctgctatagagacccgctagtctgttgagatgttgagttgtaacggtggcgccactggtttgatttcctacccctgaagttctgaaatctgaacttcgcaagctgcagcactgcgagcgtgcttgtaatgttcaaacctaggttgcacctactagataagcgtgcttattatgtgtcacaactcacaatgtcacatacttttctctcattcggcacagtttcaatagaaagcatactaaggctgagttcggatgggggagatgggaacccaacttctgcgcacggaaaacggagcagtccattaacacgtgattaattaagtattagctaatttttttttaaaaaaggattaatttgattttttaagcaactttcgtaaagaaactttttacaaaaaatgcaccgtttaacagtttgaaaagcgtgcacgcgaaaaacgatgaagagaggatggaaaaggtgcatgcgaacacagcctaagagtcagcctaagagtgttcataaaacttgttgggtttcacacgcttacagttgagcccagcaaaagcaaaagtagggaagcaacaagtaaagcaagcctcttcggtttcaaatatgttggaaccggggttttcctctctgtttctaaagaacaagtaaataagcttgcatcgacatactaaagacacaactctgtgttctcatcataaagaaatctactccatgctaacatctagaaggaccataaccttaacttcaagaacttgtttttctgtcaggactccttgggcacttagattttgcagcttggcaaagggacaggcccttgatgacctccaaatccccctaacagcttcggcgaaacaaacggcttccactgttgcaaaaaagaaaaagaaaacgacaataccttgtaagccagctgcaaaactttagtaaaaacatttttctttaaaaaaaacatgtccatttcgctgcctataaaacacctaagaattgctaagggaagtaacaaaatgtacatgggggacagttcagttggagaaaaaaaacatatttcattcctcaaaagcagaacacagcggccaaaaaaacaggaggcaaaaatggaggagagcccatgaatcgatcgcctagctccaatgttctaaccttgagaaatgagaaaaaaaaaacaaaccaagactcgcccgaggaagctagggcccaactcggcccaagaccctcaggcgcgtgtacgcacgtagtactagtagcaccagtccccctacaaacagaaacagggtcgcgtacgttttattgttgtgaaaatgtatttgtctccgtcgtcctgcccgtgtcgcaccagaagtcccgaaaataaaaaagacgtggcctccccgcgcgcccgacgcgcggatgcggctcgatcggtctcacacgcgcaacgcggggcctcgcgcggtgccccacgggttggcgtcgatggccggccgcggctgtggctgctggtggtggtgccggtggtggtggtggtggttccggtgctccttccgcaccgacaccgcgtgcgccgccgcacgcttcttccgccggtgcttcgccctgtccacctcgatctgctgctgcctgcactcctcgctgcagaacggcgtgtctcccctgtgcacccacgccacaaaacctcaacaaacttttgcgtgcatgcatcgcggtgaaaggagggagaggacaaaaaaaaaaaaagctttaaacctgtacatgaagatgtcaccggagagggacttgccgcagagggagcactcctcgaggaagtggtggatttgggcgacgtccgcctcgtggacgtagaacatggacgacggcatcgctgcaccgctccccttcatgcctgcggcggcggcgttgctggctggcttcaaagctagctagcaagcaaggccccggcctgggcacgagcgggaagagggagcaaaattgcccccccgagtcttggcactgcactgtcaaggatctcggctggcttgacggagctccggttcgccggaggaatgtacaaataggtcgccggcacttcccatttttagcctcggggagacaaggagaggctgggaattggcagcgtccgacggcaaacctatgaatagaagcggacgccaatcaacggagcatgacacgcgtgaaaaatctgcgtatactttgtttggttttgtgattcttgtttactgcaaaatttggaacaacacactactggccattggagatttagtgaggaaatgggagccattaaaatcaaggcgtctgagatcattcttagggacaatgaacacgggggctaaaatttaaaaacagcgcatagaccgcaggttcagagagatgaagacatgaagtggatgcccccttggcacgtgattcttacttacagatagttactaggcagtatgtacgctgttttggaggttgtttacctacctcaacaatcagtatgctgtttgggcaggaaaaaaaagggattatggagttcaggcagtcttgtttacttagcactttcttaacgtgtaatgcttctgttttactgccgcttcaaaagttatggagtagtatattctgtcaatctgtcgtggttgcaagaaacattctccaatgtactacgcggtcggtgccaccctagcaatcttgttttcttcctttttctttcttgaaaatgcgtgtgcgtataatttactactaccagcatatactgaagtaggagcactattatgttattgacattggtctatagctcacatgtgtaacatgctagcagtacatgtgaatacatacaccacacctcgatcaacatgtctttcagaaattatacgtagatcctacctgtacgtatcccacttgtccatttactaccgaggtcattttcttgacaacaacgctctgaagaagaaaacatttctcgtcaccttcactggcgtctgttactattgacacgacagcaacagcgtacgtcaacctttttgaaaccggtgtgccgctagctaatctcaccgggaagaatcaccctctctattcatccacctttttcctccgctaggagagggacattttggcccaagtccagccgagctgaggtaagagcatgtacaatagcaggctataaaccagctgcaaacatattttaaggagataaataaggagagagaagaacagctggctactgatttatagctagttgtagcacagactccaaaacgcgatgtgtgtatgacagataagaccatatattaatagtgtagtatgtaactattgtataaataagctattagattgactatagattaattggagctattagttggctatactattaaacttgctctaacagtagccaacttcgccacagcaacactctctctctctctcgcgagccgtgcctgcatcattgttccatgcaggcgcaggccgtgtgtgagtagcatatgcaccacatggttcaccgcgacttcgctaaaccgttttcagttggcgtggttagtactagtagtgcaggttaatctagcgccacatgggtgagacttgagagagctatagtattgtgtggtctctgctatggttgtagcgagcagagggggcaggagcgcggcagccacagcgcatgggcgcggcgccggcacgtgcgtgcgggatgcaccccccgaaacaccggcacacggcgagatgcgctcgtctctcgctcaacggctcaagtgctcgtgttggttctcgctggctcggagaaggcgtaacgtggcgagggggaatcgggggaattctttttgtgtcgccaaaggccctagattgcctaaaaggattctctcgggtgcacatggggcgcaacttggggagccacagaaaacggtgaagaaaaaaatccacggcgtggccgaggatgattgatttgttatcgctggttgtttgggctttttaaagtccggagtacgcactaatgccaacatgctttgcgtagtttaattcggttgatggtgaacaacgttgggcgtgacatcatctgctgtagaaaaaacgttagtgtcctactatggctacatgtaccggcagattttgcccttaggtcgtatacgtgagactgtcatgtgggccctccgtttatttttcttttgtggaccgcctgtcaggcagtgttgttgaggaaacgatacggagaagctgtgtctgcaacgctttgagataaaaattgtccaactgctagtacttagtagttgctatagccatttacctcgtgtaagtttccgggaagcaaggctgcacgaatgacaatactaataacaaagcctgcgttgctttcttcctttctttattaccttcccgactttttcgtcgtggagcaaactgtctgttttactacaattcagggccgatattttctcggcgaggaacggaacgaacaatttacctctgccattgatgacggaccagctgctgcaggaggtaccaacatgtctatgatctactgtttgtacacggtatagcaggcggcgacgacattcaatttctgcatcgaacgtacagtatgaattctgttcagagggcaactgaataatggccgctttaactgtattttcatcagaaaaagaacatctaattgtagctgcagcgtgagctctagtagagtactcccttcgtttcacaatataaaactttctagtattacccatattcatatacttcatccgttctacaatgtaagtcattctagcatttcccacattcatattgatattaatgaatctagattcattaatatcaatatgaatgt

SEQ ID NO: 67558 - DNA, 70376 bp, Oryza sativa
aaatgctagaatgacttacattgtgaaacggaggaagtagatgttaatgaatctaaacacaactatgcgtttagattcataacatctatatgaatatggacaatgatagaaagtcttatattgttaaacggagcaagtagtaaaaaagctacgcaacgaacacagcatggagtactaggaaggaaatcgaccgaactaatgagaaatcggagagagctttttacgccactcactttttccatatcaacaggttgcattacaagcacacacacaatgacacaaaacgctgcaccggctgcacgcacgcaccatatttttttgcgaatttgcaaccgtgccaagaaagtaaaattcacacaccaaattgactcctcatctccttgttgcggagatcaggaggaaggaaccgaacaatttcatcgcgaaaagaaagacgcagccggtttgcttctgcttccccgggcttggctttcgttcccgtggaactgtttgatccgcgtgcgctcgactggatctttctccatccgcacacacggtcatggacaagctgtctctcgatctcctcctcgttttttcggttcttgagtttctctaagatctactgttccgtgaccaaaattgtttaccatgcccagaccgggatcctcgggtggctcgccttctgctgcctctgcctctcctgctctgccctccccgtctgcttcgatctctgctctctcgcctcgtcgatctcgatctgctcctgcctgcactcctcgctgcagaagggcatgtcacctctgcaagaacagaaggaatcacaacgccattagaaacacattcttccagagagatttaacctgtcaagagactgacgacagttgtgctgaatatttacctgtacatgaagatgtctctgtttcctccgaggggtctccggcagcggaagcagatgtcgaggtagtggtggtggccgaggaggtcgtcggcgtcgtcgcacgggtcgcagaagaggcggccgccgggccgccgaggcgacgccgcgggcttcacgggggaggcggagtggccggagaagccggcctcgatgtcgtcgtggatggaggtggggtggtagcgcgccatttcttggcttggtttgcttcggccttcggcaaatgagctctctctgttttctcgtttttccggttgggaaaggggagtgatggcggagcgggagaagcaactcgggttttatcatggagggagatggacgggaaggggagatttccgaattagtcctccactgttttgtgaatttctttatgggacttggtgtgttttggctttgtgtagttactgaaatctacatctacattgggctcttttgtaagatgggataattgtggaactttttatataggctgtgtttggaacttccggttccatcccctctctcgttttccgcgcacacgcttttcaaactgttaaacgatgcattttttataaaaagtttctatacgtaagttgcttaaaaaaatcaaattaatccttttttaaaaaaattagctaatacttaattaatcacatgctaatagactgctatgttttccttgcggggagatggattcccaatccacaagtaacgaacacagatgttccttgctcataagagcaggtttaatagtatagtcaactactagctccaaatcatttataactaatgtaatagccaatttatataataattacttactgcactattaatacctggtcccatatgtcatacattacgtcttggagtccgtgctaaagatggctatagatctatagcctgatgttttttctctcttcttttatctttttaaaatatttttatagctgatttatattctgttattatacctgatctaagtgcgaagttaacatctgccgagttgtttaggcacaaatctcaatctctattcgagcgtgtagagttgtatttgctccgtgacggcaccaaggaaaacaacaagcactagctatcagaggtaaaaaagaaatggcgcctgagacagagagaccaatagcacggcttccacatatgatgtgtttgatgcacttgtcagtcacacgattactaattgggccatggtcaaatattacgaaaaatatacgaattttaaaacaaattaagtggttctgttatggtgtgcgtcattgtgcatctctcccgtatgatcgaaaagaaagcaataatgtatacactaaaatttgtgttgttgtctaaaaatatttattatgtggagtatgtgttaccatggaaaaaacaacttctggttcagtgcgtgggcacctttcatacataatgtaaatatttaaaaagggtgtactattattgtgtgtctgattgtgcatatctcatgtatgattgaagagagagtaatattgtactacctcgttttttaatacttcctccgtttcatattacccacattcatatagatgttaatgaatctagacatatatatgtgtttagattcattaacacatgtatatatgtggacaaggctataaagtcttataatataaaacaaagaaagtacataacattgttaacttttgaatacatgtttaactatttatcctatttaaaaagttaagtaactgttatttattttgctatgagttattttataccaaaagttctctaatatgatttatctataccatcttaaaagattctggtggtggtggtcctgccacctccatttatctgacaagcaaggatcaccatctatcatatgggctcatcattttttatcagaaatgtactagagtaagaagctctattttcttcatgtacagtgtacaacgtactgtttatcctatcatcgttaattagagtttgagagtgatgatttagttttaatcagttcatttaatataattggagcccgctgtaacacacgagtttgcatcattttttatcagcaatgtacgggtattatacatttacacaatatttttttaatattttttaataagatgaatggttaatcctatgttcagaagtcaatggcgtaaaaaacaaagatagtgtaaattcaaatttgtgctataatctgtacttattaaatttgtcttatcatggaaagggtgtcttccgtatgatgcaaaaatgaaaagaaaaaaatcatctcaaagttcaattatacatatttgtatttgaaaattgtgagtaggacaaatatcgatttaaagtactcctaagttcacctgggcagcaaattaaaggggaatttattaatcggacccgcgtaacatagcgtacaaactcgctttctctagaaggcgtcaggtcaggtgaccaacaagttgcacggccgcaaggctgtcatcgttgagtgccgttgctgccgcgatgaatcagcctagtggtccgggcccggccgcactattgttctacttcccgtaccactgttcatctcatcaagcaagccggtgtccgtctcatgactcgaattatcaaaccaaccgtctgataggtgcacgtattttttttctcaccaaatcacgcagtttcttgttcacaacatgtcacgtccgattggacggactgaacaattcaggttcttctgagctgagctgagctgcctgcaagtagatcgccctagtggctggccggtggttggctcctggttttttggtggccgcattcgccttacgcatttgatcgctatcaggcttgggatctcatctcaccacccaaaaccaaaaaccaaacagcagcgcagccggtggtgcagctgcttgatttgacgacaattctgctcaacctgaagggaggaaggtgggggacccggcaaattgcgatctcggaggttaatttactcgaaagaaaccggccaattggagggcctggcccctactttgcgtcgccttttcttttctttttttgcttttctatcttgtcgtttttgatgtaccgtgtgctgtgttgatggcctcttttttaagcgtgccatgcaactagggcgataaaggtattggtgcatgattcgcatgagagaatgtgagactgatgagtgtggcgggggataggcactgaagggcaactatgcaagtaggagtagtagccaaaaggatcaattgtttttggttgcttatataacctgaaatctacgaactactccgtacttttttttaaaagaggttctacgagctacttggagtaacgtgacacatttgttcaagtatagaaaccgaaaaaatgacatgtatattgcagtgtttccactagtcccccactactaaaagttttattttgcatatggatcctggtgagtgctgtttttacaatttctatctctccaaattgtcgtcgtttgctctaggtctgacaggttgtggaaaaatatacaacgaaaccataaataatttatggtattgaaaaataagctacaatgataaacctcaaaactaactctaaaattaagtttaaaaatttaaattaattttgactatggttaataaactaacaagtaaacgataataagaacaacgcttatagcattgtgtcacataatttatgacatatatgcaacttacgacgaatatgtggaaaactagcgtatgtgtgaagcatcttgcgtggtagcttatgtgacacaaagtaaaaatggagtcacgatataaaagttgtattgttatttttgctgttttgaggggactatttctacaaaagttttgctatgaatatgttaaaaaaatgtttccaatttcaacccccatcagtcatgtgctcattcttcttccctccaatggttgaagctattccaactccttttagaacttaattttagaatcaatctaggagtctaagagtagaagtatgaaagtattgccctcgaaattatttttagttgatcgatcacgcatgtttggctacataagccatagctatagaaatacattctagtcaggctcttaatttattgttaatttactataccatacctcataccacatgaaactattaggattgttaaaaggctatatctttgataaacaagatgaaactttgttagtgtaaagcttaaaatcaagggcttaaatataaatacaagaaagttgaagacagattggaatacatatatatatatatatatatatatatatatatatattacatggacttccatgtaaagttccttttttttaaaaaaaacttattgattgcttatacatcatacatacggtatggccttgtcaaggtcgctttctttgacacccaatacattggatgacacctttcataataaaaaagaatctctctccatcaagctcttacaaacagtacgaaccggtctcaccactgataatttttatacagaaatcagaggcaactccaagtcatcaaccacctttattaagttggagtaggtctccatgttaatgatgtcaataattgatggattttttagtgctattgattggccagttttttgtgcttacttcactcctcacacacgaaatatataaaacgagagcctttaatttattcctacactaaaaattgtaggatttttttctgctcccagaattttctcccttttttaatcaaaagcgacatctgaatattaattagtcgctgctggtttcatcgacgagcttgatggatacgtgttttgtttcgacttgcacgtcagtgtcaccggcggaagccagtggccaccgcacgcagtataacgctagctgtatcgtgggcgtacgtcgccttcagatcttgccttttttttttcctttttttccacagtttgttttctgccgattgctggtgcttttacgacgtgtgatgctgtcgcgcgcgacggaagcctgaaaatcgctagattcacaaacagggaaaagggcgctcctgaacgcgcagaaatgcagcatgtcgacatgcagttgtgtatctgggcccctcccctctcaagcatggacggctctgaattttcaacatgccgaccccgtgctgtccgagatgaactgccaggttaagttttatatggatgatttggggacgaactgatcccataacttaacctggcacagttgatttttagtcacttaattactggacttctttgaaaccttctagtcacctagtcgcaagtggcagaggaggctagaatgcatgcagagagcaatattcgtggtttcattttcagtgaaagaattcatagaacaatgttcaggatgttgaacgaagctgcgtccttttgtcaaaagattggactatgatatgatgaaaacaattctttgtacatgcagtcacacttgaccaagcctactagatgactgaatggtgaagtactgccttgattattcaacagcaaaattattgcgatggcttatatatgctagattcttcttctcaaagaaaaacaataacaaacagttctggctgagtcaccagtgaccaataaagattcttaaattccgcacaaaagaacctctatattctccctcccaaaaaagaatatttagaagaacctttcgtacgaacatcagttacagaaaatttccacagtatattagtgactcaatctatgctagatgtatgtgcctacggaaactgtggccttacttaactatatcttctctttaaaaaatcaagtaaaatactcaagggtatcatccaattgtcgccaataaagattcctgtaaaaaaaaaagtcgatcggacactgcgggaacagttttctgatagtcaagaagaagggaagaaaacgtagcatctctagctaatttcttatgacaaccgacaagattttcttttatcttaaaaaaaaaatctaccgcaaacaatggattcagtttctcaactacccaacataaacttgatgcggtgttagctactcaagttagcatcaaccaaacggagaaaacaggtcaatattttgttctctggacaaactaattcaactcccgtacaatatttaattttaactacacatttatttatgtgaagaagaaatcccaaataataactactaatgttttaatatgtcgaggatgtcttgtagatagaagataaactaacacactgcagcgtttctcaaaataaaaacagacacattgcagcggtgtccaaaaattttagtacacaaatgtagaagtacgtgtatgatgggtagactattggtgcctcaaacttttccaattgtatgtagatatgtggtagtgtgggtaaaaatccgagctaaatgtttgtgccttgatgtacttaaaaagaaaacgaggattgctagaccacttaatgcaatccgaatgacatagttaataaatataatacccatacactcgcatgataaccatttccacaagcccgagctcaaatgcacaaaaggaacaaaccagcggtgctccaaccctgcctgtaggcaagaccaaggatccaggcacttgcgtcgtcgccctcggcggtgtgcaccccttccattcattcgagttggacacgagcgttgtcccaccaccgctagtatatgattgatgtcccctctctacagccacaaatgccgatgcactaagttcgtccccttgcctcgtgctcgaggttaccggatggatggtacgatcaccgccgccaaggtaccagacctagcatagtacctcgtaccaaacctgatatctctaggtatcagtcgttacctatagatatcaaatagtataggttaatgtggtgcaccgttacaccgccccactgcacaaagaggtgtgctgccgtgatggctacctcccatctcctcgcctaggatctccgtcaagcagactttgcctcccgcccctcagctccacccggtgctgtccactatcgaggtggcccctcgattgccttagggtggcgaggtgtgatcggcggtggtggaaggccacgtacagcgatgggtgagctcactgaaaaccagatgcacacggtggctattggcccggagggaacgaaagaggaagaggaggtagggaagcggagaggacgcgatgaagagcatgggggaagaagaggctagaaagttgagtaggcacaaacgtggatttcattaatctatacctgtagaagaacccgatattgttcttttgaaagaaaaataactactcgcctctaaatgatgactatgaatgaatcaacatttgagaaaattattagctaatgctagggcacatttggcaagggtgatttgaattagatgtgtcctcacttttcgtaagcatgttttccgacttgctaattggtacaattttttaaaattagatatataaaaatcatattaatctattttaatattttaaaagatagtactccctctatcccataatataaggtgtgcacacattccaatattcaactttaaaaacatttgaccaataattataataatataaattaaattttatttgctaaaattaatatcattggattgacatttaaatttactttaagatagttataattttgttgcaataatccttatagtatatgaaaaattatatgtcagagattaattttgaagactgtgccaagtttgactatgccatatattatgggatggagggagtacgacttaattaattatatggtaatcaatttttttcgtgaggctaatcagttcagccaacgctcatcttcatactcacactttagactgacatgcgggccgttgccactaaaaccactaacagggcccacatgtctggtggcattgacttttcgctgtatgattaaccagcatgaaccaaacaacaacagctcatcgtttcataagcacattgtctccagctacttaggcgggaggctctcactggctagtcctactcatgactcgtcgtacatcatactcattgctgactcagactcgtgcacatgcatgctagatctaagccggcacacgtgtaccagctgcttagccaacatgagtaatcaagcttctaccaattcctttctttacttgcacatcaactaatcccctctgcttaatttacttggacaaacaggagcccttgctgctgttttcccagcaaaggagaggagtatagaagaccacgaattaactatccatgcgtttggtgatggagtcatgtgctcgaatctacacgtacgattaggcagcctctaaacttttgcttaaaagccttaaactaagtaggcaaccgtcatacactcccaaatcataatgcttattccctccgtccttaaaaaaatcttaattcctaggttttcgtgactaacatttgaccgttcgttttatttgaaaaagttacgaaaaaatttaaaaagataagtcatgtataaagtattattaatgttttatcatctaataataataaaaatattaattataaaaaaatcatataagacagacggttaaacgttgaacaccagaaactaaaaattgagtagggcacctagatggccagccttttgcccacgaatcagacggcagcaccacatggttaggcacgcacactgcaacggtgtgtccagattccagaataggccaatcgtggagctaagctcctcctccaaacgacgggaatcatggcagatgttggtgctgcacgccatgtacagaagcacacacctagtgatgcggagacgcttgacgcatctgcagattccgggcgagacgcaagcaaaacaaccgtacacgtatgcatcaacgcacgatgggtcacacaactcacacacacagccttgcgctcgaagctgggcgggttttgtttagtcgagagcgtgccaggttgcgccttgggaaaaccgcgggtggagcttttgttttggcttgtgggagaaacaccggctagctagctccccacactcgagtggctcgacaaatactagtagtacgcctctttgcgcaattgcacgcctgcttttaatttgttgcacagagaaacgtacgggagccaatggggtctcgcgttgccggcgaggcctctttccgggaagcaggcagcggccattgtcgagattggtgcacggctttttttttaacctgcaacttcacggagaagcgcaaagcggattctggcgttattcacctcgagaggcctaagagcaactttaatagcataacccactgctagctccaaatcatctatagccaattaatacaatagttgtttactatactattaatacctgatcccatatatcatacacacattacgtcttagagtccgtgatgcagctggctatagctatagatctgtagtccgctgctcttctctttttctttatctctctaaaatatgtttatagctggcttatagactgctattgtacatgctttaacaggatggcacattggcaggaaattgtattgtatgagtggaatgcatcgaatggctgcataaaggagatggtttgaattgtcgctgccacgggcaggggcgggcatggacggtgcccgtgcatgcgctgtcacggcccccgcttcagcggtctgacacatgttgggttcatgcatccgtccgcgacgtgtcgcgctgcctgaatcgctgtgtccctggagttttctcttgctttcggtgaaagctaggcaacagaaactggagaacggatatttttgctgcagtaattccttgcgaggtgaacctaattttctcgtaaattagtctcgacctgtacacgcacaggcgagattgattgttctcgtaaatagttgaaactgtaactggggatgaaaaaaaaatcttaggaacggctccgttggggtagctatgttttctcatcacaactctgatgattcccatggccatctgatctattggggattttccacagcaaattgattcataagggacataccctaattgcattagagtacggtgaaatcgcgatcatatgttacttgaactcgtgattctgctaaaaaaattgcattgtaggaacttggaaactttaaagccttcccaactgctttggatttacaaagtgatgatacactcaggctctaacgcgcacgctggcgcacaaacgcgacacgacccgcaaaagggcgccaatctgagagccaagacaaggtcgacccgagcgacccacatggcaaagatctcatcttgccgatgaacttcctcagactcttctccggcgccgtcgggcatcgcggccttggagaaatcaatctccttcgtcgccgcatgttgatgcgtggcttagctcttgaaatctcgtctggattcaacgccaattcttctcagctgatcattatattatcgacgcagcttgattagctcgccacggacaccttcctggtctcccggtgcccgcgccgcgaatccgccctcccggagtactgctgctgctgcctccgtccggccgacctcgcgtacaccgcgtcgagctgcatctgctcgtagcggcactcctcgctgcagaagggcgtgtcccccttgtacatgaagatgtcgctgtccctcgtgagctgcttggtgcagagcgcgcaggcgtccagcgcgtgcctgccctgctcgcccaccggctcggcgtcgaagaagaaagcgcaggcaagagacgccgccatggtgatgatgtttatctgagaagcgttttctcggtggtttgtgcttttggctagtgggaagaagaagcgaggcgatgagttgttggtggagctcgaacgagtgggagtgcggggattatatgcgcagctcggtggggcgtcgcgtcgcgcacgggcgggtgggaggggagaaaaccgtggttccgcgccgagctgcgggcgagacggcacacgggtcggggaggcgggttcgcgcgccaaccggaggcgggatggtggcggttcgtcttgtctcacttttttttcaattcgggcctggaccacggtgccgtgtagtggttgggttgggttcggcttggctgccttgatgggcagcgtcaagtacgtggcggacgagaacgacaggaatctagagggggggggggggggggggaaccgcaccaaagacgtccctgttgttgttacagggacgtggagtcagtactcagtaccgcccaaaaaccgtgggctaggccattactcactgctctatcagcaagtggtgataatgcttgcggcttgctacgctttctgcagcaaaagcgaggtgcaacaatatattcgcggcaataatcaatcggaaagcacttggcgcggctctcttagtcggaatcgtgtgcatcagcatcaaatctacatcattacacggccctctaaacagcggcttataaactaatcatgtgccttagggttgataattagcgcgccagcctttttgccaacatatcgggcaggcacccgcacatggtttggcacgctaagagcaagtttaatactatagcccactactgtcttcaattcatctatagtcaatctaatagctcatttatacaatagttacatagtacactattaatatccggtctcacttgtcatacacacgctgcgtcttggagtccgtgctatagctagctacaaatctgtagcccgctgcccttctatctcctcatttatctgcttaaaatatatttgcagctgacttatagcctactattgtacctgctctaataattgagggcaattgcttcccttcccccactgcctggtttgccccacctagcaccatagtagtagtgagcatcgacgtgagctttcaagaaaaaaaaaggaaattcagggccttctcttttctttttctccttttttaattgtgtgctccatgggaatcttgggcgagtgtggcgcgtgcatgcacgccaggtagcaccgtgtgaacagcaagttggatgctccgcaagttggcacgtattctacgtactaattccccttctttgcaagcgaaccgtgcagcatcggtgatttttaatagtgaaccctttggagagaagcatatacttaggggtgtttagatggggttaaaactttttagcccatgtcacatcggatgtttggacgctaattagagtattaaacatagattaataaaaaaactaatttcataaataagagctaatccgcgagatgaattttttaagcttaattaatctataattatcaaaagtttactgtagcatcacattgtcaaaatcatgtcgttattagactaaaaaattcgtctcgcgaattagtccaagcttatggaatgagttttgtaattagtgaatgtttaatactctaaattagtgtctaaacattcgatgtgagagggacttattccaagtccctgaaaaccaaagagccccttaggcagatgattatatttgctgtttcattagccgttagatctcgccaggtttcgcctcggcaaccgagcacgtttttttcagcggtagaagtggtcagtgggggaagcacctcgcagactcgcggttggcacgccacgagattccattggtagtttacggctgctgccctcggcccgggaaaacgggagagatgggtggcatccatggcgttgccggccggtcaggcaggcaggcttcgtcctgggaggcagcttttctcgagatccgcgcgctgtttagtttaagtgcactaggcttagcactgaagcattgcacgtaatcatcggggtttgcgaggtaaatctcgtgatggagatacgcccgtactactaaaatcctcattagtgaggtacaaccagcataatttgtgctatcctcacacagattaagcagcatgcgtggtgagaaatgtttctacgtcgcggtagcaggacaggtccctccagtttgtcgattggaagtattcgcctctgggtcacagatgttgggcgatgagtggggatcacataataaaaagtggtgctgcatctgatgggcgtgggcggcgtcgttacgtgctgctgcatccgcaccgagtcacgctctgcctggtagcaatcggacacatgttcggtcctactacagtaggtccagccaaagccgtgacgcatcgctttatttggactcagcagcgtgactcggtgatgagtagggtgtgagcagaggagttgaaacgttcaatggatctgacgttggagcccctatcatttcctccactttggtcttttctttagttgtctaagtggttgttacctcgcccactgataatccaattttcttaagcagcagtttacgtggcgttttctacttaaaaaaacaacaattagcatcaaatcagctgatttcccactttcttggcacacatgatcagtactactacttcagtagtgttctcgtttactaccagttcatggaaacaacgccagactgaaggagaaaacagttttaccgctcgttcactaaaagaacagtttaaagtgtacagcttcaaagcagcagacgaataaacagacttgctcgaataacagacttgctttgagagcttgcagcgtttgacagattttttatgagggctcaaattatgaaaagtcacgggtgtttcatactcctaaaagagtagacacaaatatgattctgctcaaaaaattatggctcaatagaacttctcggaatgcctcgaatatttacagcggaattgctcttcacaccaactcagatcagctcctcatacaaaaggagccaaccaaaaggggaaaaaaaagagaagcacacatggcctaaattaaaccatggtgcctggtgaatctcggagtcccttcctcagatccgtcctttctctgcttcgactccgaccagatccatccatcggcacagcggccggccagacatgagcaagaacaactccttcatcacatcttgcaagctcacgctcgtctacctaaggtatgcagctcatcaacagctcgccacggacacccccgccttccgggacacgggcgccgccggcgcggtctcgtgcctgctccgctgcccctgctgctgctgcttccgcctggcgctcgcggcctgcctcgcgcaggcggcgtcgaggtgcatctgctcgtagcggcactcctcgctgcagaagggggtgtcccctctgtacatgaagatgtcgctatcgcggcgcagcggcttggtgcagagcgcgcaggcgtccagcgcgtgccgcccggtctcgccgaccggctcggcgtcgaagaagaaggcgcatgcgagggaccgtgccatcgagaatctcccaagcttttcttggctttgcaacctttttttgcttgtgcttcggagaagagagtgaagtgaggaggtaaccgtgaaggggacaggggcggggtatataaccatgcgggggagaggtaggcgacaaagcagcggcgggggtgacgtggtgcggaggcggaaagtggaggagagtgggggaagggggggaaaccgtgggtggttctggaaaaccggtacgcgagacggcccaccggctggggaataccagagtccagagccaccagcgtggcggagacgggacctctttttttttttttttgtacgagtagtggcttttccgtggcaatggcccagtggtgcagccgttgggcaggtgggctccaccgcgcggaaacgacgaaacagcgcgttggatccatcgtgccatggactcatcttgacgtggcacacagctggatggcttcacgagcagacatgggaacactgtactcctacagtcctactaccagcaaatctgttgttgctagctggagtcgcctggttcaacgagcgaagcttagcttccgctttgtaacacaaaacagccgggcctgaggctaacacgaccaacccacatagacccatcaaaaataggttgatgtgggctgcttctttcgggtgggttgggctgtttgcgtaacacctgtaataggaataagttcaccggaggtccctcaacttaacagtgagatttttttgagttccctcaaccacaaaacagaaatgtatacctctagactcactaaaaccgttcaccggaggtccctcggcagtatttttacccggttttgctgacgtggcatcctagtcagcaaaaaaaacacgtggggcccacatgtcagcttcacatcttttttctcctcttttcttctccttctctcctcttctcttttcttttctctctgagcagccgcgcgccgtggccgccgtcgtcgtcggctctccaccgtcgtcgtcgccgtgggcgaggctacgcggcgcggccgtccggcggcggagcggaggcagcgggcggagcggcgagcacggatgcgggcggggcagcggagggcgagcgcctcaacggagcagcggaaggcgcgagcgtggcggcgggccgagcagtggagcgcgagcaggccgcggacagagtagcggagcgcgagcgcggcggcggagcggcggcgagtgagcgcggcgaccagcgagtttgggagggagggggaggcggccggcgaccaagaaacaatcgcttcctctgcctcttccccttttcccgccagtggtgcctctcctagcatcgtcagccacccgcgggggcacggcggtggtggcgaccgagcacgggggagctcctcgtcccttccactgtcttccgcttcgcctagctcgccctccgctgctttgcccaccgctgcgctcgcccgccgccgctcctcggccgcgctcgccttccgctgcaccccctgcatccacgctcctccgctgcacgtaatggcatatatacatgtgagtgtgctcagccatatacacatgcttggctaatatatacgtctgcatgttatcgggcggcaaaccaacaagaagctagctaggctatagctggtcgtctccatgcatgcatatatatgctcatacgaagacgcatgtacatgcggccgtctgtacccggcgtatatgcgtatgagctacgacgtcaagtgctaccgcgaggtcggcgaagacgacgagggtcaccgcgcccgcgccgaccaccgtccacgacgccgatggcacgccgagcgtggacacgctcctgctgcagctgcgcgagctgggcgtccgggaggaccatgggatcaggctggcgacgctgccgccgccaccactgccgctgccgcggcataggaggagcgtgagcgactggggtgcatcatcagccggcactttgaaccacctatgcacggccactgcgacgcctggccgatgtcgccgaacggccgcgccgtgtagcctcgcccacggcgacgacgatggtggagagccaacgacgacggcggccacggcgcgcggctgctccgcccgtagcctccgctccgccgccgcgctccgctgcctccgctccactgtcgggctcgcccgccgtctgctccgcccacagcccgccaccgctctgctgttgcgctcggccatcgcggctgcgcccgccgccagcctgaaggagaagagagaggtgagaagagaaaagagaagagaaggagaagaaaagagaagaaaaaatatgtgcagctgacatgtgggccccacgtacctttttattttttttgctgactaggatgccacgtcagcaaaaccggacaaaaatactgccgagggacctccggtgaacagtttgagtaagtttaggggtagacatttctgtttttgtggttaagagacctcaaaaaatctcgctgttaagttgagggacttccggtgaacttattccaatgtaataacacttgtctatctccacattggacgttttgacaagaagtgggtcgtatgtgtgaggataacacttatctatctccgggtggaaggatatctttgtgtgaggatataacaagtcccaacagacagatcccgttaacttccaatggaagaaggcctagcaacatctcttctctactacttaaaaaatctatagtggtgacggtaactccatacacgcggaatatggatcatgggatcgggagatcagacggtgctgagggatcccatcgcacgcgctcctcccctccgcctgcgatgcatcccctccctgagggatcccctcacggtcctccccctcgactcgcttttctccccacaaggcagctcgcgctcgcgaacccgccgacgctgctcctccgttagcccccgttgctccgcatcacgcagcaccgcgcccccgcaacccatcatccctctcgtcgccctatctcctctcctccctttccctcttgcattgccgtcgctgccgccgtcatcgtcgcgtctcctcaccatcgatcgggatcggacgtcggccagtccctcctcgcctccatccccaatcccctcgccctcttgcacctccatcacgaccaacgcacgccacactagcgccgcctcgccaagcgccacgacctccgtcccgcgacgccgccacatccccaggtgcccatcttctgccgcccactgtcgatccctcgtcgtcgctccacctccatagcagatcccctccctggaaccccctccccttcccacacaccactccctcccattgacgcaccttgatgcacgtctccccaccttttgcccgatcgcccccggaacggatggatggatgcctccacggccacgctgccggtcatcgaagcgccctggccacctccgtcatcgtgtcttgcccgtctccttcgcgatcagccgtcccacccggcgtcgacgccgggagtctggagggactctccaattggtcctgtcacctatgatcttggtcctgtcgatgtccgcctctgctacaccacctatgattttgggtatggaataactgatttatcttgtgatggttagggattcatgttttggatttttttttttttgctttgattcccttcaagctaaggaagaagtttgtacttattcagtgtttcagtatgttgtatctagaactacaaatacaaatacatgatatggttgatgatctgcaattcttcttcactatatactgtctgtgttaatcttttagattgaccaatttgggattatcagaaaaatgtttctagattatcagaaaatgtcatgaagtcttgtatgtttctaaattatcagaaaatttccttcaaaaaaaataggggctattgcattcttacccctattttgaagttcaattgtgattttgccctcgctttttagggtttgcgtttttactcctacttttttgaaacgaagtagagatttgtccctggtttggatggtcaatttaacggggttaagtcgagcacgaaaagacttttatgcccttgctagctattgcatatttgcccctactttttaaacaacacttgtctttttacccttattttgtactgagctttcgtgaaatgattcaaaatccgtatgaaaatctaatggcgccacattgcatgaacatgaatgatgtctatgaatggtaagttcattaacatcctgtgtcttactgcataagtgcatagtatcagccacatcaggtatcttcatgttggtcaagtcctttcgatctgatgaacccgtcaagagcaggattcatcaccaatggtttgccgctccgaggagtcgctgccatcgcctgctgctcctgccatagcgctgaggatcgccgtcgctgccaggtactcctgccgcctcctgctgctcgcgacgccgtgttgaggagccatcaccgccgccttccggcctcgccgaggagttggagccgcagcttgctcctggccacgccgaggagctgcgccgccacctgctcccggccgcgctgaagagctgctccaccgcctgcttctggcgccgccgcgccaaggacttcgggatgggaatggatctgggggaaggaggatatcgaacatgtactgatgcacacccacatatattacttaagggtacaatggtaatcccatatttccaaaattatttttctcttctaatttctctttccttaactgaatattgtgggacccacctaactgccatccatagtaggggcaaacggcaacttcgttcagagaaagcgggggtaaaattgcaaacgctaaaaaactgagtaaaatcacaattgagattgaaagctggggtataaacacaattctcccaaaaaaatattatgagaaaatgaaagtgttgtaaacatgactgcttgttttccattgccaaacagactccattttggattttattaaccaatatagtctgtattgtcctggttattacaacaaatcacttgttgctctcaagtgcgagatttagccatcaaagctagatggagtaaaaagattttgttgtttccaccatcctctgcttttggtagatggagtaaaaagattttgttttaaacctttctgatggttaataaagctgttttttggtgatccattaagctagcagcacttaccgtggactgaagatgctgattaagtcttctcccgctcgcagacaacacaggtctggcttcctctcagccaatctctcccaacctccatctccaaggtagcatcactattttccctttctttttattttcttgtgtgttggctcctagcctcctacagacagctgcggaatcaagaggccctatggctgtgtatcttaatgtttactcgatttctgctcaaaatgtttcctcttttatttataagagactgcagccatcttgtttgatttcatttcctttttgtctattcatttttcagtgcctggtctaataattcagaaagatagctgggtaaacctgcatagaattttcaaattcatatgaattctaattttccttccgggggtactatggccgattcaagaagtgtcccacagaaaggtgtgcgtccttcactgttcaaggttcaaatgaatcctcacgaaatgtaaaaacaggtgacttacgacatcattgattggtgaccctgttagattatttttcttttattgattatggtgctgtagaaaagaggttttgctgtactaacattgtataggatataataccagggccaaacatttgggtggtttgtattaatgctcttctttttctagccaatcacttcattcagtttgacaatatgtatatcattttttgtccttaacattagaatggtaatgctttaatgcagccaacttttttacaaaatattctaagcataatttccaagattgccttaatgaaatgattgtcagacatagatgcacgtgcctttttcttgcattatgaaatgtcagataaatttatttcaagttactacttgcaaagtcgtcaaatcttagtcgagcaaaagtcagcagtacacaatctgcacatatacggtaccgttcatttcgagcaatgtctatacatgaaagtccttttttagcagtcaattccatggtccctgcaagtgtacattctatttgacaatgccacgtttattatgattttgcatgcttatgcatgatattatcaagctgatacttcgcaatttccagatttatcaagttttgagttaaatttctatcaaatattggttatttacagtgtcaggttgtctaaaacaaatacatgatttttctgattgtgtccacattttggagttgtagaagtgcagggaaagctaggcaaatcagttgagagaccgagaagctgagcattagatggatttagggcactacatgcctttggcacttcttaagccatagccacagtattgatcaaggagcagccaagcggactgtggcttgaggtgatgtcctctgtacctaataaagaactcagctccagatttgatacagatcttctattgcataaaatacttttgtattcaatttgatttcatgaagcatactgatcaggaattaccatgttatgccaattgttgaatccatttttttttgggtgcaagtttcagtttgtcaaaccttttctcattcttttcatgccagagcaagaaagcatatgagatgtggataaacaaatgcacgcacaatagtattttggtgactttatttggatgtaatatatcttttaatcccaaggaaagaggatatattattcttctgacatttatcttctttcacatatggttatagttccttttttttgcgccattaacttgtgaaggtttagaacttagaaggtcaaggttttcttgatccataggctgccttgaacttcatagatggcatgactatccaactttattatcctaaacaataatatagatctgtttcgagcatatcctggtggcactgaacagtgtaagagattaagtgctcagctaggcgttcagcagtagcattgagtgtaagttgaatagcttcatgttttgcattcaacttatttgttgtattgcgtctaaggagtgagtgttagttctttatatttctgaagactagggtatggattatctggagattgtcaccaaagtttagcatattttaataaagtttataatcaatttatatgagatgtgatatcgttgttctcttttactatggtaggggctaacgaaagagagtggatttcatcctattatacttgtgcttagcatcagctcacagcatttgctacagttatcaacaactggctcagtaagggagggccggcggcacgtgaggcggtccactgctaggcgcaacaagctcacgaggaacaggcggcaaggtatgtgcatgatgcggtctgcacggcgagccacacagtttgctcgaatgggctggcgctgtgagctgcagggatgcgagctatggaagaatggatgacgcatgattatgaatcctgaatatcggtgatggtccaatattcaatgtaatcaaatgatgttcagtttctcacgaaatccattgctttttacattttgtatttttcttctgtcaaaccagatcaagctgtacaagaaacaaagtaaggcagattttttttttcagaaacttctttgcagcaacttacaatgtcgatataaagttgtcttgctgaaacttttgttgatataaagttgtcttgctgaaacttttgttgttctagttggtaatgtatgaaaaaaatataaaagatggacatagttattgtttttgttatatcaaggttttctgttgcaatcaaattatacttaatgcttatataacatcattttacccggtgatttgaaattaatgcatatttttttcccgttgcaaagcacgggcacccaactagttaatgaaagaaataagttcactttgactcccttaaatagtaaccgaatctgattcgtatccaatactagctcgcatcattgctgcttcatcttttttccccacagtaaaatcagcgaagtgacggtgcaccgacgcccaattcctcagcgtcatccgcccgccaccctgtaatttcccaccctccagaaccgcacaatctagcccatccaacgggcaggcccattagcacagaccaccacacttacactttcgctatccaacaggcaggcccattagcacataccaccacacttacactttcgtcctcgtttcgtgtaatatggttaacttgatatggttgaagtgttgatgcagttggaggtagaagcccttataagttgcttgcccgtaaccgctcgccctccagaaccacgcaacccaaacccatccaacaagcgggcttatttacacatatcactttacttgcactttcattcttctttcattaaaagggttaatatgatatgattggatggataagattttataagttgtttacattattgctaaactaccaatgcggtactaaacatgcacacacaactctcatgggctatgataccatatgtaatgacccaccatccagaacaccttataagttggttacactaatacaaaaccagtaatgtggtattaaacatgtcctcacaactctcatgggctgtaataccatttgtaatagcccaccctccaaaaccgcacaacccagcccatttgatggacgggcccacttacatgtaccattacatgtacacttccgtcctctcttcacgtaaaaggcttaactcaggagaaatgtggtactaaacatgtgcacacaactttcacaagccacacaatccacattctaattgggtcaagatgacatacaccctctccttctctagccgatggcactgccctatcctctcacgtgcatccgcctttcctttctggcttctaatagattgagttaatagatccaatcctcttttttaagagataaactcaatattttgtttgccctccattatcttaggttcccacaacccaagcaaataaaagtattgcctgactttgacatagataaataaagaatgatcacagtaagttctatctcagcttggtattatcagatgctttggttgttttttaacttgaccaagctttaatgaatatatagcaacattttcaacaaacaaatatagtattaaaatatattcatcttttgatttaatgcaactaatttgatattgtactcgctttttttataaactatagtcaaatttaaaataaaagttgattaggagaaaagttaaaatgtgttataatatgaaacggatgaaatacctaaaaacctaaaatttacaagccaaacagcagcctaggtaacacaaaacaaaatattccttgaaacaaaaactcgtcgctatcgctaaaatagtttcgcttgaaaatttgtttaaggcgctgttattttctccaacaaaagttggataaacttttggatatttgtggtacgcttttcaaactgataaacgatgtgtttcgtgcgaaaactttctatatagaacacaagatcatacgttaaaactcaattaatccatttttcaagtttgtaataattaaaactcaattaattatacgttattatcacctcgttttacatgaaaacttaatttttatcttcatgttcatcttcacgaccttcaaacaccacctaaatacagaaccattagtagctaagaaagcacattctttgaaccagctacagaagactaagataagtcagcatcgaactaccaagaaagaaattgagcagtcagcatcggagactcggtcaatgatgttccgctggtgatgaactgtatacctcttagctactggaggctacttgttatccataagttattttcacaactactcctaattgacacggtgagtatgatcgttggtgtgttccgcggaggattcggcgactattttagcatatattttttttcggctgctgcgagttggcgatcctattggtctgtggaaatgggcgcaggattactgcctgcacaggtacaggtgcacacacgccgtggaaaaaaattagcatcagcttggcagcttggacccagtaagacaaatcatgtactacctccattccaaaataagtgcagccatatatatccgtgtttagcgctttgatcatccgtcttatttgaaaaatttataaaaaaatattaaaaaaatagtcacatataaggtactattcatgttttatcatctaataacaataaaaatattaatcataatcttttttcaaataagacgaacggtcaaacgttgaatataaatagtgctaaaactgcacttattttaggacggagggagcacaaagtacaataagccgccagttttttcttatgctgttgtttgtaactagattcattaacatctaaatgaatatgaacaatgctagaaagtgttacattatgaaacggagggagtagtacagtaagtttcttgctggaatgtcaaaataggagtggacacatttagtatcagtgaaaattttcttttgggacagaagcggcgagggactgtcacgtaaacttatctcgcgtggaacctcccaataaactgcgaccattcgtactattacaactactgaccatgagagatcccaaagtccaattgaaactgaagggcagtgttccttctcttcaagctaaatatattttaaattagatttaaatagcgaaaaatataaaaaaaaacaagttcagatatatatagtgcatgcacttcacttaccttgattttcctttcataattaaatttacttgttcttcaggggacaagagtgaacatcccactaggtttagaaaagattcaatcaatcaaatactattaaagagaaccgaagtggttcgtttcacctgtttattttgtccttaaatcagtagtactcctagcaaacgccccaaaggccaaaaatctatcctgggccgaacggcacgtgccaaatcgttctgcgtgtactgcagggccgaatccgcgtctccgccgaatgagtaacccgaagcacacggcatagccgcatgggcgccagggtgggaaactcggtgcaccacagccgttcttgttccccccgcgcgatcccatcagctcaccactacaaaaagttttcacgcactcacccaaccagcaagaacgaaggaactaccacgctcgatcttccgctgcgcgcgccgatttgagctttacgccggcctacccaattacccaatccagcaagaacagcatatactcgtcccgcccatggcaggatcgactctgttccgatggctcttcttactgctggccatcgtgtcgcttgccgcggcggatagcggcagcggcgaagcagagaccaccgtccccggacaaattcgcctgagctgcggcgcgtctgcctccgccaccgacggggacggccgggcgtgggacggtgacgccgtgtccacgttcgcgccgtcggtgaccggcgtcgcggccgacgcgtcgtaccaggacccctcgctgccttcccccgtgccgtacatgacggcgcgcgtgttcagctccagctacacctactccttccccgtcaagcccggccgcgtgttcctccgtctctacttctacccgtccgcctacggcaacctcggcgccgccgccgccgccgcggacgcgctgttcggcgtcaccgcgggcggcatcacgctcctccgcgacttcaacgcgtcgcagaccgcgctcgcggtcggctacgcgtacatcgtccgcgagttctcgctgaacgtcagctccggcgccacgagcctcaacgtcaccttcgccccctcgccgcgtggcgcccccggccacgggtcccaccactacgcgttcgtcaacggcatcgaggtcgtgcccacgccggacatgttcacgacgccggtgcccgccttcgccaacggcgggcgcccgaacccgatgcccctccgcgccgacacggcgttccagacgatgtaccgcctcaacgtcggcggcgaggccatcaccccacgggacgacgccggcggtttctaccgcacgtgggacaacgacgcgccctacatcttcggcgcggccttcggtgtgaccttcgcgaaggacagcaacgtcagcgtccggtacaacccgccgtcggtgccgaagtacgccgcaccggaggacgtgtacgcgacggcgaggtcgatgggcccgaacgcgcagatcaacctcaactacaacctcacctggatcctccccgtcgacgccggcttctactacctcctcaggttccacttctgcgagatccagtacccgataacgaaggtgaaccagagatcattcttcatctacatcaacaaccagacggcgcagtctcagatggacgtgatagtgtggagcggagggatcgggagggcggtgtacacggattacctcgtcgtcacggcgggctccggccagatggatctgctggtggcgctgcacccggacctcagctccaggccggagtacttcgacgccatactcaacggcctcgaggtgttcaagctccacaagtacggaacccacagccttgccgggccaaacccgccgatcccgctgaagcaggtattcagcacggtggacggaagcagatcggagtccaggaagaagagcgtcgtctgcgccgccgtcggcggtgtggccgccggttgcttccttgcggtgttggttgccttcgccgtcgcgtgggctgttcgcaggaggcagaggaaggccgcggcggagaaaccggctgatgggcttcttggcccaacaaaaggctccgccctttatgacccggtccaaaaataaacaggccaattttttaagccttttgttttgataatattatagggtatgtatagctataattgggttaacatgaaagaattataaatgggcccaaaaacatcacatgctttggcaatttttcaaggagagaactatatattacctcccttaactatagcatgagctcaaatatttccctcaaccgcaatatcagttatcgcacatctctcaactaccaaaacttatttaattgagataatccaagaaataccattgacaagcgtgcaaatactagaaatgccatcgacaagtgtgagttccaagaatgccattgtacaaacaactctataccaaaaatgccatcgatcttaggattctgtccattccgcgccgttaagttctataggatgaacagtgtatttaatggcgcaaaatggacgaaaccttaacggcgatggtatttttgggacaaaatcgtttgtacgatggcacttcttgaaactcacacttatcgatatcatttatcgatatcatttctggtacttgaatgcttggtaatggtatttcttggattatctttatttaatttgtctccccaagcgattttaatgattattttattttattttttttgcggggaataattttatttgacatgacgctggcatgatattactttttttttttgggtacgaaacgctggcatgacattacaattagaaagaaagaggaaaaaatgggtctcagttgtcaatgatgaatgatccactcctgtcctaatttttatccctctgttttttttccctccgaggtctgtataactaaaattgggccgtcctgaaagaagtatattaatgagcccaaaaatgtaacatgctcttgcaatttcatctccatttctgtgtagcgtaactttccttctgtctcaacggcacgtcaataaggtgtgagccagatgtttggattaggttgtggtttgcctttcgcttgtatgggcgaccaaccaacaggatgctaacaaatttggctggtttcggttcagcatgcctcacaaagttggcacttgccacaattcctggtggaccaaccgaaatgcaaaagcccggggcaaaattttccgtgtgtatccaagcaagaaacctcctgcatggtgacagcatttgcctgtgatgtcacaggcgaattaggtcacttacggcaccatcaccgagatcgcattgtgatcatcctgggtaatcaatattagtacacgtacattggctggattttcctgaatagggcatagtgcttagtactagctctagctctgttcagtagtgtttctgaattgactaatcatcggtactccatggcagagaagtcttttttatttccatggcccgtcaagcaatcaagttccatgtgacgctcttttaccgtacgaaacaatcccgtttcagtgaaaattaggcaacctcaagcaatggtttcggtatggtctcgatgtaattttggtgtaactgaaactctatggcagtagtcttgaatactgtatgaaaggaggaccgttcaagttatgcctttttggattttggtagtgccatcctcagagtaggagagctactccattggaaagtgtaaggctcaacatcatcatgtcaggacaactctagtaagatcagaaagagtaaagtgaacgaagggaaagaaaaatgcaggcagctcatgctcatcataatttgggggaggggcactgaatgccatgaggcagcacgacacagaggcaggagaaatggagaattcatcgccacggcgccaaaacaaaccaaagtcttcgatcccttctccagacatggcacccagactgtgtgggtggccatggcgatagaaatataacccattgagaaaatccgcatgctaagtgtgcaaggcaagcaacactgcttgcttcctttgctttgggttaaaaggcacgggcttgattgatcttttgcactaacaaaaggggcctcgccacttgccaggatcggtgccaacacttcactctagtcggctgcgtactccaatactccatgcatgcctggatgatccattgatcctgctctcactgacagaaaaaacagggtagtagcagtcacaagtagctctgaaactgtttaattagtttccttctaaaatactcctgctaatagcctgtcattacctgtgatgctcaacaagtgacaactagtactgatatttatttactagttagcagtacaaacatcagtactctgtactcatactctcagcactgacgcctggtgggattaagagattgacctgaataatcggagatgtagccatgtttctacagatcattatcagcaacatacacgttgatttatcatgatgttaacacttgctgagttaggacatcgaagtatgtttgtttccctcttggattagtttctcaaattcccatgctgattgcacgtcataggtgcatctagcgaagcaagggacccacggtccgatacgtgtctcatcatagagttgataaacaccggacacgcaaattaatatttggtgccgcattgcattacagcatttttgtacaacaacgggtttgcgctgctttacgttaccctagtacttcaccccttgatccaacggcttttaattggttttacagtttggtgaaaggtacagcatgaacactgcggtacaggggtacgtgctgggatgcagagtttactagcatgttcaggtttcatgctaatctgctctgcaaacagaatcactgttgctgctgtaatgcagtatttttactgcggatttgattctttgcacgtacttaagttcactaaccagtgtacaacattgtactattgtgcaacaaactatcgaattgcaaacagttgagctgctgtctgctcaactgctatgcgaaattttccacgtagcagtagtagcagaatttcaggttgcaaagggcaggcagaggtagaaaagtagaaaccgagacgtggattggtttccaaggctgacctccaccatttctgggatctctccatcaggagagtgcaaacccgccactatttacttccggcctctgcatccgcaccaccaccaccgcgcactccaaagaaacccggggataaaaggcgcgagaggtctcattcccgggcgggttaagttaaaccattctcaagctaaggctaagcctcgccatggcgtccactctctcgtctccgtcgccgccgtctgccgatcccgtcaccggatcctccgacgccgcctcgtccttcctcccgtctctcctcatcatcgctgctcttcttgccttcgttctactagcgtcggtctcgatccacctacttctcagacttctgtccaggtcgtcgccgccgccgccgccgccgccgccgctcccacggacgcgccgtgaggtgcacaacgtcgaggcggcggacgcttctccggtgcggcgtaatggggtttgtgaggggaagaaggaggtggtgggcgacgagaagcagcggctgatcgagtcgctgccgctgttcacgatggcgtcgtcgctggcggcgctccccaagagctcaccggactgcgccgtctgcctgtcgccgttcacgctggacgccgagctgcggctgctcccggcgtgccgccacgcgttccacgccgcctgcgtcgacgcgtggctccgcaccaccccgtcctgcccgctctgccgcgccaccgtcacgctcccgcacccctcgatctccgccatcctcgccgccgagcagccgccgccgccggagccgaggagcagggaccgttccaggagcttccgcgtcgagatgggcagcgtcagcaaccgcagcgcgtcgacggccaccggcggcaacgcccgccccacctactcgctcggcacgttcgactaccacatcgacgaggaggtcgaggccgtcgtctcccgcgccgcgcccatgacaaccaggagcgccgccgcagtcaaggaagacaagccagcagccgagcagtctccaccgcctcccggcgaggcggtggccgaagcggcgggcgcgacgcgcggctggctgcgggagtacgtggaacggctggccacctccgcgtcatccctatcgtccttctccgggcggtggagctcccggtggagccagagctaccagagccaccatagccacagccaggaggagccatggctgtgggacgcggaggcggtgaggatgtcgccgccggggacggaggaggaggagacggcgttcatggtgctgtaccggtggatcgcaggggtataaacgtaattaccataaaaaggcacaggaaggctttcgtgtcaaattgtcatcttcagatagatagccttcatcaggtactcaggtgaatggtgaatccaatgttttggatgcttctgtgttgactcgatcgggtacaaactggtaggcgtaagcagtttgcaggcctctctttgcacatagttatcctcggagttcggattttggaaaccgaggagagcataattagcagccagggtaggaaggaatcatgcatgcaaaatattgttcttttccgtggacgagtttgatgcatcttgtttattttcccagagatgtagtagtagttgttgttgtgtactttgtgtgacttcatcatgtgtgtcacaacgtgtcagtcagagcaccaccatggaggcgcctggtgaaatgggaaagagtgccttggcatgccatgcgtggcggtagctatgaaacgtgaaatccaatttcagagttccggtgcatccatgtataatccagctagttcgctgatgctgcttatttacatgtgagctgcttgttgctttggtggcaatgccagtgcactgcacgggcagcccgagtgcgagcggccgagtataaattaagcggcagaaaaggcccaaatttgatcggtttcacccgtttctcgtgcacacgccgagtcgctgtgttgacggcagtcaatgtgtcaaatcgcctgcagcagcagctagctactctatctagctcgctgatgtgattcgggtcaccaactctatcgcccatgcatgacgagagcacaggtctcctggtggtcaaaaccacggcacaagcgttgctgccttcacgcaacgacgcacagatccgacgacctgcctgcccttcgatccgtagatacgatttggttttggtgcaacgattgcatctcgagcgaccgaatagttttaccatcagatcttgtcgtcattagctgcatcctgcatgctgaattgctgatgctttttgcttagcggtgccgtattagctaggtacgttacgtagcgaaatgcgcatgcgcaactttggtacggatgcaatttactgacgtacggtgtgagtaccggactaccggtgctgtcgaaacgagaagtgcagacaacgtttcggtacaggtacagccgtacgtacagtgcgaagtcacatttatattcgccggtgttcccgtacatactacatactgcatggctcgatcagtacggctcgtggagaggtccatgactttattgttatatacatttactaacaaaagtgttcatgcgttgcacctggtgattacggagcgtgtatattgaccaaaagtattgtttggtttagcaaaagtgcctctgcgttgcaacggaaagcgtacagatgagaagaatatgcaattaattaaaatataaattcactgaaatatttggtatctttaagtaggtatgtatacaattaaataaatttacaagtaaagtaagtgtgagaaataaaatgatatggttaaatttaattttattaaattctccatgattagtttcgctctttgaaattttattggaattttcagagcttaattgctaattttaataatacaaatatcatttaacaattatttaattggaaatctaatttaattttttgttgggccggccgacctacgtgcggcccatcactgatgcggcccgatgatggaggccagcccaacacgggacggctcagatcggctcctaatctatcaaaacccccaacccaaataaaccctaaccctaatttcattcttccccttcctcccctccacgcaggccgcctctctccctgctggcggccacgccacacccccaccggcgcacctctccacgctcctccccaaccggcgacgccttttgcccccctccccactgccggcagccttccccaccgagcagcggcgacgacggcggcagcggtggcgacggcacactccctcgcagcgggcggctgtggcagcacggcgatggtggcgccgctccctctccccactgccggctccttctctcctcgtcgggcggtggccaccgcaccactctctcggcagatccggaggtggcggcggtcgcgggccggtggcggctccctcctcccctctcgcctccctcctgcccctgatccggcggcgatggcggtgtcggcgggtgggtccgtggccgacgacgaggtggcgaggagcagcgcgctgcagcctccggtccggctcgcccctccctctcctagtcatctcgtgttaatatgatgttttctaatgattccgatttagatttggactgggattttgtgtttgatttggatttggattgtgatgatttgagattggagagaaggtgtgctcaatgtgggattctatttgtgtgatgatggaattccaactgggttttttgaggggggatgaaaaatcaccgtatggatgaggtgacgaccagaaaaatccgaatatttatattagttatagatatggctcgtggagataattatttttggagatggtctcaacataaaaaggcagtgttggaattgttgaacaacctactatatcccgctttgctgaccacatggaatgtcctctgggctttgaaggtaaacaatgcctaccggccttttttggtctagaaacagaggggaataagtccactttgactcccttaaatttgactcccttaaaagtaacccgaatctaatatgtgaccctcaaccacaaaaccggatagaacgactccctaaactattgaaaccagtgcaatttgactcccttggtggttttggagggtggttttgcttatgtggcgctgacgtggcgatgttgacctagttttcgtcccacgtggcgcttacgtggcattagaattaaaaaaaaaatctatggacccacatgtgattcacacataaaaaatattgtgggccccactgacatgtggccctacatgtcattcactctctccttccccttccctctctccccgttctctctctttatctctgtcacaccctgaagttctcctcctaagtctaaaattgaatttataaatcaccctaagaaaatgccggtgcaaatcaagagaaaaccttaataaattaatgcaaataataatcgaaattggcatgtggaattttttttttgagttctacatgtcgaaatacgctaacaagatttttagtggaattttcagagctctcgaaataattttaaccaattaaaattgagcacatgcaattttaatcctatgaaaaatcctttttccttctttttcctttttctttcttttcttttccccttttcctttgaataggccgccggcccattcctcctttttctccccctcctcccgctgggccggccgaaggccaaggcccagctaggccgcgcgggccggccgcccgcctcctctcacccgggtcgctgacaggtggggcccacctatcggacccgtctcccacctcgcgccgcgccgccgcgcccgcaaccaccgccgcgcccacgcctccgcctcctccgggccacgtcggccacgcccgcgcatgcgccgcacctcccgcacccactcccccctctccccgcgtcttccggccgcgcccgcgcacgagaagggcaggattcgattttgaatcgtccccaccttctctctctcctcccccacgtcgccggcgaaatcggggtgcctcccggccacgtccgcctccccctccgcctataaaatgctccccatgccctcctctctcgttttccgctctcaccgctccatcccgtgccccctaccgagctcgcgccgccgctgcttgcgccgccgcactccggccgtgtgccgccgctgctagagccgtcgccgcgctaagccaccgccacccctagcttcgccgccgcaagacctttcccggccgccgctttgcgtcgccggaatcccaccgaaaccccatctccctcgtgtcgccggtgagttctctctcccctccgactccggccggcgtggatggtcgccgtgagggtttcccttcgtcctaattcctcctctcttttccctaggtgtcgccgtcgctcttccgcacctcggcatcgccggtcttcgccgcctccctcgttttccgccgccggccgttgccgccccccccggtgaggtctccctccccttcctttccttccttttttttcccgtgcgccgccgccctcttcgcgcgctcgccatcgcgttcggccgtcgccgctcgcgccgccgcccgccgtccacgccgccgtttgccgtcgccggtggtcacatgcgcgcgccgccgctttgccatggccggccggtcggcttgatgccgggcctggccggtacatcggcccgtggagccggggccgtggggcccgcttgccagccgtgccctccccttgagccgctgccgagtggggcccacgtgccgccgccccttcccctctctcccgagccactgaccagtgggacccgcccgtcggcgccacccccccttgatgacgtcagccctgggagttattgcgcaataaattatttaaggactttttttatagtaataaacacagtgaatcttctaaaattcataactaattcatccgagctccgtttaagcccattcaagtctcagtaaatcaagaaaaatgtgtagaatccattaaaaatagttttgttctctgtttcagtagtcttatagcctgtttgcattgtttgctttgtatgtcgcttagattccggttcttccgacgctccggtgtacttcgaaatagtcgccgaggttcctccagcagcagagcaaggcaagttatgcttgtcacttgaacatgttgatcctatattgcaaatgctctattgtttttcttcaaatactgcatcgttttataatgttattatgggatgtttacctattgttacagccatgctattttggtaccttgctcctttgttagcttgggttataacatgaatagacattggactaggagttgcttagccatgcttagttcaactagtacacaatggggaaaatcctattaatgtttagactgttggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcatgggcaacggctgggcttgtagtgtagctttcctctagctgacgcatccaggcaagggtgggcgtgatggagcgggacgggccctgcgacggcctctgtcgcttccggattcacctaggcatgagaggggactgcccgctgccttgcgaggagtgggggtgaaacctgaggtgtggtgtgcttggttagagggggttatgcgaaaggtcttgtcacagcctctttacggtatgttgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctattaaaattggatagtataggtggatggttgggcctgtcgcaacgtggtatagcgttggacagtggatgattaatattgattaattattacaactgttttcttctttaaacttctgtttataaatgctcgctttatgcaaatgaaccactctagctctcctttgataattccctgcatcatacccctattccggtatgacttgctgagtacagtgggtagtactcagtcttgctctatttttcccaaccccagagtacgagtatatgtcagatggaggtttctccgaggagtaggcttcgtccgtgccgtcgaggatgcctgtggagtggtgttcccgctgcagttctagtcaaggcttagctcctgttgtctttcatttttccgctgcatttatgtaatacgtttatgatgtttgtaagacgtggatctgaatgtcaacattgtcgtttgtgtactccggccggtcctggacggggattttaatgcacattctgcttggaattctattcgggaatttctgggcgtgacaatctcccccctttctcttcaccttctctctcgtagcgtaatctgcaggcaagggcggcgacggcaagcgggagccggagtggcggcgacggcgatggctgacgcggcagcagcaggcgggcgccagcttccccatcgccatcgacctcgacctcggcgtatccgcatgcgtgatggcggcggtctctgtcacgcccagaaattcccgaatagaattccaagcagaatgtgcattaaaatccccgtccaggaccagccagggtacacaaacgacaatgttgacattcagatccacgtcttacaaacatcataaaagtcttacataaatgcagcggaaagaaagaaagacaacaggagctaagccttgacttgaactgcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatgatgcagggattcatcaaagaagagctgaagtggttcatttgcataaagcgagcatttaaaaacagaaattgaaagatttaaacagttgtaataattaattaacatcaactatccactgtccaacgctaacccatgttgcgacaggcccaaccatccacctaaactatccaaattaaaagattacactaaggtgagactaatcacggtgaatctggttgaccgcccataaccgcgggcacggctattcgaatagttttactctgatcagaggtgtacaactgtacccacaagacacagccccacgacacgttttcgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagatatactacaagtccagccgttgcctacgctggcttgtggtaagtacgatatgttcttccagggcatcccgcgaaccggtccttaactgccatgggtgcgaccagcaaaaccatgcacccacagcccaccatgtggtttattttaattaaccaacacccaaacggtgtcactaatccaacaacaccattggaaccaacagtctaaacattaatatgattttccccgttgtgaactagttgaactaagcatggctaagcaattcctagtccaaactctaatcatgttataaccccaagctaacaaaggagcatggtatccgaaaagcatggctgtaacaataggtaaccatcccatagtaatattataaaacaatgcaatatttgaaagaaaacaatagagcatttgcaatataggatcaacatgttcaagtgacaagcatgacttgccttgctctgctgctggaggaaccttggcgactatctcgaagtacaccggagcgtcggaggaaacggaatctagcgacatacaaagcaaacattgcaaacaggctataagactactgaaacagggaacaaaaccatttttaatggattctgcacagttttcttgatttactgagacttgaatgggcttaaacggaactcggatgaattagttatgatttttagaagatttactgtgtttaaaactatacaagaaaaaccttaaactatttattgcgcaatatattccagggctgacgtcagcacggagggagtgcggcgccgacatgcggggcccaccggtcagcgacccgggagagggcggtccacggcggatcgggtccacggaccggggaggagcggcgccgacatgcggggcccactggtcagcgacccgggagagggaaagaaagggcggcggcacgcggctcggattggctcaaggccggccaaccgaccgcggcgacggcgacgacgcgcgcgcgaacgcgttgccagcgacgcatgcgaccgacgacggcagcgaccggcggcacgcgaggcggcggcggtcgaaggcgacagcgcgcgacttgaagcggcggcgcggcactaagaggagaggaaggggaaaagaggggaggggatgcctcaccgagggtggccggcgcggaggaagacgatggcgaacggcgacggcaagccacgggaggacgacgtcggcgagcggacgagcttcggggtgccctaaggaaggaggagagagggattattgagagggagatgagccacggcgaccggaagccatggccgaaggcggcggtagaggtgatgctcactcgagtgcgagggaacgagggctccggcgacgaacctcgacggaggagaggtggacggggtggatcccggccacgcgaacccgacggcggcgatggcgcggcctggcggcgaccctaacggcggctagcggcggccggagtagcggaaacagcggctgcggatgggcgcacggcgtgagagcgatgggaggctcgagagagtacggcggaatggggaaaaagtgagaggggacgacggcgatgcttaaatagggggagagaggaccggacgtggccgggagaggcgggaatcgccggccgacgtgggggagtgggggaagagagagaggcgggattcgaaaatcgaatcccggccatctcgggcgcggacgcgagcgggagagagaggagagtgggcgcgggagacgcggcgcacgcgcgggcgtggccgacgtggcccggaggaggcggagacgtggacgcggcggcggtttcgggtgcggcggttgcgggcgcggcgtcggccggaggaaggggaaagacctgacaggtgggccccacctgtcggcgaccccgggagaggagggaggcgggcggcctggctgggcctcggcctgcggtcggcccagcaagggggagggggaaggaaaggggagaatgggccggcggcccattcggaaaaaaaaaggaggaaaaagggagggaaaagaaaaagaaaaaggaaaaagtattttccctggaattacaatattgctggctcaattttaactggttaaaattatttctagagctctgaaaattccactaaaaatccagttaatgaatttcgacatgtagaactcaagaaaaaaaattccacatgttaaatccgattattatttgcattactttcttagggttttctcctgatttgcaccggtattttcttagggtcatttataaattacaattttggcttgggaggaaaacttcggggtgtgacagtctccgcggatgcagtccataaacccagcctggcaatccggccaacccccacaatgctccacgggtcagcctcggcagaatcgagcagcagtacaacaaacacaccaatgtagcagcataggagaaggcgagcaagcaagaggatgtgtatagctgtatagctcgattacttcctgctcatcaaaaatcatgtcgagaaggtgatgatatgcctcgccttcgtcccaaggcaggcatcgctacatgcataccatcatggccaaaggcgaggatggagctcggcctcctcctggcgcttggcccaggggcttcgacctctatggctgggcgtacagtgagggactccatcggcaccacggtggggatactctttggcgggtgtgctcgttggcgccatcgccgccgctgtcggcactgaacgtgagctggcagatcaccgggacgctgaccgacttgacgttgcacgccatcatgggggagtgcggcttccggtggcatgaggagttcctggagacgctgggcgaggcacagaagaaggcgactaggttcggcgtcgctgacctgttcccgtcgtcgaggctcctccccgccgtcgggagccggagtggtgacggccggcaggagctgacacgggagctagctggagcggcggtggaagtgggctggagctgacggaggctaggaataatccagcgcgctagtcagaggcagccgcagccgcagccgcctcgttggaggtctgtggcgtggggtggtttccaccgccgcagccactcaagcccctcctgtcgccgcctccttctcctccgcctccacccgcattagctccaacccgccgccgcttcagctcccgctggccgccagcacttcggcccctgccccaccgccgctccagccgtgctccccgcggacggtggaaagggagagaaagagagaagggagaaagtgggggaggaagaagaaagagagaggatgacatgtcagtgggccccactttttttatgacaaatgggtcccacatatatgtttttaattaaatgccacctaagcgccacatcaagaccagagtagatcaacaccgccacgtaagcaccacgtcagcgaaaccaccatccaaaaccattaaggaagtcaaattgcaccggtttcaatagtttagggagtcgttctatccggttttgcggttgagggtcacggattagattcaggttactttttaagggagtcaaagtggacttattccaaacagagcccgagtacccaaccatacgccctctacatgggcaacggcccatcagcgtggccagattgcagcggtcgcggccgaggccgagagcccgataatactcgtgggccttatccgctaaacgctcatggggatcacggtagtctaagcccatagaaaacggcccatctgagtgggctaaatcgctcaggtgctggcggtagcccatatggtgatctgagctttttgttattattttttaaacaaaaaatacataaatataattttcttttacaaatttacaaacatcatactcctttcaccctatgggagagtttttttttcataaattgcctctcaaaaggcggttctgatggagattatggtggttgaatattgcgtacatgcctttcccatgctccttagaggcgacttttatatgccacccaacccaaagacagtgaaattaaggcctatatatgcttgcgagaaaaataacggtcatgagaaatttgcatagactacttttgttctctaggtgggcgggatatttaaaattattctctaggagtgtgataaggggctatacgcaaatgtcccatgcctaatgccacgtcatcagatctgccctctagaagggctgtttttaaagcaaatccctaaaaaaacactcccacggtgaaggagtattttttaaaaaaatttacagaagcgaaaaatatattcctgtaatttaaaatatatattaaaataaaaaataaatatttgagcttccatttgttagttaccatttttggaataaaaaatggttggatccataattttcttcatttaatgtatttcaagcatatcatgtatcgttgtattttcaattatatttttcaaaaggagttttataaagcaccctatgtatcgttgtatttttaattgtacatgcctaatttctcttttcgagggtacaaaaataaatcaaagacctataagaggaaaaggtgaaaaatacaggcatagggatttatgcatcagtctaatcccaaattttgtagcttccactcccattaatgtttgggaatccgataatgacatatccatgtttatgtatttattgtctttttttctgtaaagagatttagaagcattaaattaagcaaaacatatatacacgtacttcatttattgtggtgaagccaatagtgtgcacacacactcctacccacaccatctatatattcatgcactccttggctagatcacaaaacacacaccaaacaatcgagcacagcaaacaaaggtgaggactgaagcaagaacaccatggcttttctgagggcactctctcctctcgtcttcaccctgctcctcctactcgccgcctccacatccgacgcctccatcttggaggaaacctgcaagtcgctcgccggtaaccacacggccatcgactacccctactgcgtcaggttcttccaggccagcaaggagagcgccaccgccgacacgcacggcctcgccgccatcgccgtgaggatcaccgaggcggccgccgagggcaccgccaagcgcatcgccgccctgcgatcctcgcacaaggaggagaagatgcaggagtgcctccgcataagctccgacctgtacgcctacatgctggccgttctcggcaacgaggcgaaagccgccgccctggtggacggcggcgcgcagcatgcggcggcgtcgccgccaacgcccgacgtcgcgcggtatgtcgcggatggttgcgagggcaggttccgtgggaacaaggagaccctgccgctggttgcggagtacgccgagtttagacagagtgcgtccattgctctcgcattgatagaggcgatatcaccaccgagtgatcagtgaatgtgtgtttttactctcagattttgtaagccaaacaatgtagatgaataaacatggcaattatcaatctattgttttcctgttactattatctttgtttattttctatttcatttttatggccgagttttgcgttgaaaaccggttatgcttttgaaaaaaaaaagatgaagtcaccctttgctactttgtttagaaaatagtcattcatcgtcgcataagtagaatagttatctttgctaatttacttataaattaataaattgtgtgatttgataaaagtggattaatcttaaaatatgctccgctagctaatttgatctattgattttaactactccgttaattataccgtaaatcatcagttgagtgtgtttggcaaaaaaaaaaaaaagcgtcaacaatgttagtagtactttcgatgcaaagtataacagccaacaagcacttgaaatatagtgatatgctacctctacaccaaaataagtctatttttgagatagattaatacaaatacaaactaaaaagtggactaaaatacaaactattttatcaaactaagaagactaaaatactttgcacttgagatagactaaaataactctaatttattaaatatcaatgcaattatttcttattttatccacttccaatgcatatatcaaacaaatactttcacaaacttcaatgcaatgattactccaaaattaacttattttactagaaacggaaggaactaaaaataaacgtatccttctcttgagatagtatctatcaccactgttggcgtttgcaagatttgtgtatctacatcatatctgttacgggccttccagcccactgcccacgccaaattcacctctccaaactgcaaacatccggacaacggaatttaaggcccaggtggcaactatcagttattctcttatttcacgattattaagcagactctgtttcgtaataagagattttcgaatttcgaccatgaatttgtaaagggaccttttggaacttcccccgattaagactctggcagttcgacatgtggtgtctaaacatttcgtcatgacatgaaactatatagattagatttggctcgaaaggaacagggaccctgtcagcaggtggctgatcctaatttctgaagaagagcgatcctggttcctggatcccgagactcgcggcaggcgtgaagagactgcgagacacccgccaacgtttcagcaggcgtcatccaggaaatcctcttgaatgaatgaatgaatggtgtaatatctcgtaatgattccagtgcaatcaacagctggatcctcttttattgttcagagattaagatgacgatacctgctagtataaagttgttggttctaccacgaaaaaacacaccaaacaagtaaccaagcggcaccaggacaagaaaagccatgacgaccatgaagcttgtgcgatcgttctctcctctcatcgtcttctccttgctcctcctgctcacctcctccacgacgtccagagcctccctcgtggacgacgcctgcacgtcgttcgcggctagccacgcggacatcggctacgcctactgcgtcaggttcttccagtccgacgagggcagcgccaccgcggacaggtacggcctcgccgccatcgccgtgaagatcagcgcggcgacggccaggggcaccgccaagcgcatcgcggacctgcaggacctggagcgcgacaagaggaggaaagattgcctgagcgcgtgcggggaggtgtacgactccgccgtggacagcctcgacgaggcggccaagggcatcgcgtcgcgcagcgccgacggcctgcgggacgcggtgaccgtgctcagcgccgcgctggacacccccgacacgtgcgaggacgggttccgcgagctcggcctggcctcgccgctggtcgccgaggacgaggagttcagcaaagagtcggccatcgctctcggtgtcacatcggccttatcgccgccgagctaggatgacgtcacaagagttacagcgtctgtaatcctataaatcctttgcgtaataaattaattactctggaaaatcacaggacaaaattacattttctcactaattccgttgtcatataattttccatttttggaagaaactggttggattccttgtgcacctattctgagaccgatccggccattagccatgagatgcacgtacgattgttgtttttttcccagtggaacgcacacttaatttacggcatatcttgtgaagaaattattgcatttcagctaagatataatcggccggcatctttgcttaaaaaacaacaatctgctgggccgttccaacggagattggcagctacctcgccctgtaaacgtcatgcacgtctccacggatcacgacgtgacggcgtccgaggctccgagccagcggcggcgcgagctttggtgatgcaatttgttgggctttctgcttgccttacctgggccgacctgtatgcacgaattgggctaaattcccaaaaggaatccaaatctcccttcaaaaaaaaaggaatccaaatccttttcgttcccgggggagagggataagggatgaagatttgttgaatacttggagcaagttttatagctaatttcatgcataccatataatagtaagaggtaatatgtatttccacatttttattgaagtttatgtaggagttgtttcttccatgagaggtggtactttctctcttcactcttctctactctatctacctcaccattagtccaatgcgatatctttgggtttgtagttagatgcctgtagtacttagcgacaacaacagcaagctcttccactttttcggtgttgacgatgatagatatttggattaggatacgggtgggagaagaattaaggtgagggaaagatgcagtttttcgagcttagagaaatgactaaggagcagggagatggtaaacctgtggtgacatatatgacgtgcgacgaggcggtgttggcatcatagccatgagattgatggtatggacatgggatctagagtagttaggagatagaggcaatggtagcatctccaatgctaggggccgctgaagacaaaaaaaaaaaaagggcaaggcaagggcggcaagggcgcctggccgccgcttaggcttagagaggagaagcgaagggagagaaagggggtgaaagggaggaggacgattgagctgggctggttagcatctagatagcgcaagccatgcaaaggggggcaagtgggtgaggatgggtgggcagtggcgcaagggttttatccaagctttgcgaggagagatggtatctctagtatgacagcacgaatcatgaagtggtattggccattagaaacgaccgaaatttaggcatcttagtgtgaccaaaactatgcaccaaaccaccaaaggaaaaaaaaaaccattttattttccgaactatttcattggttaatggaatagtaaaatagacttttttttcctaccaagtattgtcagcctatggcccaggtcatactgaaaagtggattttggcccacccgtcgtggaaagctaaagattcggcccatgcacagtaagacgagacaaatgtggacgacgtcaacgtgcacaaaaccttctcttctgtatcggccgcttgaagtacaactttccgctatcgcggtgcgcgcggaaggccccgctgcggcacgtaaacgttcgtcgtgtatcgcgctttaacccggaaaccgtggaaacccgcaaaactctgcatctgcataccgctgcaaagcggaaaaggaaaaactccccgaagcgcgcgacgacgacacgagcgcggccgcggcggtgaaacgaacgggcggaccggttcttcttctcccgctggtctccggcccctccctctccaacacctctgcatgcccagcccccatgcatgccctcttgttctctccaccgcgaaacatgagcccccgcaattctcctttgccaccacaccctgcgctcctctcgcctcctcctcctcctcgtcttcttcctcctcctgtcctggatctcacagggtggcagttcctcgaataaaaaaatggcggacagtaacgccggcggcaacaacagtagcggtgccgcgaacaacgccgaggtccagataccgatcccaggtcagtctcagtctggtccgctctggtcgctgttatgtttccatttcatcttattgcatgaagggttagggtgaaaaaaaaacatgagaagcgggctatgcttttgcgttccaatcgtgctgtgcacctgggaagcacctgtgctggattatccgtgaacactcgtgcgaattgatcattccgttggtacattggggaaatttttagggatgatctgtttttagcctttgtgagtacgatttgttacacttaaactctgttgctcttacatggacctctattgcatcgtgttcagaaactttcacccactgatgaaatgtaaagcatcattaaaaaaattttacctgttacgtttggtactaactttctaccatcttcattacaaatcacagctccatccaaggctgaagctgcagcagctccggaaacaccagcaggcaagccatttcgatggtgggcgatggtggcagtggacgtcttcttcctcatcgccggtcagacatcggcgacactgctgggcagatactactacacccaaggcggccgcagcaagtggatatcggcgttcgtgcggacggccggcttcccgatactgttcttcaccctcttcttcttcccctcgaagtcaccgtcctcctgcaccaacactcccatggccaagctcgccgtgatatacatcgtcctgggcctcatcatcgccgccgacgacatgatgtacactggtggcctcaagtacctccccgcttcgacctactcgctcatctgtgccagccagctcgcgttcaatgtcgtcttctcatacgtgctcaactcccagaaggtcactcctctgatattcaactccgtcgtgctgctcaccatgtccgcttcgctcatcggagtcagcaaggagtctcagggggtcaccggcgtctcgggagggaagtatctgctcggtttcgtgctgacgctgggggcgtcgtgcacctactcgctgatcctcgcgctgatgcagctcaccttcgagaccatcatcaagaagcacaccttctcagccgtcctcaacatgcagatctacacggcgctcgtggcgacggccgcgtcggtggtcgggctgttcgcgagcggcgagtggaggtcgctgaggggggagatgaacgcgttcaggtcggggcagttctcctacctgatgacgctgctgtgggcggccgtgtcgtggcaggtggccaacatcggggtgctcggcctcatcttcgaggtgtcggcgctcttctccaacgtgatcagcacggtgtcactgccggtcatcccgttcttcgcggtggtggtgttccacgacaggatgaacggggtgaagatcgtggccatgctgattgcaatttggggatttatttcgtatctgtttcagcactatctagatggcaagaaagcgaagaaggcttcatcgggtgatagtgcgcaggggtgatcagattaggtggccacagtgatattatcgtggtagagattgattgctctccgccaataatcttagctagttttgttggctgcgaggtactagatgttcgttacttatgttatgttgcaggttgttcgtcagataaaaactagtacgtactttgtttttttgtgttgccaacgtgttcagatgtacaattttgctggattactagtagttttcttgttcttttcttcatgtgcgtttgtgtaagggtatgacgcataattgtatatcacgaaagaatagaaatagtagtactagactagtaaagaactctttatttgcttcgtcctgtcttatgtcaggttgatcctggtggctgatggacacgaataatttggtactacttctatttcagttgtggaaaacaattagtatctgattaaactacatctgaatctgacacttccgcagaatcttgggtgaagaacaataattggcaatctttgtactcttttgtcaaattggagataagattgattccgtctggatgcagcgatcgacgttgtcctcacttggaaattttggcatcgcacgcattgaattttccaagaggcaggacataaacattgactcgccggagtagttttgaaacgtttgacggcaaaattagccccttgcgcatgccctatcaacccttttatctttttatcgtttcattgattgatgacgactccaagttggcaagtttcagccttccgctgctgctggacgagtggatgacgagcactaggcccatcttgttgtttatcctttttctgaacctcacaatgagcgatgctactgaaattcagctgcagattacaggtctctctcggtcatgaactgccaaatcgatcacagtttcgaattgagatgtgatgtgagatcgatcgaaactagtccagtttttatactgatgagacggatgattcgtatgtgcaggtgtccgaggccaagaagacgtggtagcagagtctgacaagagcacgtctcgagcagatggaactgcggcggcggcggcggcggcggcgccgctgccgcctgtgtccagccagcggctgcggtggtgggcggtggtccttgccaacatcgtgttcgtcctcggcgggcagagcgtggccacgctcctcggccggatttactacgaccagggcggcggcagcttgtggctggcgacggtggtgcagtcctgcggcgcgccgctcgccgtcccactgctgctctacttccggcggccagaggcctccccggtggcacgtccgccgctgctcaagatcgctgccatctacgccggccttggcgtcctcctcgccggcgacaacctgatgtactcctacgcgctcctctacctgccgctgtcgacgtactccctcgtctgcgccacccagctctgcttcaacgccgtcttctcctacttcctcaacaaggagaggttcaccgcgctcgtgctcaactccgtcgtgctgctcaccttctccgccgcgctcgtcggcgtgagccactcctcggaggagaccaacagcagcgtcccggagggcaagttcgcgctggggttcgtcctggcgctgtcggcgtcggcggcgttcgccctgatcctgtccctgatgcagctcacgttcgacacggtgctcaggagcaacgcggcacacgccgtgctggagctgcagctctggagcaacgccgccgcgtcgtgcgtgtcggtggccgggctgttcatctccggcgagtggagctccctgacggcggagatggacgggtacaagaagggcgaggtggcctacgggatgacgctggcgtggacggccatctcgtggcagctcgccacgatgggcatggtggggctcgtcgcgacggtgtcgtcgctgttcacgaacgtgatcagcacggtggggatgccgctgtcgccgatcatggcggtgatcttcctcggcgaccggatggacggtgccaaagtgatagccatgctcattggcatctggggattcttgtcctacgtttaccagcactacctcgatgacgccaagagcaagaacacagctgggtcagctgacgtcacacaaacttcagaagcaaaactctgaagcctgatacgcctgatagtgatacccagagtgaattttactgtacttgatctcttttttttcacggaatcaattggaaatttggaatactggtcttatcttccctggaataacggggtcaatcagagtaactgcagaataacaggaactcgataatcgctttttgctcaaaaacattacagcatcgaggaagatccccgtcttcatcagtttctgaaacgacactgtagttgtcaatactttctgacagtagagggtcatctcaggtaaagactgtttttcattagtttcaccgtgtgacgacagatgaaatcttaagggattacagcgggaaatctgtctagatttgaacgactgatgttgccgacttgacattagcaatcaaaacgtccatggtccataggattggtcgaatatacccagaattttgcttccttaagccaagagataaacccagatctcagggtgtgtttagttcacgttaaaattaaaagtttggttgaaattagaacgatgtgacggaaaagttgaaagtttgtgtgtaggaaagtttcgatgtgatggaaaagtttgaagtttgaagaaaaatgtcgcaacaaattggccctgtttagttctaaagttttttttttccaaactttcaactttccatcacatcgaatatttcatacacaacttttttatcacatcgtactaatttcaactaaacttctaaacttcagtgtgaactaaacacacagccaaaacacggcctcagtgtaatattccgcctaacgcgaatgcgaccgattacgattggtgccagcagcagcactgctcgtgctcggcgtgcaaacgatactgacaggcaaaaactgtactgctactagctttacttttggatcttcactgaatctcatgtaagatggcgtgtatggtaacttggtccgtcctactagctgcaacaggggggagatgaacttgtcaaactgcctctttttcgtatctgatcgctacaggtatcatgaacctgacgtagaaatgtcacactggtacagtagtctttatcgacatcatgatgcaaattggaagaacgtctgtttcatggttgggggaaatatctatctgcagccccggggcacggctcaaagttatgcgggcgatccgtcgtctgctctcgtactcgttgtcgatttcttacttgttgagttcggctgtgtttatttcagcgcaaaatttggattttggttgaaattagagatgatgtgactgaaaagttgtgtgtgtatcaggttaatgtgatggaaaggactggagtttggatccaaaaacagccttcgttcaatgtcccaatatgatactgctccggtcacgaatatttccaaggacgcctggtcgccccgctccagggcgacgcgggcggcaaaacctcgccgtcgcctcctcactctcctcctctcccccacctcgccgccacccgaacagccgccggcaaagccgggcggctgcgaagacggcgacggcggggctcccttctccctcactcccggtcagccggttggggcaccgacgacaccagagagcgagagcgcggccccggcgatgacggccaaatccggcgccgttgggtttggatctggccccttggccggatctgggctgggacgcgcgggtcggcggcggagtgcacggaggcggcggccgcggcagcggcgcgggaggcgcccgtgcgaaggtggggggggggcaaaggtcggcggctccgacgacgggcaggcgccagatccggtcgccccgcttggccggggtgaccggcgacgggctcggtcgatgacggcgccgctccacggacctggcaggggggtggctggcgacagcgatggtggcggatgtggcggcgacgaaggcggcggactacggcgtgtgccgcgacgccggccctcgtcaagaacctcgccaccacgaggagggcgcggcgcccatcaattgtacgccgtgcccgtgacgccttcctccatggcgccggcgacccgcactgcgcgttgcaccttcaggtctatgccaccccggccggtctggacggctggcggctggcgacggtggcggctggacggtggtggctgacggtggcagttggacggtggtggctgacggtggcggctggacgggggtggcggtggcggtggcgatggtggctggcagtggtggctgtcgacggtggtgcaaggccatcatccggggctgacggtgtgtcgtcgtcggcagcggcatgtggaggcaaggaaggaggagtccgggtgcgggcgcaccatcgagaactgtgggcggtggccttggccgaatttctgaagggacaatgttgttgaccaacgaagatccttcttgtgcggattggtggtgtgggtttggacagggaatcgcgagcgaaagccttgccgagccgtttggccagctgacgacggcgacgcccgtcgccgttctcctccttggaggcgttgtgttagattacccatctcctttcctaaccatattctccgggtgaaaaccttgcttccttccgaacgagcggtggcggcgatccacgtcgcgtcctccttgggggcaccgctttggagaaacctcttcgtgcaaggattgtcaagggtctatgcattggcttcgaacttcagtcctaggctttgacgaggccttctagctccactttttgttttgcttttcttagtttgggtcctctatttttctgtttgatgtgttcaacttgtcttgaactacactctcttctggagtggaactttgtaataattggctgtagctctttttgagcaaatgccgggatattatatatctatctcagacggtcctccatgtcccggcatggaccgtcagcactgctgcactgcacatggctggttatgtgagtagaaaaacatgttaccagaactgataattaatcgagtgatgcagcacagaagaatactacgagtagcatactctgtgctgcactgctgcatcaccaagtgcctagtttttcttgcatcccggccttcccgggtcctatgcaagaattcgcctcaatcatactccctccctaaaaaaaaaaaagaaaaccctgggttttcatgtctaattttgattgtctgtcttatatgaaattttttttataattcgtattttcattgttgctagatgataaaacatgattaatattttatgcgcgacttgtctttttaatttttttttataatttgttcaaataagatgaaaacgttcggtacggaaaccaggattcgtctttttttagacagaggtagtagacagcgaaaaaggatcaaatgatgcatgatgggtctgagtgactgcgaccgagtaaaacgtgagccatgattattcaaacatgtatatcctaaatcaccactaaattaccatatagtcccggattttgtcctctttcggggacagggtccatgggccatgacccacggaagagaaaacgtgcccctcctttcatttcaaaatataagagtttttaaaatttttaataactatttaaaaaaataataggtaaatttaaatagggaatgttattattgattggaaaaatagataaaaaaattaaatgagaatattatgattgtttaaagagaagaagttaatatattttgtgataaattttaaatgatataagttgcaatattttggcatagaacgagaatcatccaaccgttctggtagtagatgtcgctttgctacattaaacaattaggtcgagtcgttatatatgccaatagggagccatgagtccattctgcgttaggaaggctaatgaagacgtgaagtagaagctgtagcagacaccctctatcaatatggcgtacgctcaagaaattcagctccaaatcagaggtgcctccactgctcctcaccatctttagtctcctctcgtgtaacccttcctttctggtgcttaatctcgtgacaatggtttaaaacttttaaacggctctcggttttgcaaattgccctcgttttctcgatgtttagttggtgtggttttctgcttccgctctaatgaagtttggagttttgcgagtgaaatggacgagaaagacggtatgtgcgtctgaaatgtccagcttaggagctgtttccaaggatcgagttctggcgcatggtaacctagatggtatgtgcgtctgaaatgtccagcctagtttgttcttgctctggctcgctggcagccgtcctgagccagcaagacagagctgttgggatcatcgctcttgttcttcttcttgttgggatttattttaggagtttcttcaaacttgggcgaggtaaccgcgtacaaggagtgctcaatagaaatagaaaatagtttttcagtttccaaatagagaaatactagtagcaaccattagaggaataacaggggcggagctacagtgatgcctatgtattcccaggaatacccaactttttttatcaaaaaacaactatacttcagtatatacacataacacatatacacatattagttgtccccactcctccagagtccctcgctcggctcacgcctcaccctcacgcgcaaatgcgctgctcgcccgctccccaattccccatttgattccaaaccctaggtggcggcgttcggcggcggcgcggcggcgcggcgaccggcggaagcggcaaggcgtccggcgaccggcgacgggagcagggagctagaccagcggtggcgcggcgaggcattcggcagcggcgcgacgccgtggcgaggcattcggcggcggcgcggcgaagccgcgagacggcaaccgacgggcgaccggtgacggcgggagcgaggccacgaggccgaggggcaggggcgcggcggcggccggccaacagctgcagctcagcgggacagcgcccagcggcactgcggcaggcgcaatttcaggtgacaaatcaagagttcaagattcaatcagtcctaaatccactcactatgtgtccatgtctgatgtttttttaccttagtctctgagtagtttctttttcctgtacttttgtagttctgtagattgaagaactctcaaaatgaagaagaaatcgattgatttgaagactttgtgggatagacattcaaagtctaggaaggtagggttaggttctggttctggatcaacaacacaaccagttagaattgacagtgaagttgctgttccttctgttcagccgattacagatgcaaatgagagtccagttcagattcagattactgcagttgaggttgtgcctgaggtagcagccagtgatgcagcaagagatgtgacagaacctgaaacagaggtagctagcaatgatccagacatagcaacagcagtgacacagcaggagcaaccttccacttggtctcctatcagagattggtctcccatcagagatggtgatgatgaagagacagagtatgactcaagtgatgaagctatttatgacattgatttactttgtcatgatcctggaaggcgaattgcaatcaaaaattatgatgtcaatgaacggaattctgtgataaggggatatattgcattagggccatgccaaccacgcagccacaattttcctataaggaaaattggaggtaagcctcggcgcttccttcctagttggtatgacgaatttaaatggcttgaatatagtgtggaacaagatgctgcattctgttttatttgttacttattcaagcataaaattaataattctggtggagatgcatttgtaaataggggatttaggaattggcacatgagaaaaaggattgcaaaacatgttggtggtatgactagctttcacaatgtggcacaagataaatacaatcacttccttgcacctaaaacaaatattgttgagagctttgctgccaccaatgaacaagacaaggctagatatatggctcgtttaacctattcaatgaagtgcttgaagtttcttttaaggcaaggtttggctgcccgtggacattatgaaagtgaaaagtcacttaataaaggaaatttccttgagatgttgagtatgctagcagaaaactttgaagaagttggtaaggtggttttgaataatgctccaaagaattgtaagttgactgctcccgaaatacaaaaacagatagctaattgttgtgccaaagaaactactaagcttatcatggaagaccttggtgatgaatattttgcaatacttgccgatgaatctagtgatgtgtaccaaaaagaacagttggctctttgtttgagatatgttgataaaaaaggaagggtagttgagaggttccttggtgttgttcatgttgaaaatactacttccttgacacttaaagctgcaattgaatcattgcttatggagcattccttgagcttgtctaaggtccgtgggcaaggctatgacggtgctagtaacatgaagggtcatgctaatggactaaagaaattgattatggatgagtgcccttctgcctattatgtccattgctttgcacatcaactccaattaacacttgtggctgttgctaaggaaaacccagattgtgtgtggttctttgagcaacttagatttttgttaaatcttcttgggaattcttgtaagaagacagaaatgcttagagttgcacaagctcaaagaattgtagaagaactagatttgggtgacattgaaactggaaagggtttgaatcaagaaatgggtttgggcaggccagcagatactcgttggggatctcactataaaactgttatgcatgtcctatctttgtatccttcaattcaaaaagttcttataatggttggcaaggatcgctcttttggtgcagaatgtgcaaatgcacaaacagtgttgacaatattccaatcatttgagtttgtttttatggcacacttgatgcaaacagtacttgggttcacatctgacttgaatcatgctttgcagaagagggatcaagacattgttaatgcagtaggactgattttattgacaaagtttcaattgcagcaattacgcgaggatcctggatgggatgattttcttcaagaagtgcaatctttttgtgtgaagcataagatcaagattcctgatatggactctttctatcggccggttggaagagataggaggttctttattaaaatcaagaatatgcatcgcttccatgttgacatgtttctaagtgtcattgatagacaactacaagagcttaatgaacggtttgatgaggtaaacacagatttgctcctttgtatggctgcatttagtcctatagataactttgctagttgggacaaagataagttgattaagcttgcacggttttatcctaatgatttctcaagcacagagatgaaccatcttccatcagcattgaaactcttcctcactgagatgcgtatagatgaaaggtttagaaaagtaaaaaatcttgctaatctttccattatgattgttgaaacaaaattgcacaatagacatgagattgtttacaagcttctcaaattggttctggtacttccagtagcaacagctagtgttgaaagaatattttctgccatgaattatgtgaagaataaattgagaaacaggatgggggatcaatacttgaatgattgcttggtcacatttattgagcgtgagatgtttttgaaagtcaaggagtgtgatattataaaccgctttcaagccatgaaggaacgcagaattaaagctactcttccaagccacgaaggaaccgaaatagaaaattagaggtaccatgtaataatttgtaattttatttcttagattatcggtattgacatactgtgaaccattgattttttttactatgaatttttttgttagacgggaatacccaactttcaaatcctggctccgccactgaggaataaataaaaaatatatagagaaagtgggaaacatcacttctccatgcatgggccctcttattattttttttttgagggcactcttagtcttatcttcatcatatagtagtgtgactagtgtcattgaattcaacacaagtaagaccagagtagacgtaagcaggcttagcaacaacacataaggcatggtccacaggccccatcgcgttgtattttgcaaagaaaaacaaaaagacaaaaaaacacacagaggaatattttttatatacgtaaatgacatattctctacttctcaaattgatcatcatagaacaaaatccaaaatttcttaaattgatcattatataactgcatgatataactgtatggacacaaattttatcggaatacgattaatataacatgagagaatgtgtgcatgctagggcgtaattggcatattgttttaattgatgtatacattgtggaagaatgtgtgcatgttgtcttgattgatgcgatttaaattattattggtcttggtgtataaatatatatgatgatcaatttagaatggcggaagtatttactttgaaacttataaggtatttttttcgcagtacacacgctatttaaaagtagtatataaaaatcaacttaaaagaggagacatatgagattcagagaggtagcaattacattgaaaaaagtggctgaaatcaaatagtatatgatgtcgtatttttttagcaaaaccgttttcttattttacatgtaaccttttgttttgtttccccctaaatttcccttattttatccacgatcccttaaaactagatcgtcactccagttccttgtgatatttgtacctttttttttacaaatattctttcaaaaaatggagaactatcagatgagaaatgataaagttgatcttttccgttgcttacattttgtgtttgagaagtaagcttactgatgacggtgacactaaacagccatgtcttctgtttgcaaacttatgccagaacaagagtctgaccatggcgaggacggctctgcaccaaaagccgccgccgtgcgtggtgggtcaccgagaggcggcgtccggtggtggctgtcggtggcggcggacatgttcatggtgctctgcggccagaccgtggccaccctcctcggccgcctgtactacaactccggcggcaacagcaagtggatggccacgctcacgcagtccgccggctcgccgctgctcgccatccttctcctcttcacgccggcgcccgccgccgacgagcccaggccggcggcggcaaagatggcgcccatctacgtcggcctcgggatcatcatcggcttcgacaacctgatgtactcgtacgcgctgcagtacctgccggtgtccaccttctcgctcgtggccgcgacgcagctcggcttcaactccgtcacctccaggctcatcaacgcgcagcggttcacggtgctgatcgccaactccgtcgtcgtgctcaccttctcggcggcgctgctcggcatcggggcctcctccgacgagaccgccagcagcgtgccgaggggcaagtaccccgccgggttcgccctgacgctcgccgcctccgccgtgttcgcgctcatcctgtcgctgttcgaggccaccttcgagaaggtggtccggacgcggacgctccggtgggttctgcgcgcgcagctgtggaccaacgtggtggcgtcgacggtgtcggcggtggggctgctcgcgtcgggggactggaggacgataccggcggagatggcggcgttcaaggacgggagggcgaggtacgtggcgacgctggtcgggacggcggtgtcgtggcaggtgatggcggtgggctcgctgcggctgatcgtgagggtgtcgtcgctgttcgccaacgtgacgggcacgctgtcgctgccgctggtgccggtgttcgccgtcgcgctgttcggggacaggatgaccgggatcaaggccgtatccatgctcatggccgtctggggtttcctctcgtacgcgtaccagcagtacatcgacggccggcgcgcggccggcgccgggaaggggagagcggcggcggagtgccgcgtttgcgccgcgcgcgccggcagcgatccggactcgcccgcgtgaggggcccgcgttttctcacggcccaacaaaccgaaagtagctcacgtctacttttcgcctgaggcccaatacacagaggacatgtaggcccatcggcttgtgttttgagatactgtttaggttttaaaccgtgtatccatcatctgtagggccccttggaaaggaataattcactcgaggttctttaatttgtcaacgaatctgattttcatatttcaaccaaaatatttttccttcaactgttaaaaccggtgcaatgtagatcacatggctaattttagctgatgtgacatgtacatggctaatttgacttgatcttcatttgacgtggcatatgaagcaaaagttaacaatttaaaaattaaaataaaatatataggcccacatgtcagtcagaataataagattaaaaacagcgagacccacgtgtcagtagaccccacttcatccacctcatcctctctcttcactatctccttcccttctccttctcacctcttccccttcttccctagaggtggtcaccacgagcaccagcacgccagcgaataggagtagaggcacgacagaggcggaatcggcggaggccggtgagcaagggcagggagggaggagcatcaccggcccgggctcttcgcgcattgcccaccgtcactaagcccgcgagtatctgctggcgagtgcacgtagagggggacgaggcggggaggccggcgagggtggaatagcacgttgcacggcctcccgcaccctggccatggcgggaagatgaagctgctcctcttcctcgaagatcgcagctgtgcgggatttttctccggtgccctggtcgcgagcgaggccgacgtagccgcaaccgcaaccggcacacgacaccgtcaaaggttcgtgacacgcttgttgccggaccagataccggcaacaccgatgccaagcaagaactcgacaagcaatgcctcatcttcgtcaccgttctcgcctcagtgccagtagccaaagcaagtggagggactagagatcgtcgaggtggcaaccggcgagcggctgtcagcgcacgacgtcaggctcatcgagatggccggcagctcggtcaatgtctttgcggagttgtcggtgaagtcgtggagagggtggaaggacaagggggtgagatagagaatagaggggctaaggtagaggaagtagggcccactgacatgtgggcccactattttttaatcttattatttgactaacatgtggtcccatatattttattttatttttaaaattgttaaatttcgcttcataagccacgtcaaatgaagaccgagtcaaattagtcacgtagatgttacgtcagctaaaaccaccatccaaactgccatgggacctatatccactggttttgatagtttaggaacatgttgtatctggttttccagttgaaggacgaaaataggattcgtcgacaattaagggatctcatatgaacttatttaccttggaaatacatgaattggccgctgcggagtatccaaatttatccaaggaaaaagtacacccaaggtccctcaacttgtcatcgagatacaaaatcgtcccccaatcacaaaaacagataccggacgtccctcaactaacaagacagttcgctttaggtccctcggtggttttgaccctggttttgtccgatgtggcggctgagtcagcgtgggacccacgtaggccccacatgtcagtcaatccacgtcagcctcccccttcctcatctcttcctctcttctacacacagtcacacacccaggcggtagcgcgtcggcgcgtcggcagctgcggcggtagcgcctccacagcgccgcggcgaggcgggggtagcgcgtccacgacgacggctggcagcggcgggggccgcgacgggggaggggagaagggagggcgttggcgtcggcgtcggcggcgacatgggagaaggggagggcgtcgccgcgcgggcgaggtcgaggacggagaccccggcagcggcccagcgaagctcctcggtggccgaatatgggcccgggaaggcggtagtgaggcgggaacggtgcgggcgtgcaggcggcggcggcggcgcgcgcctcccgcgtccgtgcctcccgctgccttcacgcaccacgctggcgcctgcacggccgcgccctctccgtcccgcgtcagcgcgtccggccgatgcccggcggcctcccggctcagacactcactttgacctcccgccctgcagacgccaacatagatggtcatcttccggtccttcccttgcttgggtgacgacatcaccctgcagcaatccctccttggagactgcacgcgcgccggtttaagagcaacattacaaaaaatcaagggtttttttgttgtacgtacaaatcaattcagtcttttaactacagtgtgtgtttgattacccttttccagaggtcggggtcgggcttcttgaggacgatgacgcggtcgagcagagcggcagggtcacggatgcgccagccgcacttggcaggcacgacgcggcggcgctcatacacagtgacggtggtgttgcggctgtgataaaatgtgaagcattgaaccatttgcctcgggccgcatctctgttaaatagtggtagaaacagcctctaccgtggcttacaatgttcagttacaagtgataaggagatagaacagatttggagataagaaactaatcctaacaaccttatcactggatgagctattacgggtgtgagcagctgcgccactactggagatggaaaggctcccgtgtgctcaaaacctacgggaacaggccaaaaacacacggtaacgtcgttaccgagttctagctcacggtaacgctcacacggcggcttcatcggtttaccatgtggacttcccgtgagttcgcacgaaaaacgcacgggatggttgaaaattttaccgagtgtactcaaaactcgggactcatggtaacactcacgacgtaacggcgctcccaacagaacggcgggttaccgtgcaccaggatcacacggtaacagtttgtttgttaccgtgcgtccacagtatcactcggtaagttttttagtgttaccgtgagttgagcaatatcgggcactcggtaagctttttagcgttaccgagagttcagcaccatcgggcactcggtaagctttttagcgttaccgtgtgctgtatgctattgacgcacgggaagtcacactcagcactctttttttatttatatttctatttctatatttgcatgccaatatagatcacctgcaaaaagtcacacagaagactgcaatgcatcccaatcatttgcaattcatcatgacacattccatcacaatacaattcactgcattgcatccctatcatttgagattcatcaagacaaattttcatcacaatacaattcaccaagcatagaagagatgccaaatcccagacataggcatatattttggtaaaaattggttgtaatgaataagcatacaagctgatcatggtccatgtcacttaaagcaaatactcaaatctttgagacaatagctagcaccagattatttagttcattggtcctagaacatgcagttgaaacttgagaatacacctgcaattgtgagaaacttataagaaattaatttttcttgcaaggactgttgagtaggaaccatatgaaaatggtgctatgggtgctgctgtatccttgtgcatttctcatattatgaattttttcactaatctgcaccagcctcatgtttgatgctttacaaagaagtattgacatttaatttgaagcaaaagaataatatgagctagtatcaaattatcctccataattcggacccatgtactgttacaagctaattaaaccaaaacaaagaagaccaaatggtcagttctataagctgagaaatggatttgcttggaataaaaacatgagaaaatatgtatccacctagcaaacctacacacttgccattatgcagagtagcagaactatcatataagtaatgaaatgaaacatgcattactatatatcttgtgatttgtcaatatggttaagaacaatcaataatgtaacttgagcagtttttcacagttgataaaatgtatgcatctgttgatgtacagcaccaaccaccatccatgaattgatcttaaaactgatgagatgaaagtagataccttttctgatcagctctaatgatgctacttatattgcttcataacctgtaggaattagccacacattagtaagaacatgcaaggagactgatcaatacattgtaattatttgagaaatgattaagtagggaaggtttgaatgaaaaacagatcatgtccatgtagaagaaactaaagtgtaagaaaaggcaaatacattaagcaaagcatacttagcaagtcagcacagaagtggtcctcgtcgttgtcatcttcatcggttctattaaagcagggtggaaatcaatagaataagacatcaaatgagtcatcttcatcaattgtagaataaaatgaacatgtaaaaaagcaaaaatattacttagaaatattcatcaatgatggggccctcctcctcatcttcatcaaactcagaactatcagattcatcttgttgtagcacattggatccatttagaagctgcaagtccttgtcattgacaatgccttcggcatctctagtggtggcttcagaaacattatggagtccttccataagatcaactacaaaagtgccttggagaccatcttcttggaaataatggacattatcattgttgggaagaaagtcgtagtccttatccacaggggctgctatttttccagttggctgaaccttgtaaactacccaccaatcgatcagggctggtacagatttgcatgggtatggtatgtaataaacttgtgtggcttgatgagctacaacaaatggctcatacactgcaagtgttgatgaatgggcaacttccactaaaccatactgtggggtgtaccttgtttgggcagggtcaaaccaatggcagttgaaaagcacaagagtgagttcactatcaccatgaaaactaagttcaattatttctttgatgtagccataataatcagtgatatcactattttctccttgtcctattgtcaccaagccactatttatggtggttgcatttggcctctccttctcatatttatttgtacggaatcgatagccattcacatcataaatactataggtcttcactctagtatggcatcctttagctacttgcttcagatcatcattcatattcatgtctataagactctacaagtgaagtgaaataattttgatgaattatagttattaacaggtgcagaaattagatgttcaagttgaatattgaaattgaggaattacttgttggtagaaccaggttacgaaattaggacaaccattcctagcaccattccgtaagaggttctccttttgctgtcttgttggctcgcctcgtctactccactcctcatgtaagaatttcctgtaaacacagaactcatgcatgtcaagaaaggataaattatttcatgctatgaactggatgtgacccaaataaagtgcttacccaacgtagtcatccacttcaggcaggtttgtgaggacgtacaacatggcagcctcccactccacttcagttaagtgtctagtgactcctcggctagtagaatcacccttaatagagaagaggctaagtgagcattctctcgactcaacagtaacattgtaccgagggactggattgtgaactgtgtacacttgatcagcaaagtatatggttgtgaagtttgcgatttcatctagtatatatgcttctgctatagatgcttcaacacgagctcggttttttactttgctcttaagatccttttggtctctttcacctggatacatccatcggtactgtactggccctcccatccttgcttcgtatggtaggtgaagaattagatgctgcattggattaaaaaatccggatggaaagatcatttctaacttacaaagcaaaacaggcacttgaagttccatgctttcaagctcaattggatctacctcttttgcacacaatttacgataaaagaagctcaactccgctatcacttcccacaaataaggttgaaagtagccacggaacatgactggtaaaaggcgttccatcattatgtggtagtcatggctttttaacccattgattcgcatctttttgaagttcactcctctccttaggtttgatccatacccatcagggaatttgagtgtttgaaaccattctaatatttccttcttttgagtcctattcaaacaaaaatcagctcttggcttcaaccactgcccagatgtttgcctccggatcatgttaagatcaggtcggttacagagtattgcttgatcaagtcgagccttcacattatccttcgttttctctggtatatcgaaacaagtgttaaatattgcctcagcaacatttttttcattgtgcatgacatcaatgttatgaggaagtactaatttatggaagtatgggagcctccacaagcctggaatgtgtgtccaattgtgatcctcaccgtaaccttcaaacccctctccattggcagcaggttgcagacgttgcaagcgaacatgaacctcttcagttttgaaccgatgaggtggttcagtcgtaacagtagtatttgcaagaaaagagtttgggtcatttctaaaaatgtgaccatgaggaaggaattgtctatggcaatcaaagaaggagtactttccaccaaacttcagccgtctttctttaagcacctccatacagactggacatggcatcttaccatgtacacaccacccacaaaatatcccataggctggaagatcatggaacgagaataaatatgacacccgcatgttaaaattctgtttagtggcccgatcatatgtctgcacaccatgctcccaggcatggagtaggtcatcaactagaggctccatgtacatactaattttcttgccgggataatcaggtccagggataatcaaactaaggaacatgttgtgtttctgcatgcaaacaccaggtggaaggttgagagggatgacaaacacaggccagcaggtgtaggaggcagcacccataccaaatggattaaacccatctgttgctattgcaatcctaacattccgagcgtctgatgcaaattccgaaaagtcgcgatcaaattgcttccatgcttcagcatcagcggtgtgtactatcttgttaggatggtacctatggccatacttgtgccaagtcatttgcttggcttgtggttcagacatgtataaccgttgaagtcttgggatgaatggtatataacgaaggactttcattggaatatttagttgcttcttttcaccatagctgttctgcacctccacatatctactctcaccacacttgtcacaatgggtcttctctgaattttcctctctaaagagcatgcaatattttgggcatacatctattttctcatatggcatggtcagtgcacttagaaatttcttagcctcatataaattgagaggtagcttgtggccttgtggaaggagagcaccaaacacattcaacaatgcatcaaaccctgcaatggatatggaaaattgagacttcactgctagtaaccgtgtgatggcatctagttgagatacttctgtgtgtgcatggagagattgatttgatgcagtcaacatttcataaaaagctcgtgctataggttccggttcttcctcctcaactgatatatgtgcatcacgcacatcatctaccatgtcatccatccgatgaacctcagcatccccatcttcatcaaaagtacgttgccggagcacatcatcgcgtgtagggtctgagtcagactcgccatggtaaacccacacagtgtactccggcctaaacccatgcttaaaaagatgtttc

SEQ ID NO: 67559 - DNA, 4674 bp, Oryza sativa
ggcgcggccagcagcacgcgctcgccaccgctcccccctgcccccgccccagaccccgcgccgccccgaccccgcgccgccgcgccgacacgacgttcttgatttggttcggccgccgcaccgacacgacaagtgggctgccgccgccgcctcttccgccgccaccgccgcctattctgtcgcctgcctcagtgcgccaaggagcgagagagagaggggaaggggtgaagagaaggggagaagaaaagggattgggctgacaagtgggtcccatattttattttatctattttggctgactagactgccacgtatgcgtccacgtaggaccaaaaccgccctgaatcgatctagggaactaattcatccggtttacaaagtttagggtcaaaaataactggtattgaagtttagggtggtaaatcggacaaccgcaattgttcacgagtgcaattcgtactttttcctacaattaaacagctacatgtccctctatagaatataaataaataaataatgtaattaactaacagtgcaaactatttcaaataacaacacctaaaaaagattcttcgttttaaatcgttatagttatgattcggttacttttttttagttttgaaccttttgaagttttaatttaaaaataaaatctccaaagttatttctaaaagtaaaccttaagctggtgtggcaagagtttcgccacgtcagacatgatggtgtggacaaaagtttcagatttaaaaataaaatttgagagatttcattttatatattaaaaattaaaaaggtttagaagataataaaagttctaattcagtgtctttgaaacaaaagaataaacatattctctccgttttattcaggtaggaatttgctcggtgtacaattagtacattaatttttagactgataagttgaatcataatatcagtatgcaattacactaaatttgatttttcttatttttgttttaaggccaacttaaacacaaagatataaaacacccgattgtccagttgcaaaaccgcatcttcgccatccagattacttggagctccacactgaaacgacgtcatccaacccgcggggtctttgcacgagccgtcgcctccattatatattttgtacacacctacagttgcaaacaatagcagcccaagcatcctgcgcgacacagcaatggcagatgattacttctacctcggcttggctctcgcgtcgttgctcgtcgtgctgttcgccaggcgcaggcgctcggcggcgcatggcgacggcgggctgcggctgccgccagggccgtggcagctgccggtcatcggcagcctgcaccacctcgccggcaagctcccgcaccgcgcgatgcgcgacctggcgcgccgccacgggccggtcatgatgctccggctcggcgaggtgcccacgctggtggtgtcgtcgcgggacgcggcgcgggaggtgatgcgggcgcacgacgcggcgttcgcgtcgcggccgctgagcgccaccgtgcgcgtgctcaccagcggcggccgcggcatcatcttcgcgccgtacgggggcagctggcgccagctccggaagatcgccgtcacggagctcctcaccgcgcgccgcgtcgcctccttccgcgccatccgtgaggaggaggtggccgccatgctgcgggcggtggccgcggcggccgcggccgggcgcgccgtggagctgcgggcggcgctgtccgcgctcgtggccgagaccacggtgcgcgccgtgattggcgaccggtgcaaggaccgcgacgtgttcctccgcaagctgcagcgcaccatcgagctgtcggccgggttcaacccggcggacctgtggccgtcgtcgcgcctcgccggccgcctcggcggcgccgtgcgggaggccgaggagtgccacgacaccgtgtacggcatcctcgacggcatcatccaggagcacatggagaggacgagtagcggcagctgcggcgccggtgacggcgacggcgacggcgaggaccttctggacgtgctgctgaggatacagaaggagggcgggctggagttcccggtcgacatgctcgccatcaaacaagtcatctttgtaagtaactatcagcagtaatattcatctatagcctcttattcaaaatttgatatatttaaagttgatatcattcgtattattcacagtaatttggaaacacaaaaaattataagttagtatgtttaaaaatctttaatgataaattaaatcacagtaaaataaatgataattacgtaaatttctaaataattaagacgaacggtaaatatattctaaaaagtcaacaatgttatatactccctccttccaaaagtttaagacctattttcattctattttcattctttgggttttccaaaaaatctaagtcttatttgtagtcattatgtgctaaattaaattattgatgagaatccaagaagctattttagtacttattaattggttgcatattcattggttttgtcacatggtgaatgagttaatgacttcttagtcttggtgaaaaaagaaatagtacttagaattttggatggagctagtattaagaactatagagtgtcattttactttcataaagcgacccgttctcctgagacttttttttttcacttagagcttagagaactcaacaactagttgtagtcggacagacatggagagaaaacaggggcacaaatgtcgtaatattactaaatgttaatataaatgttaatagagctatcctggagcaaacaaagacacgtttggaagtattttcggcattatagaaaaaatagcaatgcggacaatattttattgtttgcgaggacaaatagcaagtgcggataataaaaagggaacaaaattctacatataggagatatggtacatcatggaactcattttcaaatggaatctttatcaacggcaaatcgtccaccaactatcagtaatatactaataactgatcaacgtggacacattttttaccttgaactactaaaactggttagaatatactaacctaagaaacggtcaaatatcactccaaggcaacccaatcatttttgaaaactgttattttttagttcacaatttttatatacttgcacagaagtacagaacccagttagaaaaaatggtatatcaaaaattaaaagcatttgcaatgttagtaaaaatcgtgttgttagaatatcaaaagcatgagactacaaataaaacctggatgatttatcttggagagatgtttgaactggttttgatattgaagattgcaaaattaatgcccctttagttttatagttaagattttttttggattatgaatttatgatgtcctaatagaggtgccttcgagttatctggacaaataacacctctaaccgtacaagcaagtacaaataactagatattagtattatacaattactttgctacatgtataggtcagaagggttatataatgtttacaaagaaaagaaatatagatacaacatatgtggaggggcaacctttctccttcattctcttcttcaagcgtacgattctcctctctacttctagatctatttatataatgtgcacttttcattttttttgacttgacacttttcatacatttagtgatgtattagtgtataccctggacgactggtttctaaaaatagcatcgtgcacatcagctgctacacagtgcaaagtttaattaggaacatgcatgcatgattggttaccaataagggaataagagtcgtaccttctttaatttttttttgagaacgggagtcgtaccttcggcttccagaagtaataaaaaaaacccgatccgatctttgcattgccgcttgcatatggctttaatttggctattccctccgtactataaattattggattggatatattctatcaaacttgataataattgacatcattagtttgaagtgttttcaacctaactatgtgaaaagtgaaaaaaaaataaaaaacatattgggacgtacagtaaattttaatgtatccatcataccaaaaatttcacttgaaaatatgacacttatagagagagaaaaacatagggataagaaagtgaaccgtttccagaatccgggctataaaatgagctaaaaaaaatgtaggccttcatgtgctctggtgaaatagttcaggagagtaaaatatttttttctcaaaatacaaatgttaaaacagagtttatattttaagttagaaaatagtacgaattactccccggaactatcgcagtcgaccgaattatcccctgcacctaaaaaccaggtattgctcaacctaagcattttatttataaaaaaaaagagacccacctgtcctctctctctcaagcacaagatgcgccgtcgcggacggcggctgccagcgccacaaaagggggaggagatggagatgggaagacgagggaggaaggagaatgggagggagatctaaggggaagacaaggtggcccctgctgcgcctacgcctctggccgtcacatgcctctttgccatgaccccgccttgatgacgcctccgctcgccgtccgcctctccgccacgctccagcctcgcccgccatggccaccgccgtgcgcgccgacctccccctgccaactccatctcctcctct

SEQ ID NO: 67560 - DNA, 5309 bp, Oryza sativa
aaattgaagtagacaattaagattgcttggagatgaattgtccaactaatatagatgctaaaatcatgcggagttgttaaacttgtctataagaacgtcatttaggaggaagagacaaaacttattaaaaaaacatgtgaaaaacaagcaattggcacaatgccttgcccttataaggctgtgtttagatccaaagtttgaatccaaacttcagtttttttctatcatatcaacctgtcatacacacacgacttttcagtcacatcatctccaattttaaccaaaattcaaactttgcgctgaactaaacacaacctaaaactatagacagaacaccacttgagatatcaacttgtccaatccgtcaccaatttctttccactgactgatttgatgggtttttgttatccccaaactaaaggcaacaatgaaagcacattcagatgttaaataacttgtgaagtcaaacattgtggtaggtatctccagttatgttctctctagaagcaaagcaagaaccagatcgacaaagagatctactcctataacacatttactctatataagggacagtgtaatgaatccacctacaccttttttttgcaggaaaagtcttcctcagaagaaccaacagtctctatacgaaagaaacatgcagtgcatacattgcaacatgaagaggaaaaaaaaaagcgagagagagtagtagtagcaagtaaataccatgagtaaaaagagccgcttgtatttatgcgagagatgatgatgatgaggctagcttttattgtgctagatctccaagcagtgctgtccaaccatcataaacagctgcgaagggaaggggggaatcaaatgcaagcaagcaaaatgtttccataagaggccaatccaagagtaccttgtaggtccttgttcctccttttcttgcctcccccctcctgtgctctctctcctctatccgtcaccccttgaggcagacttgcagggttgctgcagtccttatttactgctcatcaatcactcatcttctcctcctttgttgatcacagaccagtagaaacaatcacttcaatcccattttcagttcagttccccttgtcatgctacctacaacttagatccagccaaactgtgaaaagaagtaaatgaaggccgtacctttgggtgcaatatatgcttgagccccagatgctgcaaatccacctcttcctgtcttttggtgtgcatccaggcatcccagccgaagaacagcaacaatcaccatgcacagacaatgctacagcttgtgaaaacatcttatctgtctaatactacaatgttcaagttcatgacatagtgttggaatatgtgttcagtaaaaaaaaagaaatttactgctaagtagtaaaactccattgtggtatatatttcagtaggattttgttggatctgcaactcctatcccaatcaatccgatcctcctcttcagcttgaacgtggcaaggacccagggggaggcaacagttgtcaggcacttaaaaacaaagagcagtgtgcttttatgctcccctgccatgaaatgtggcaagtgtgtgtgcgaggaggggaatcaaatgctacaaaaggaggagctccccagaagtagccaatgcaacagtacgaagctcctttatttgtccaccaaacccaatgtaccaccaccaccaggcggcgcatttggaagttggaacgaagcaaattctggtcctctttgaattttccattactgtatctatagccttgagttacaacgatatgtaacttcacagcaattctcaactgcaaagagaagcatgagaacataaaaatgtttctttacaccataacccagatgattttagtggatgataagcatatcatccagcattcatttcttgaatgacaggaaatatttaagctgcaaagataagcagaacatgaatgaggctggtataaaaataggtaaaaaaaaaagctcatgatgtgcaaactgcaaagcaaatcagtaataaggcacatgctgaaagcaaccgcatgtagcaatgcaatgagagttccagatgcacattttattgcagaaatggcaggtgatcacattgcggtgcataatgaagcatcattatttacaaaaggagcactcttaagttttacaacacttatgaaccgagccagggcctacctgttaaataactaaattcaaggtctcaagcactcacatcacaggcagatgtcatatggaggacttaggattgcttaaagcttacaagaaacatgtgggctagatatgtcgataatcaggaaaaaaatacgttgcttcaaatataccttaacattgtatgattgaacccctaagttcatcttgtagactgtagtgtgtgcgtgtgtgttagaaaacaacacactcttactatttctccttggttgttaatccccccgcccccgccttttttaaaggagacatagggtaattaccatttgctcaaactacagtggatctttgaacctgcatttcactcacccattggagttttcgtcaagtatgttagccttagccaaatatctttcagcaaagtttgagtttgaagttgatatgaatttgcaacaagaaacgccgggggtcttccggctagcagcacaaggtggtgggctagttagcctaggttcgaagtcttatcacccctcttaataaaattcgatatgagaccccttcctctcatatctagagtttttttttaatttgcaacctccaggatatataattatttattattaaaaacatcaaactttgaaaaacacaagaaaaacccaaatatttttaatcacatataatgctttccatttttactgtaaaataaaaaagaactaattagaaccattctcactcgctgcaagcatattaattctttttcttcaaaaaataggcaggtgttttgcctagtatattaatagaatagaaagggttttgataacagcttggaaagctcccaagctaagggtggtgataaaatctaaagcccaatgttctgataagaactcggtgcattcgtgcgccaggtagacaacaagtatgacctccctccttgatctttgcttgggagagaagcacgttaattatactgtctaaaaacgtgccttgtgcagcctttggttcttttttttttttgccgggtcggccgaaggaacggcgaccaaatttcattaagatgggggaagtacataaagttacaaattgtttcttgcttacaacgacaggaagctgtcgagatggtgctatggcaaagccacagcctttggttcttcatattcctaatgctgtttgatcaggggtatatatataactttcaaggatcagtatcctgtatcctccgtcgagcacactgtctcctatgatctttgcctctcatcctgatctgcaagagtatagcatgggaagagattgcagttaggctgcacagatcaaagtcagaagatgccataattttcatagaccaacagtgttaagatcattgttgctatgaatgccagaataggaagacataatgatcaaatgttcatggagctacagaaaacagggtactagaaggaaagaaatggtgtaccgcatggtccgcatccgcatgtattacaaattttacatttacgcataaaattaaacatttgttgaaaagagtacggatgagtcaaccaccagacattattttggtttccaaaaaagtagccacagacagagcaagccttaatacaacgggtaattccacaaagtgagactagcagatgtactagaagagaataatttctgacaaaattggcatgtacgcactcagcacttgttaacacaatcagcaatcaacactatgtaactatgttcatccaaccagttacaaagcatacaatagaaacacacctaatgaaactgtgcttgaaacttttcaggcttgaacaaattgatagagataaggatcaacagttgggagggcttgatactgcattactgcacaccattttatcagctagttttgctaacgcgaagaattcccgaagaactcgcaccctttctcttccattacacccaaatcacacctaccacctgacgatggctcgcttctccgttagcgacattgccgtgaaatatgcttcgttcgcaaaacgggggcggagagagaactgagaagagcagactgacccttccggaggaggagcgaggacagtcgggtccagcttctcttccgcggccgccgccgccgccgccgcgcacgctcgccgctttcccgttcccttttttttttgggggggttttcactcaacacgtaccccaatccaactctcacaaacacgatgaatttttttcggttttagatttttttaaaaaaatatttatagaaataatctatcgaccaaaaaaattacaaaaatagaccctgccgcccacctctggggcggcaagctgacgtggcaaacggggggaggaacgggcggtgacgaaagaagggttttttcaggaaaacccttgccgccctctggtggggcggcaaggggcccgaatgcaaaaaagccagtcggggccggctattttgcaggcggccccttgccgccctctggccgggcggcaggcctcgctccctataaaggcctgctgcccagcccccagccctcattcttctctcctcaattccagtgaaaaaaaaagaagagaggggaggagaagagaagaaggggcgaagccctgccggattcagacgccaatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctactagtttggaatcaatactgtcatgcttccttgtcccattattatatcgtcgttgtgttcaactattgcactacctccctcctagttcaaatctaatatcatctatgtaaccgcaatgcaaatagtcgtatcatgttcaaattgtactactatttcttcatgttacataattctccttgtttaagtccatataatgtttctacgacccagactgcgataggcctatataaattatccgagtactaatacgtcgaataaggtacaaaataatacctcacgtaacatatgaaattgcgcaacaaccaacttcaatacatttttataacaatattaacaagttttaccaataaatacttctttatttattattaacataacatagaaaaatcttttggccgtacttttttcatctgg

SEQ ID NO: 67561 - DNA, 14700 bp, Oryza sativa
tctgcctcgccgcggctctcgcctccagcccgaccccgaccgccgcatcaccataccggagatcatggagctgtacgactccgacaccgacacgatctagtcctcgtcgtcgtcggaatctcccaccccggtggccggaacgcctcgcgtgagctcacctctccgccgccgccgcctcgcctctccgccgcgctcgcctccgccgccgccgcgctcgcctctctgccgccgccgctctcgcctctcctccgccgccgcctcgcctctccgccgctttcgcctctcctccgccgccgcctcctcacctctccgccgctttcgcctctccgccgcgctcacctctgcctcgccgccgcgctcgcctctccgccgctctcgcctctccgccgcgctcgccgctgcctcgccgccgcgctcgcctctccgcatccgccgtcgcctggagaagtgagagagagagagtattgagaagagagagtagtgtatgacaggtgggtcccataattttttataaagagaatgatgactggagtaattcgtccggtatttatagttgggagtgaagaatgtccgattttatagttcggggtaattcggacgaccgtgatagttggagggtaattcgtacttgtcccttaattgtaacgctaataagtactaataattgaattaattgtttatcagatcccttcagatctcatgcacgttcagcgtgtactatctggtggtacacctctcgcatggcctgctgtctgtcttgtcagttatcagccacaagcatatattttaatattaaattttgattctagaattgattttatatttttttaactttactttttagcattttcttttaaaccacaactattatcccataaatatttgtacggtttattctcatagcagtttgtatgctgcacagttttatggataattggatatacagtaggactttcatcgtctcataataagtttatttttagttcttttcatttgttttaaaataagtttatttgagctattgaagtttgtgaacttatgatatataaatgtacttagagtagatgaaatttaggaaaacaggagtattatagtcttttttttattggtatgtgtggaattattttagaattgagaaagtacaatgcagtaccgcatcatctatagtacgagcaactaacaaatgaggccgggcacgtatatcaatccctatttcgatccatcagctcctacaagtgtagaggcaatattgtaaagaaccatgcctatataaatctgtgttttttctttttgtcaccatgtaatgacgcatgcaacaagatcctgaggtattcttgtgttcatgagactatcaaggtgtcaatcgaagttgcctgtctccttttggtgaagaacattaaggctatgtttagattcaaactttgaattcaaacttcagtcctttttcatcacatcaacctatcatacacataacttttcagtcacatcatctccaacttcaactaaaatccaaactttgccatctaactaaacacagcctaattggaatcctcctccaaagtgatttggggtctggaccaatcaggtattcaggtggagtactacatattttcgctgcaaggttgttgagctttgtgcttagtgatgtgactgaccttggccggccggcggaagccggcttaagaatttcttctcgttttctttttagggcatgttgaggttccaaataaaatttttcacgctgtcacatcgaatatttagacacatatatagagtattaaatgtagacgaaaataaattacacggttcgctaggaaattacgagacgaatcttttaagcataattacgccatgatttaacaatataatgctacagtaaacatttgctaataacgaattaattaggcttaataaatttgtctcgcagttttccggtggattctgtaatttattttgttattagattacgtttaatactttaaatgtgtatcaatatatccgatgtgacatgtaggggaaaatttttttgccaattaaacaagcccttagaaagggaagactctattaccagaaatgattgtgacattacaagccaaaaaaatattaataagtatatcaaataacagactattctttctttagataagtataacagactattctgaagtctaccagggacggcaactggtagtctggacaaagcgataggaaacagaagccgaatctgaacgaaagcaagaaacgattccgctgttgctgcttcacacacaatcgaacgaatgggacgtgctatttcacgctgcaaatcggacgcgggcgggcgagaggacggggttcgaagctctggaaatcggaagtactctctccttcacgaaaaaggcaaaccctagatttccttactaacgtttgactgtccgtcttatatgaaatttttttataattagtatttttattattgttagatgataaaacatgattaatactttatgcgcgacttattttttaaattttttttataatttttttaaataagacggacggtcaaacattgaacacggaaaccagggtttgtctttttttgaacggagggagtagtaggtaactggagggaggtaccactcgtttgctttactatacgagtacctgagtttcgattgacgcgtgtacgtacggtaaaaataaatgaagtaccaggcaaacccccccccccccccccgcccctttcctatgtagcttcgcccttggtaggcagatgacgtaccaaacgaaccgacggaaacatttcatatgcgcatgtactctcgaatgtgtctgtcgctttaccgtacgatacggccatcttatctagcaactgacttttagaaccggtggtggaattggctaatggccggagctgaatgggagttggtcttctagtttttggtgatgtttgtttgaagggtagggtgaatgaggcagctaaaaagatgaaatattctctcaatattcacgatagagggattaggcttattttaccggattaagacatccaccatgtggatggctaaatggactgtccagccggggcatgaccagacccgagcctgagatcagttgggtcagcacgacttgacctgcatgtcgggccgggccatgcccacccatgggctgcaccaacaacccaaacacagtccaataagattcgggtcgtgccgagctggctcgaaggtacgaaagcccaccgtgctcctccttggaataagtctattttatgtccctcatatctttgggccgtgtcttatatggctggaataagtctattttgcattctttatctctttgggctgtgccttatatggctaaaataagtctatttctctccctcatctattttgcctccctaatcattggaacatgtcgtatcgggatggtccaccatgctgaggcagaggcccaagcacagcccaaaggttgggccaggccatgccatgcctgggccaggttgtctagcctcaggccttttggcaatctataatccaccttgtctagaatactaattagtgtatgattactaagtaggttaaattatgattaatgatattaaacatgtttgatattgattagtaattagcacgataaaactagtgtaaacaagtgctaatttgtattattaattgtatgacttactattattatagcacttctatatctgtacctaactaaaatattcgtatttttcctttagtcacacttttttcgtccgtccgattccctccatctcagcacgtgcatgcgcagatttgaagagaaacagactcgaactataaagctagggtttctcttccaacatctatacgacgtggttttgttttgattcttgggaaaacagaaaggggagaagataaggatcaaaacccctcactcaatttctaattatctccatggatgtggactgatttcacggaggaggcggattcaggcgtcatcgggcagatgcggcaatacggacggaggtaggagacgacccggtagcactggcccacatgacagtaaaagaaggagcgagggaggctgattagacttgtagtgctttgctgggccggatgcgtacttgcgggccgaggaagaggggaggagaagggagaaaagtgggccggctaggctgcaggccgaggaaggaaacgggatgaaattggcgtagagagaatggagagtttttatttagatttttttaaaataaattcttaaatgatgtttgtattattaaagttagcaattgagatctgaaaatttcaagaaaattccagagagtgtaattaatcatggagaacttcattaaaaattaaatttagctatatcattttatttccacacttactttacttttaaattaatttaaacacctacctacttaaaaaatcaagtattccaggaaatgtgtatttaatttaattacataatgtaaatctttctcaaattctcctcaattttctcatcttttcttcccgttgcaacacacgggcattttttcgaggaagatattataattaagtttattgctttcatccaatccatcctcatcctaccaatcaaataagcttatcccatcctaaaaaaaacttagcttcatcctctaaaatatagatggctatattacatccaaccataaccttgaaccaaacataccctatccgattgatgaaacactagtgaccaaaggccaactcaagagactagaccacttgcacgacaacctaggacccaggttggtcgggggctatcactaaccaacctggagaacattgtcacctgccctcacgtccaactcgcatacggccacaccttacctcatcatgagttcatgactaagattatttaagttgtggtcttatgatcttctcatcttctgatttttgcatcaatttagcctaaaacttaggctaggattttgtttcactcttatttaatttacttcacaattttagatgtttatcatgttagtaattgttggtatttctcaatgtcacagctagaatccgcaagcgcacggatatactgatgtagcacttcccctacggagtattccaaaggtatcaaatccaagagaacgtgtatgattatctcctcgttaggttcatccaaggacacaaagctaatgtgggcagagggtagagaggatttcctaatgagaaacagtgtttaaggaaagcttaactttaatcctaacgcaatacttcaggcactggcaacccgctgttaccagatgtcgctctactacgtaaccggacagggagtacttaagtgctcttgagggctgtcaccacctctacacctacctcaaacgtactatgggatacgcagcaacaactgcagattaattatctagacaccgcatctacgcaattaataactactctagtgccgatcaaacactaaagcaatcactataaataaatagactatagtaaacaatgatcccgtatgctaattaggaactaaccaagaagtaattctcactaagcaaatcttaattactcagaatgatatttctattaaagcagagtaaataacaagatacaaaagtaggaggagattatcgacaactccgggattcctccgattccttccaccttaccctctccctattctaatatacaataaagtatactagagcctcttataattcagcttatgatttggtgtgtgtttacaagtgaggatgagaggggtatttataggtgaagtgccttgggagtgtggagatgctccaagcatccaaagagcatcatctctcttgtgttgccaagcgttcaagctaatgacggtttctaccggtgaaaacggccataactgtcattgggaggcggattgctaccgaactgaacttgggctggggcgaacggcctctgctagggttcagccgaactcaggggttcggccgaacccgggacggctccgttcgctccggttttcgtcctggacactcattttggggccctcaattcattggtatgaatgtttggcccatatggaggtgtttaatttatgggtccaaaactccttaagttcggatacgagtttgattctcatcctccttcatgtatatttcctctcaaccttggtagtttgtcacctgcatataaatatacaccaacacttgtggaaattattataaataagccctaccactatgttggatgtttacaattatggtcttatgctggtattaacggtgttaattcgatacttaacagccatcaacagtaatgtttatttgtgttactttaactgatacatgatttatctcttctctgtccctactattatatattataaaaattgaagatgtttccgcggtccgtcatccgtgtttgagtcgattataaaaattgaagatgtttccgcagttcgtcattcgtgtttgagtcaactttaattttatgttttagttttagtctatatctcttctctatctctatctctatctctactattataaaaattaaaaatgtttttgccggtattttggtacgtcatccgtgtatgagtcggtttttaagttcgtttgcttttagaaatacatattcgtatttcagtcggtttttaagatggtaatatagaaggaattatatgagaaatatgtttaaaaaaactcgcatgctaactgagacgatcggattccttagtgcagctaatgatttcctaaaaatatatatatccaagtgaactcccacagtgaattttatccttgtaaatatagcgccggctgggccggcgacgtcgatgacctagacgcccggcacgggcactctaaggattggacggagcaggaggttggccttgcggcgcgccgtgatgccgaacgcctctgtcatgtcgaactcggtcgggtcagccacaccggaggcctcccagtcgatgtggaagagcaggctggcgagtgggagctccacgtttgcgaacccgaacgccatcccggggcacatccgccggccgccgccgaacggcaggagctcgaagtcggcgcccttgaagtccaccgcggcggccgcctcgccgtcgccgaaccgctccggccggaactcctccggcgagccgccgggccagtaccgctcgtcgcggccgatcgcccaggcgttcaccagcacctgcgcgccgcgcggcacgtcgtagccgagcacccggcacggctcccggcactcgcgcgggagcagcagcggcagcggcgggtgcagccggagcgtctccctgacgacgaggcgaaggtacgggagctcgccgacggcgagcgcgctctctgacacggcgccggccgcctcgaagtcacggcgaacctcggccgtcgccttcttcatcgccgccgggttccggattagctccgcgaacgcccaccccagcgtcgtcgccgacgtctcgcagcctccgctgatgacatcctgcgtgtgtttcatcgtttttttttatgatatgaagctgcgtgatcgagcattcgagctggccatcatggcagagaaaaaagaacagcttggaaagacaccatgaaaccattgttcataagaaatgctgctagtcactcacaacgacgacgcatttgacggcgtccatgtcgagagggaactccagcccgccctccttatgtatcctcagtagcacgtctagaatgtcttcgccggcgccgccagtcttctccaggtgcgcctggatgatgccgtcgaggacgccgaacatcgtgtcacgacacctctcggcctggcgcacggcgccgctgagacggccggcgagacgcgacgacggccacaggtccgccacgttgagcccagcagcgagctcgatggcgcggtcgagctggcggaggaacacgtcgaggcccgcgcaccgctcgcccaccacggcgcgcacggtggagtcggccacgagcgcgcacagcgccgcccgcagctccacggtccgcccgtccgccgcggccgcggcgaccgcgcgcagcgtggcggcgacctcctcctcgcggatggggcggaaggacaggacgcgtcgcgccgagaggagctccgtgacggcgatcttcctcagctggcgccagtagtccccgtacggcgcgaaggctatgtccctgcctcctttggtggccgcgcgcacgctggcgctcagcggccgcgacgcgaacgccgcgtcgtgcgtccgcatcacctcccgcgccgcgtcccgcgacgacaccaccagcgtgggcacctctccgagccgtagcatcatgaccggcccgtggcggcgcgccaggtcgcgcatcgcgcggtgcgggagcttgccggcgaggtggtgcaggctgccgatgaccggcagctgccatggccccggcggcaaccgcagcccggcgtcgccatgtgccgccgccgccgatcgcctgcgcctggcgaacagcacgacgagcaacgacacgagagctaagccgaggtagaagtaaccatctgccattgctgtgtcgcgcaggcaggatgctggggcgctcggctagtgtttgccagtgttggtgcgtacaaaatgtagtggaggagacggctcgtggatgaaggggatttggttcttaatctgtagtgatgtcgttttcagtatggagctccataatccggatgcgacgaaaatgcagttaatcttcgtgaggacaaatgaatgttatcttgtttatttctggtcatttataacgttaatcgtaaaatgagtataaattaaccggctaggtttctggaatctatttatccggatttaaattcttaagtgggcataagcacttgtctttatgactaattattatttcattaatagacaatgtgcctctcgatagcaagccgtcatatcacaacttcctgaatattaagatgtgtcggcccacctaatttgaaaatcaaatttaatgaagagagtactaaatattaaagtttaattgcatacctaatgccatttatagtgcgcgtgcttgacgttcggccccgaccatccacatcggggattccatgccacgcacacatctgcgctcccaacctgaagaccgtggaaccaaacaaagccaccggttcttcatcaaaatttggatagacatttgtcaaggcggaatgaggcacagggcgagcagcgtgttgggtgaggtgtggccccgtgcgacgcctccacacctcgtgcaaggcggcggaggtcgccagcgaggccaccatcacgagctgcgtcgtcgccaaagcggtgctcgctaaatcctgtgaacccgaggtcggatctgcttagtggggtggtggtcgagtgaggagaagggaggatggtggcgacagaggaaaaggaggtggcaaactaaccttgttttcgttcccgttcagcgccgccaagctcgtcgtcgtccccgctccgaaccacctcggtctgcagcagcagcagcttgacggagagggagaggagctcgtcagtatccggccaagggaggaaagccaccagttggagtaggacatgagtgggggtctttgaagagctcccgccgtcccttgctcccacgctgccgatctcgccgtctcccgcagtccacgccgcccaagggaatagggccgccagttggggaaggaggatatataggaggggtggtgtgccggtggcgactgtatggtgaggagcgtgggtcgccgttgggggatgggaacgggagaggcgtcggtggcactggaagggcaacggggaaagtgaggaaggagggattttatatatgtttccgattttgagggtgttttgtgtaaaatttgaagtattctctaaattgacaaactacgagaactttaatgtaaaatgttaggggctgatatgaaaagttaaagccacaggtataactcctttgcattgtgggataaagagagagttgagacccgttgccccatgctacacgaggtttctcgtaacaaagtgatgcactgtggaataaagagagagttgagacccattaccccatcctacatgatgcttctcataataaagtggttctctgtgaatggctcgatagaattactgccaacatgccttaggtttcacgatgtttctagctccatcataagatccatataagcagtgagatatatattatgtggggattcttcgcaatcattactatactacaaaaattagcgtgtctattgacgcgttgtccctttagcatatatagatcatttctttattttccatttacccttctgcgaagatcgcacatttaaaaggataatttagtgggagtatcgcgtgttaatgacctgtaggtttttaacagagtgaaacaattgaggctaaagttagaacaaaccgataaattttgataaaaacaactacacttttcatttcaattatatttatttgtgctgctaaaattctagtatgtgtctgaacctgaaattgattatctttttctttcttccttcctgtttgtgctgtctcctaggccaattggatcgtttagcacttcaaagtgccaccaggcccatgcagacccagctgcccaagctgctgctcgtgcggtcgtgcccaagcaagccgtaggtcacgcagtgtgtgtgtgggtgcggcttccctgttcctacttccgtattcccgtcccttttcctgctacgtggcctactcctattcgcttcttgtttgcctggtggccccacccttcttcttccccaaatcaaaacagaaacgtataattttttcagccttcattactccattgttatattggattagttccgcttggacacttccacctccaatgatgccccgtagccgcaggtgatttcctcttggcagctttcttcgctaatcggatgtgtggcgcatctcaatagctttgattatgtctgcaagtttcaagatgtgctcaggtaacaccaaaaactgttactcgggtgcttcctatcatccatggatgaacatggagacaaaggtttttggaagttttgtccttttatgaatgtgtagcagttaatctgctaggagttcatttcaattttcatcggtggaagcctgtaagagagtacatactcacagagtcgcagacttgcacggttgcaccagaatgtatgaaaaaaataagaaacaaagaaaaggatggaaagaggcatcgccctagttgaaattgttatcaattaatgatcttctataacagtattgattttgttcttgcctcaagctagctaaggtttccgttttgtccctttgataccacacatgccattgatgcaaaagcacagtaatttgttcaggatggtttagggcaggcaacactagcaaggaagaatccaagaggacctctccaggtgatgagcatgcacccgataaccagcaaatcagcaaaagttgttcagacctgaacgatgtgaggatcagtctggaccctgtagggagagtgttggagactcgatttttgtttttccgatggatgggaaggaagtagggccaccggtgaaacaaaagcaaatggatgtacgccatgtagcggaaacagggacgggaatacggaagtaggaagtacagggaagccgcatctgggggaggggggtgccacctatgtttccggatacggttttggactttttcttttcctggtaacttgaatttatcttagaaatccagcctattttcatactggcggacttgaaagcttctaaggaatcccttgaagtcttggacaaacagagaagagaagatagttcttgtgggcgggaaacgaaaccatcacaggagggaagtgcaaggtgaattggacgtggactttcctctctactgcctcgggaggtcttggcatcctgagtctcgaaaaattcgcaagggcccttcgattgcgatggctctggcatgaatggaagtcaccggaaaaggcttgggcgtggggtcagaaacaccttgtgataaaactgacaagctattgtttgaaacagcaactacaaaacaaattggagatggagcgaaagtgaagttctgggagttggcttggctccgggcaaagattgaaggatgtcacaccactagtccacgcggcctctaggaaaaagagcaggaccctcaaacatgctgctttggtagatcaatggctgcacgaccttgctcttccaacaaacgaaggatggacaacggatctgattgaccagctcatcaccatttggagcgccgttcagaatgtacacttcacggaacatgaagaccagatcacctggaagctaaacaaccatggcgaatacacggccaccacagcttataaggtgcagctcctgggtacaacatcgtcaaatttcgacaccctaatatggaggccttggatgccgcacaagtgcaagtcctttgcctagctgatactccaatacagagagtggacatcagacagactagccaccagaggctggcccaacggatccacatgccctttatgtcgccagactcaagagacggctttgcacctgctagcggaatatagatacataaggagaatctggaatgaaatcgcgcagtggacaggcaacgaccatctaagaccttctagttggcaagtaactttgacagtatgagtggtgggaggccaccgtaagcatacgggaagcacacgctaaccttgcttgtgaaccgggagatatggaatgaaaggaaccgaaggactttccagcacaaggagttgccagcgccaactctgctagccaagataaaggaggaagcaaaaacgtaggggctggcgggcgcaaaaaatctcatcgcctggttgacaatgtaattgccagtagttaggaccgtggccctggtttgtttcctgtacattctccctttttatacagtttcttctctattcaataaaattggtggcctagtcgattcgttcaaaaaaaaaattatcttacaaatcgaggtgccacatgaaccaatcagatgttgacataacagcattagaagtattggttgatggattgattggttgattaataagccctgggacgttgtacgtatttatcttttgtttcaggacgcacatgtcagtttctacagccattacagaagcagtattggtatactactttcttcaatgcagttgtgtgtttctgtgtacaacgtttaaccactgtcttatttgaaaaatatataaaaaaataaaaaatagtcacacataaagtattattcatgttttatcatctaataacaataaaaatactaatcgtaaatttttttcaaataaatcagatggtcaattgttggatataaacagtgcaaaactatgatatttctggaacggagttaggacaaaggatcatgaggtcacaagtcacaagactcacaaaaagcacgcacatttactccactcttactgatactgctactttatctctgtcgtaaaatataaagaaatttatacaaataacaatatagacataatttcttatattttaattagagttagtagtcacttagtttacaacacacagctccgtactagtagtattatggaagaggtcggtggcgctgtctggcggaggacgacggacacggcgcaacgatgcgcccgtctgaggttggtagcggccgtgcgatgcaacagctggagcagcgcttcagtcagccatgcagctgcgcggccctgtggctgcaaggcatggacagggccggcggccgtgcgacggcggggcggtgcggcaagcaaccacggctactcgtttgttggtgcttctttcttttttttttctccatggctcggtgcaatgtctgtggccgatgcggcatggtgaaacgctcattggcgggcaaccgttcccaaaaaatccccaatcggcattcaccggcgactccacgtcggcgttggaggatttctccgagagcagtataaaggaacaagaatagagagaggaatctgttttcgtgattatattagtgagatgcaaaatggatttgcgagttgttacccttcttcttccttgatttctagtagaacgttatgctatcactggtggagaaaccatctttggtcggtcagccaaatttcacaacagtcccggttctaataaaaaccgggactaaaaaacatctttagtcctggtttaaaagttgaggagtactttttgatctttagtcccgggactaaagatcatttttactcccgattcaagaaattgtcgggttcaagacatacctcaactatttttactccccgttggtataaacaactgggactaaagatctatttttagtcccggttgtttataccaaccgggaggaaagagcacctcgagccgtgcgcgccatctttatccgctctcctctcgatctcctctcccctctcattaatatttcctctccatcccttcctctccccttcatccccttcctctccccttcattccctatctgatccttcctctcccctttcccttcctttcccgttcgcccctttcccctcttcggagcaccggccgggcgggagcggcggcggccgagcggctggccggccaggcgagcgcggcgagcggccaggcgagcgggagcggcacggccgggcgggcgagcgcccaggcgggagcggcgggaggccgggcgggagcggcgacggccgggcggccaggcagccaggcggctgggcgcggcgggccgtgctggcgcggaggcgagaggacgggaggccggcggcgccctcccctctgctgccggattttttttaatatgtgattcattggatttaatctgtgatgt

SEQ ID NO: 67562 - DNA, 23260 bp, Oryza sativa
  unsure (1)..(23260): unsure at all n locations
caagctctttatgggcggccaaaattgcaattagccccttgccgccctttgtatggccggcaagggcctaatcgcaattttggccgacggcggcaaacggcgcggtcgacccaccgtctgccacgtcagcttgccgcccaccattagggcggcaggggctatttctgtaatttttttggtcgatagattatttctgtaaatattaaaaaaaaaaatctaaaaacgaaaaaaattccaaacacgattcggttccgagatgatttatggcccaatacaaaagcccattaaaaatctagggtttaaaggtgggaaaaagtccactttgactcccttaaatgtataccgaatctaattcgtacccctcaaccagaaaaccggttaggatgactccccattttactaaaaccggtacaaatagactccctcggcggtttcaagggcggttttgctgacgtggcggtgttgacttggtcttcgtcccacgtggcgttgacgcggcactgatgtaagattagatttaaaaatatatatgtgggaccaatttgtcattcacacacaaaaattataatagaatccactgacttgtgggggtccacatgtcattctctttccaacctttatgcctccctctttctcccttatctctctctttctcttcctgtcggcgagcagcgcggagagcttgccgagggcacggatggcggagcagagggcggcgagggaacggagtggagggctccaagggagtgcgcgaagctgtgaagccgtgaggcggcggtgggtggagaaggccggcgtgaaggccgggcggagcagcggcatcgagagctgccagtcaccgcggtcgctcctgtcgcgtatcctacagcgaggcgacggcgacggcagcggtgggaagatcgggtgccgggtgcagctgccgtggcggtacagctccacctctgtgttgatgcgatgttgttaacactccgccgccgccggtagtggcggcggcggcgtgggaagttcgggtgctggatgcggctaccggcgccggccaaggtcaaggtcatcgggagggcgccggagttgtccctcgacacgccgcggagttcttgtacactcgacgaggggagaaatggtataattcttgccgtgcgcggcgccggtgcagtgccggagacgagagcgacgacacggaggaggtgactgacacgtcggcgtccttcgccgccaagacagacgacgtggcggcaagaaggccaaggacggtggcggcggcggcgcggtgctggtgacggtggatggcgacgtggagctggagatggagacgctactgaaggcgtcggcgtacatcctgggcgcggcgggcagcagcatcgtgtacatggcggtgctggacgacggcgccgtgctggcggtgcgcaggatcgatagcgacgacgcatcgcccgcggcatggcgagagggctggccttcctccacgacaagaagttcgtgcggcaacgtccggccgagcaacatcctgctcgacgccgacatggagccgctattgacggacctcagaatctaccggctcatccgcggcgggggcacgctcaagccggcagcagcggcagcgccggggcagttcgggagcaagcggtcggcgaagtgcttgccggacctgtcgccgccgggcgcgaggccgctggcggggccgtccgggtccggtgacgcggcggcacagtaccaggagaggagcgagccagagctgatgctgagcagcaacaaccacaccctcgtctacacctgcgacaacgtgcggtgcagtgcccgcacagcaactacgcgctcggcttcctcgaccgcttgctctgctgtttctttttgggggatttgggggaaaagatagagagggagaagatggctgacaagtgggccctacgctttttatattttctcctatcacttacatgtgggcctcatctgtattttggtgactgggctgacacatcagcacaatagaccaagtcagcatgccacgtcagcaaaaccaccctcaaaaaccacttagggagtcaatttgtaccggttttagtaattgggggagtcatcctaaccggttttctggttgaggggtacgaattagattcggtgtatatttaagggagttaaagtggactttttccttaaaggtgtagtagatatttccggcccattaggcccacgagctttcctcttcgtaggctcgcggcgtctactcctccactccaccagagcgaaactgcaaggcggcaatggaggccggagatggaagaggaggaggagcggaggaggaggaggaggagcaggtgatgagcgaggtgcacctgggatgcccgccccgcttctccgggctctacgtctcccgcttcagcttctcctcccgcccgctaggtaacagcccggtctcgcgcattccgtcgaacaccttgcctgcaccgccttcttgggcgcaacccgatgtggggggtggatggaagagccatggtttagttcgattcgatgtttgcagggccatctgcgggcagcgacggcggagaatgtagcggtgtgcgcgagcaggtcgcggcgtcgagcagttcttgtgagcgtgcgtggggctgtttcttgctatggtgtagaggactgaaaggtggtgcttgcttgaactgattcttggctttgttgggaaggtggttcgcctgacgctgttaccgtggatgaggacggggatctcgttcttgacaggagaagaaggaacagaggcagtgaggcatttgttatttttaactgcattctgtcttgccgaaattggtggtttgtgcagttaatctgaccattggcttgcagggagtgatcatgtgctcactgttcagcatggtatcacctcctctcttaggagcgttggtctccaggtctgagaaaatgctgcttttgtaattccttttcgtcttcctttttgtttacgatcacgtttgttgttggttcacaggtttggaaggcggcattgctattaactgattttgtattgcataagagctttacatcgtctgagtttaatggtgttactgccatagagatcggtgctgggacaggtgattagtcgatgtgaaattagtcaaaaagtgttcccagaatcatgatttatgtgtcatttgttactaatttagtgatcctctacaatcatgaatgtttgccaggtttggtagggttggcactagctcgagttgctaagaaaatcttcattacaggtaggtagttaggccttctcgagtccgattctgtagagttgttcgttttagagttttaccttttgtccagttgcatgttccacatcaatccagtaggtataatttgatccgtatatctgacaaacagggttaattgaaatggcaaaactatataacagaaattggttcaaatgagaattcagttccatgtgcgaccgcataaatcaaaatttcctctactatacatggatctaattagtctaagaatgcaattccaattctaatccttatactcagtttcaatctatgaagctcaaagtcttatttagtgttcattgtcttgcattatttgactcaattttgctactaagataaggtaaataacccagcaggagtattacttactgttttccttagtcttagtaacctttccttgatatataaaaggttagttttgcatgacacctgtaatttggtaatgttaaaatcttgataacatttcggcatattcatcattgcaaatgatcagataggggctctgatatcctcgataactgcttggctaatgtccaacttaactcaagcatgctaaagtttgatgaagctaaagcctgtgtgcgggaactggattggaaaatgtcatggcctccacctgtgtttaaatgtgattcatctgatccaaggttatttctgcttctacaccaactattcccacttatacaaattttcatacatcataatatgcgttatctaccacgaattcatgtaaaaatgtgaatgcgagtatctgatagtcatgtgcgtcttcacaacttttggttaattaaaaattcatgtaaaacttgcaggattagtacattgttgtgtacaaagacatgggagtttttctacacttctttgtgtaatacgcttttgcatgttttatgtttttggtgaacataccctcagcattggttaggaacatgttctccaatgctgtttgagatacaaatttttttttaatgattgatgcctaagtaaaacggtttttccaatgcagttcaaaatacttatggtatacaagtgaaatcgaggcggctgagaaagctacaacactatttgctgcggatgttatttacagtgacgatctgactgatctgtttttcagcatagcaaagaaactgatgtctcatggtgctgagaaggtatcggtttatccggttaccgtcattttttcttaaaatttgacaaataccctaagacaagatgtttctcctctccatgctgaagacttggtattctccttcgtatctggtaggtattgtacttgaccctggagaagagatataacttcagtatggacgaactagatgttgtagccaatggttacaagcacttccgaagtttcttcacggttcaggatggtaggttgtttgcaaagcattttgatcagctaagaatacgtagaattggtatcaggatctcaattgtctgtgttcattccacagtactcagtctttcatttttcacaatcttttgttcgcagaaagcggagctctggatgataattcatgtagaccagattttgttggagagcagatggaccttgcagaggttcctcagtacatcagagaatatgacaggggcaaagatttggagatgtggaagataatgtacaacccaaatccagaatagcaatgtcttttacagaaattacccgctttttaatgtaccactacaatgcatttttgcatgtttgtataactgtgggtgtgtttagttctttgggtgtaaagtttttgaagtatacggatatacatttgaagtattaaacgtagactaataacaaaacaaactatagattccgcatgtaaaccgcgagacgaatttattaagcctaattaatccatcattagcaaatgtttactttagcatcacattatcaaatcatggcaaatcatggcgtaatttggtttaaaagattcgtctcgcaatttatatgcaaactgtgcaattggttttttctcacatttaatgtcccatgtatgtgttcaaacatttgatgtgatgttttcggctaaaattttttggatctaaacaaggcctgtattgtatatggcatccgcatatcataaacaaaagaagagagtgatatgttatttctcccttttgtcatcaagcttgcagactgatcacacagacacagaaggcaggagaacaagaatccacagcatattttatttcgagttctcatgtaaaagaacaaatttatccagagatctcccattctcccctactttaataacgcgtaaaagaccagtaggatgatgatcaccatgacggcgaagcatgcgcaggttccaaccgcagaatcctacaaccacgagtagatcaacacaggtcgatcaattcatccatcgtttgatcaaccccccccccccctcatcgtttgatcaaaaaaataacctaactatagatacctacagatgcgtccctccgtcccaaaaatagacaaatcatgggtttctgtatccaatatttgaccgtccgtcttatttgaaaaaattatgaaaaaaattaaaaagataagtcgcgcataaagtattaataatgttttatcatctaacaacaataaaaatactaattataaaaaagtttcatataagacgaacggttaaacgttagatacggaaacccagagttggtctttttgcttttagacggagggagtacttaccagatcgctgaggttgccggtgtcaggcttgggctccaggagcggcgctgccgctgctgtgtccaccgtcaccgccaccgacgatgacggtgggttggtttctttgagaatcttggcgacaatccgctgctgctgctgctggtgatgatggtgatggtgaccgtggtggtggtggtgatggtgattatggtgatgatgcggcggctgggtgtggtggtggtgatggtggtggtggtggtgatgatgatgatgatggtgatgcatgtcgtccatggctggaatccggatgatgatttgttggtagatcgatgcaaagggttcgtgggttttttttccggtgttttcgtgttgggtttaagttaacctgttggcgagatatatcgatcgatcgatcgacttagagttggagacgatttacgtatggcgtcgatcgatggatgatggatttactgccgtgcttgcaagatgtattctatctgtatgcgactaggggcggcattacgaagaagttaagagaaatttgtaaaagaacactccataagtcgctcgaagtttgacatttcatcccataagttatttttgttgcaaaatcctaaccatttatttagttttgttgcacaacccggacgagagtctagttgactggtgggatcaagaacaaagcaacaaagcaaatgtcaaagtaaggggatgcactcactgcacatgctcttgagttgggaaatctggtgcgagagaaatagacgagttttcaaagataaataacttcaaatccctcaattaatggcaagaatagtggacgaaatannnnnnnnnnnnnnnnnnnnngcaaaaaatcttgcgagaatagcgccttaacatctcatcctctgttgtaattttcctttttttctgctcttctcccccctgtctttcccctcgtcacctttggtgacatttgtacagtgcttatcttctgaaatataaaaccagctaagctggctaaggtttcaaaaaaaaatatcagcctagtgtgcacgtgtttaaccaaatcgatctgttataactaatacagagctaccacaagctaagctacatgagtccatctttccaactgcttgcatttattcttcatgtttcattgaactttttttcgcatacaacaaaactcaacgcgacaacatttaagctctccaaaaaagtgtccaagactatactctagaagtatttaattttaataaagacaatattaacgactcataatttaatgttcatttggctaaaacacatgtacactagagtggtttttgcaacaaaactgagtaggtcaacaaacatttgtaagaaaatgaattatgtgatgaaatgtcaaacttcaagtgatttatggggtgctttttcttttgcaaattctccaaaaattaaagctgaaaatctattgaaactaataattctattttaaaatatattacgctattgacttctagacatgatttttatcgttcgttttattaaaaaaccaatagaagtattatttatttggggtgacagcttgagcttaagaaataaggaggtggctgctagcgcgtctccttcttgacctccggcacaaggaggttatagagctcgagctcgacaaggcagcccccggtgagcgtttcctccattgccttcgaagtgaggctgtagagagcgagctcgatgaggcagcgctgccgctgcttctccccctcctccccaacactcacttcggattgagctaggggccatgttagattaaactcactttggattgagttagggggttattcatctagattagaaagtcatgatgtccgattttataatttatgggataatttggtcttttgcaatagtttaggggttaattcgtttttttcccaaaacaatgtaacacctctcattacttctcatgtacaaagtaaaattactctagaacatgtatatgtactggttctcctagcccgttggcctccattgaataataaaatctattatgacgcgatatttcaaaagcaaaactacacgaaccatcttatataatgggaaattacatcgaaaccgttgaaatctctactatattgatcctagctagctactgatcataacttgacttccattattaactcgtagccatgcatgttggtccatttgacaaaaaaggctggatcgatcacaaaaagataatgaagatggcgacgacgcagacgatcccgacggttatcaacgcacactgcaccaaagatgggaaaacacacacacacacaataacgagatcgcattagctctcaaatcaaaaatcgatccatagcgcttaattagtgcaataatgtggttgacatcggatgcgttgcgtgctatacgtaccttgcaggcggcatcatcatcgccgttggcggcggcggcagcggtggcggcgggcttcggcttctgaactagcggccggcgtacggacgacgacgacgacgacgacgacgacgacgagctcgagattgttactgctgcttagtcgaagaggatcatcggcactgggcagtgatggcaatgcatggctggtcgccggtcgcggtcgtcgtcggtcggcgcctcggccggcgcgcggcggctagctgaattaatccggcgagacgaggttcgacgtcgaggctgggagagagctgatcgctgtggttgtgcggtttgtgccgccgccaccgacggcgcgtcgttggatttatgggcgcgcgctgtcgaccaaccgatcgtgagcatggctaacagatacccacaaatatctctaaaatttagtttttagatttctaattcgattttatggtgtaaccagatttttatctctaggaaatatgttaaatcaactcccaataataaaaggtggatccactcatcactaccaacgttatgtatatataaaaaatggggaaatctaaatcgagagcgctctcggttacattttatagcgtgacgtgttcgatagccgtccattcacgcgtcgttgtcccagttgttcccaccacgcgtcattgacatccccatctaagccgttcgttttcgtcctcattcattcgccactgttcaaattatgggaatcgagagagagagagagagagagagaggggtggaggctatgacggttttgtcccatcgtggcaagggaaggtggaggttgtggcagtttcatcccatcgcggcagaggaggtgaaggctgtggtaggtttcggctgtttcccctcattgtggcgaagaggtagatggatgtagcagttttactccacaaatcacgacgaagaaggggagggtagtgattgtttcctcctaaaattctgatgaagcagcgactgacgacttctactacaacggcgacgagcggtggccgcgatgggattccgcggttgcgggcttcagctgtagcagagacgacaacatgcttttgaactagtaagtaacttttatatgtttcctaaaagttactagtaagtaacttttatatgtctaaaaagtaactatttaaattaccaagctttttgtaatcgattgtgcataactttcgaattgaaagaacttgggtatggaaccttcaaaagtaaattacgtgttactagtaagtaactcctatatgtctaaaaaggaacttttgaattgaaaagaattggatatggaaccttaaatttctccatgtataatatgttattatacatgtttctgatatacgtgtgctagtacaaataagtaatcatgtaagagatgctaaatgagcataagtttaaacttacatgtttctagcaagtaacttttatatgcccgagaagtaactttatgtatagtcgtttcaagtatagacttatttttctttttcacatttttacatgcagcttgttgtagaaaaggatatgaaaattggaactagatttttagggggtcgatgcagcatgttgctttaagtatctgtggcactcgttggtgctttatttttctatgaactacttgtgtgtttaattcttgttttgtgtttcttcttttggcgaacctgatctagatctattaaatgtgggatgtaaattacatgaaaattttttgggatcacctttttatttgattttgggtattccatgccttcttcttccttacttcagttctgttttctgactataatggcaacactggtttttggagaggcgaaggtgccgtgggcttcgctatctttttttattgctggaaatggtggtgctagttcttaggggagccaaaggtgctagttgtggtgggctttgggttggcccatgtgaggaaatttcgggcgtgcggtgcgtttttttgcattcttagaaatgagcgtatgggatggtcgtgaggtttccttttgaagaaagatgcaagttctatttttggaaagcgcgtgggtcgctggttagcgtaatcgtgctaccatgcactaggtagtcatgtttatctctttacccattccctcgtcacgcgcgaactctctccacgtgtcgcctcctcctttcgtagagctgaaattaagagcgagagcttcttctgacttgtagagagtgagaaaggagaagaaaatgattctaatttttagatacatctttagaagaaccgtttaagcaagattttcacataagaaatctaatttttaaaattaggttttacttaaaagaaaactatggataggtcaatcgatgcaaccatctactaactatctactctattcatgcatgaatgtatatattaattttaaaaataatatttcttataaactactcgtcagatctaccatctaagcatattgttgtattcgttgtaattaaatatttacaacaagagatcaaataattatattctgatgaaaaaaatatatgttccacactgttcaaactaagtttcacacgggatagcaacatgtttcaacttgtttttccactatgtttccaaaaaaaaaatgtttcaatagttgattttttttacatcatggacaacataatgtttcaccggtggcggtggctaacaaagctacacaactacctacccttactctttctcgtgtcacgctacttagggtctgtttgacacagctccagcatcacctctcctggagctagagcccagccaaacagtttcagctccacataaaatgagagtggagctaggtagagctatctcacaaaatgaactagaaatgtggagctgagtttgggcagctctacaactccactccagacccaactcctgaagttaaattgagttggagctctaacaaacaggctcttactctctctctctctccactccatatatgcatgcatataacgatattcaaaatactttttctcctattctatttatccgatctacgatccgaacacaccattgcactagatgtaattaaatctttataacaagatatcacataattattttctgataaaagaaaacaagatatcatatatgttttaaaccgttaaaacttcttgttttatatgtgatagtgacatgcttcatcgggtgtttccactatgtttcaaaaaatattttaaatgtgtcaatgcctgttttttcatttcaccacatataaaacttaatgtttcaccggtaatcaaccgaagcatttaaccatctgattttttattttttattttggaatcgggtgttcgtatgtagtttcctccattttacttacgtaggtactctatctccgagccggagtggaacgtgctgcgatcgagatgtatgtgtcggggataataaaagatcgggatcgagtataatacggcgagtgattaatcttcaacttattcaaacaaacacaaaatttccacatctaaatccaagacggaattgctaaagaattgtcgtaagcccccccttttattttttacggttttgctgcctgtcatttgacaaattctaagtacctgtatctttccacgaaatcgtttctctcttttattttctcgaaattagccatatcctctcgtttgagagaagtttctgacgagcaaagtccatcgtccttgcaagcaaataaccaaggattcagagatcaagacgcaaccttgactgaactgaataacagaagattaagcaagtagcagtgactgtccgatccagtgattcgcagatccaagacacgatcgttctctatcactctatcatgtctagtcttttgcagggccagtgagagcgcccattgctgtttctttttgtcctccggaacggctgaacctcgaagcaaagtggatctggagttcttgtgctgcaattttatcgattcaagcatgtcaatcttgtgaagcaatgtctcttgtttctgtgagacttctgaactttgacaggaactgaactgtataaggacaaagcttcaccatcacaatgggtcgtcaatttggaagctgtaacctgaacagagactctgcaactgtttgcctatttggaaaactagatatttcatccttagcatagtcgatgactgtgacgagtgtcattatattgtcactgttatttgttcctctttatgtgaaggccccaataataccatcttagtaataaatattaacctatttctccaacaaagaacactgcacaagatggagataccttggctcttttatcttttgtcagtactatgtatgacaatgttgtctcaggccatccattgtactttgctcatagcctcgtattcattgggagttggaactaggtacaagctttactttgaggattcaggctttgtcagctgctcatgggaacacaatctttaatttgagctaattaattagtaatttaaacaggtgtttccatgctcatgtaatcgagtccaagtgcaaacctattatactctctttttttttctgctaaacgtacatttttagcattgaagagttctgtacataatcttgtctttgctaatgccttttgtttgttagtgctttagtttgtcattacagtaagaaatgaggcgtacaagcagagaactgatgcgaaagagtgtggcacccggagccattgctggccacagatgcagaaatcttgcagaaaatggagcagccaagttctttcaaattcttatcataacaagatagtagctcagtaatctagtcagattgttgtgtcttgttgcactgaagtaaaatagagagataatagtactaggattcctttgctgacagtcagacagaggctttagtccagagctctttagaaggcaatcaagtgtgcttagatatttttggaccataccaaatcttcagataaccaaatcctctttggtttggctttcagcttttcagggaggaaagggcacaaaatcagcaaaatgattaataattagtggtgtaggttcagctgttcagttggatgtcaaatcatctacttaagttagtaatagtgactatgtcaaatcaaatcatctgttattactgagttactattaactgaatgtaactctgctctgcttctgaatttccttgcttagtgccatcaaattttaccatcttttgctgtggaaacaaagggtcaattatatagacaaagtgaatcactgaatctttcatcaactagcaacctttttttaccacacaaatgatagcaccacagcatggtcgagaaggatggagaagtagggaataataatatgttgcgcctgagacagtatttcaacaatcttagtacttggtatagcaattaccaaccatttgcagtccaaaatgacggcactgaaataaagttttgtagcctcatcattcccttggaaaaccagtggttgcatcttgcatcaagtaaaactaaaagtgtttggttaaaagcaaaacaaaaatactcaaaagtggactaatgtgggatccctgactggattttttttgaacctttttaatttttaattttaaaagtaaaccttttcaaaactaatttccaaaatctaaaccttctgaccatgccagcccgtctggcgtggcaaaacaacactgacacgtcacctgaagtaggtgtaacagttttatcctgccacgccagcaaaagcggtgtaaccaaataacgctaccacaccagtgagaccggcgtagccaaatacctctatcacactagcgagaccggcgtgataatattgttttgtcatggtagtttggctagcatgattaaaacattcagattttaaaataagtatttaaaataaaaaaggttcaaaaaaataaaaaaatattcccccaatgttgcgtatctttgatatatcatctctacgttaagattttacacctgtttattaccctcgatattttaaacccgaaatattagggcccatttaagataactgaaattgattgattcatggataatctgatctttgtgatatcttaagagtataaatgaatgcattagcttgtaaaattttaaaaagttgttttacaaacgtatttcaagaaaaaatatataattttctttttgcacgaaaaggtgttgcttggaagcttgggaagcgtacaaacaaaaatcaagaatttttaaaaatatggcatactccctccgtcccataatataagggattttgagtttttgcttgctgtttgaccactcgtcttattcaattttttttttgcaaatataaaaaacgaaaagttgtgcttaaaatactttggataataaagtaagtcaaaaaaaataaataataattccaaatttttttgaataagacgaatggtcaaacagtgcaagtaaaaagtcaaaatcccttatatcatgggatggaggaaataacttttagtatgggtcagtttgcgttttaatgatgttgtaaattacttgtatatccttccttttttttttcttaaagagaaggaaaaattttatgcctcatgagtcttgaattacatgtttttcttaagatataagaatttagtccggataagttccggtttttatattttgagatcgaggaaataacaagctttatttccaagtaatattcaaataactgtttaaaaaaattaaataactcgaaaaaggaaatgaccaaaatgccctcgctcccccctccaccgcttcccctccttcccccggcccccgcttcttctacagttctactccacacctcctctctctctctctcgctcgctcgctctcctctcctccctcgcgcgcgcggccggcgagcggagcgggtcggcaggtgcgcggacggcgtcgtctcctcccccgactccgccgcagcctcccaccctccctgtgccgcctcctcgcgcgcgctgccgccgccggcgagcaggtttggagttggggggcgacgtggcaggcctgcttgctcctctaaccgaattgaaggtatccgtttctcctcccctttgctacttcatgagccgtcatagattggagatccatccgggcgaacaatggattttgtgcggtttcttccattccacacccaatttgttaacccgtacaggttactagatggcagtttgcttgaagagaggattggggaattaatcggctgaacaccgattccccggcgttatgtcctcctctgctctcgtgccccattgactttttgcgttattgtaatggccaaattggccgggttgagtgagccttactggttactgagctgttcttgcttgagcttggagtgaccacattccccggcaagcacggttaaatcctggtgcccgtgaatattacgcatatgcatgtggactttcaaaaggattttagtaagatcagggatgtgcggctggtgtccgtctcttagagcctatgttaagtggtgtatatgcgggggtgtgagtgtggtgtcacgtgagtagtggtgtgtgtgcgtgtgtctgccgtgtaattgcaaaaaagaaaagcttctagtactttaccccactaaaaaagttttggatttctgatgctactagtttcagccacagaaaattgggttgagtttcatttggtggagtgctgtgctccagaaacaagaaaatcttggtgagaacatagaaagttgaatgttgcctgagtgcttaatggcgaaattgtgttggcaggaaatggcagggcaaagatctgattcgcagtcagatgaatcgttcgaatacatgttgcttgagagggaccctgatctttaccgtacagtcttctcgggcccgagccagataagtccgtggattgacccgagcgtgctgactttgcagcaccggatagggagaggtccatttggggatgtttggattgcaacccaccatcagaggacagaggatcatgatcggtaccatgaggtcgctgtgaagatgttgcatccaattagagaggaccaactgcaagccttctcagtgaggtttgacgagatctttagcaaatgccaaggtctaagcaatgtgtgcttcctacatggcatctcaacacagaatggaagggtatgtatgctattagtggtgtgttgatctttcttgtcttgattatctttgcacatcaggccagcctaatagcttattttgtatcatggttttttagatttgtatagcaatgaagttttacgaaggatccattggagataagatggcccggcttaaaggtggaaggatccctttatcagatgttttaaggtacggtagaatttcccacagtttatcacatatactaatattgccatgatcaacgcattacaaattgaaccttaggatttcagcatgtagtttgcaacttcctattgatgttctgactgctgacttggttggttggattatttgtctgatttcctttctcattttagcattggcacaagttcttattgatttctgagagtgattatggtctatttagaggaatttcgtgcttattttcttcagaatgtttcttatatatctttttaattcacagatatggtgctgatttggcccgtggcattatagacctgcactcaagaggaatattgattctaaatcttaagccctgtaattttctccttgatgaacatgaccatgctgtgctgggtgattttggaattccgtccttgctgtttgggctctcactgcctaatccagatcttatccaacgacttggaactccaaattacatggccccagaacaatggcaaccaagcattagagggccaattagctatgagacagactcatggggttttgcctggagcatccttgagatgttgagtggcattcaaccatggcgtggcaaatcaccagatgaggtttatcagttggttgtcctgaagaaagaaaaaccaatttttccatacaatttgcctccagcaatagagaatgtcctttctggatgctttgaatatgactttagagaccgcccccagatgactgatattttagatgcatttgagaggtaacatgcttattatcctgcttttcatgttcaacaatttacattttgattgaattgccattgagttattttttttgcttatatactataatttacaaaagctaatcggtgctaaatatgtgaatccatggaattgtgtgttttaatacttgtattctgttagcttgttgtaatttgaagtatcttatatatttatatgcatttttttcctttgcataattctttactgtcccatagcagtaacttggattacatgttgtcctaattatttctttttaattttgattagtgcaaaagatgtagattacgaaaatactgaccagggaaattctgaaaatctaaggatggtcagtccagccctgccaagccgcactaactggtcattcttcaaggacaagttgcaagtgggagacaaggttcgctcgagaaagcttaaaaacacttgtagtccaacaaccatggaagtccctgatggaaccatagttggaatggaggataatggagagcgtgatggctacattcttgtaaggatccatggtttacatgatcctttgaaggttcgctcttcaacagtggaaagggtaacctatggtttcgctgctggagactgggtacggcttagggaggatgagaagaagcgatctcaggttggaattcttcatagcattgaccgtagtggtactgtttatgtaggtctgattggagtggacaccctctggaagggtgaatactctgaccttcaaatggctgaagcctactgtgttgggcagtttgtgcggctgaaagccaatatttcaagcccacagtttgaatggcagcgaaagagaggtggaggactggctacaggccgtatttcgcagatactaccaaatggatgccttttcataaaatttccaggcaaatttaaccttggtgaagtatgcagttgcttggcagatccctctgaggttgaggtggtgagctttgacaagtgtgaggggatcgtgaagaagtacgagcacctcgaggatttccattgggcggtcaggccgctgttcattgctgtaggtttcttcaccgctctgaagctaggcatctttgttgggaagggcattgctcggccaagaagtcgaaaggttgccagcgtctctgatcagagtgatcatcagcaactacagcagcaagaagtgcaaaacaatgccaatgcagcatggctccctccaactgtggcaaacatgctgtttagagacggtcctacgctttctggataaaatgaaaatcaaaaccagtgcaagatggagagtttcagaactactggataatgcaacgcccaagcaaatcgtagttcatacttagacctgaaacttgtcttgccacaagacctgtaaatatttccaccttcactctactatcatctccatgttcacaaaaacatgttctgtgcttatgtctgtaaattgtaggcttgcagtccaaatcctgatactgtcttttgcttttgtcattacactgcaatctctcagtatccctggattttctgttcccgatccatcaatttgcagttgcatctgcaacgtgatgaacggcatgcgaatatggatgaaaattgccataaacgctggcaacacaatcaacataggaaattatatggcatcatctgcaattctgcatataatataccttctttccgaaaggacttcattcctagtacttgtccagattcgttgctagaaatgaagtctttttggacagaggtagtacaatttcaacctgattaacaaaagagtttgtatagcagaagtccacaactgaaccatacatgggattggactggctgatactatccaccaaattgcctaatttgtaaagaactaaacctctacaaactacatttttccagagagcaacaattacacaacaccagaaccttctgtgtcaatactttttctgagcatcctctcagctgaaacatgaaagctactagtcatcaagtgatactgtgaagctcgtgtgaaggccttcccatcttctcggagaccaggttcagcatctgaactagaaatcaagctgtgaaccttgtgaggatgaggagcaactgccagatgcatcaagtgaaggaccacctgatccatccactggagcttgattcaaccgttctaacaccagcgacctcctcttgcgcaacttcagagaaaacgtggacgcctccaatatgacggggacctgcttgttgataagaaaggcatcgaaacgagagagtgcaaagttttgtttatacaactattatgaaagcttaattcgtggaaaaaaaaaacaatcatgaaagctttgatacctggctattagtctgtgccaccttatgcacatgtaaaaaaccaaccatatcctgatatccagtgaggagttttgctaactctttgtcctcatctggtgacaaataaaatggaaacttaataaaggatatagttgatcaaaatagcaatcacatgacatactttaaagggccatgcttgcttacctggaattgctttgattgacagaagtgtgtccgccaggtgctgccatctcttacaaaaggagcttgataaaactgtatttggaaatgttataacagcaactgcattagatgcacgaaccatggccttcagcgatctgataaatgagaccatgtcccagtcctgcaatacacaaatataattagttgcaagtacataacgatgatattagaaaggtgaaaatatataaattggtctgaaaaaagattcaatgcatcgcagcaaccaatcaagactaatagacatcagtcgcattaaatactttccttctcaaagtatccgcattgtggtgcacatagtgattgtatagcaatccgtccagcatgcgcatttccaccatcttttctgaacaccaataacaaaataaattcacgagtaataacgaatatggtacatgccatcaaattttatgttaataaaaaaaatattatggtagacgaatttatggtaacatggcattgcaatgttagaatgattttccttcagaaaaaccgtctgagcatagagacaagaacccttacctcggaagtttggacaagaatgtggaacaacggtcctggaggacaccaagagtgtctccttcttgagtgctagcacattcaatattctgagcattaagtaaatgcctttccaagggcttccgtaaatcaaaatcattgctaaattcttgcttgttgtctgcaattatactaaactgagtcagaactttgacaaacatcttgatagacagtgatgatagctaataaaaaacacttttaaagcaaactgataggtattatgaacattgctattatcctgaagtatgctaatattatgcatttaggtctttgcccaaaaggataatcctagaatcccatctttcttctggatttggagaaatgtcgattttcaagaaagaacgcgaatcttatgatatggtgggaatctcttatcatcatcatccacgccttaaatgtatcctaatgcccagctcaggtgtcagtgacaacaatggtgcttaggaataagtagattatagaagctaagggctcagacaaaatccattcacgaacaatattatttattttgttttcttgcgtatcctcaaaaatgtttacaagcatgcttttttgcgtattcatggccaacaagaatacaaaggaaataatagtatcacctctgtgttcagcatgagaagtcttctcttctccaaagtatttcttgtactgccaagctatcctcaaagcctcgtcctacacaattacatgtcgagatcaacattaaaataataacacttttcagggctcaagttgactgccaaatattcttcctcgagacatacacttgttcggccatcgctacttgttccagcccccatccctctttgtcgtccatcctcctttgaagatgcaacagcaggtaatgtaccaaggaacaagcggggttccttcataggtcctgcgaagagcagcggttgtttgtgcacaacaccctgcgccatgaagctccgaagcagtaggaggtggtgaggcgcatcagagtcctccatgatcattacaactgatccaataagaaaacccccacctagaatccctgcatccgttaaactagtaaattatggtgaactgaattgcacatcaccataactcataagagcatcagcttttttttttccagtttaaaggttttaccccattaaactcaccgcaagaaccaaactttcctcacggcatctatacatggctaaacacaaaatattgaaaggaatttgtactcctaaaataacaagtaatgcaggtgatcaagatatatcatcgaagcaattttatttgattcctaacaaaactacgcacattgcatttgcaaacatagttagtagtagcatatattgtactatgaaataatactccaattagcaccctttccctaatctcctaggtaacaaccaagcatgtgaagtgacctaaagataaaaggaatttcttacataaataggaataatcgcgttagtagaacagaaaaaaaacgctagatttttattcagcaaaacaataaaaagggtctgcaagcaagaatctgcttactgtcgaggtcggggatgcccgaggagacgaaggcggcgccattaggaccaagcttgactcctgcggcggtggatgaggacgccacatgaggtgccgctgctcgagagaagctgctccggccgacggtctggcctccggcggcggcggccatggagttggcggcgaagtttcacggggcacagatcgagctccacttcacagcggcggcttagactaggagaaggaagggagaagaccgcagcgaggacgccgcggcggcggcgagagcgctcgagaacgaggcggaaacccacggcggcgggaggggtcgagggcgaggcgacggcggtgcctcactacgaagaccacatgggctatttgcttgggctatttcttgtttgggccaagcccactaattaatttcacaatatattagttcaccgatcactcctcccgtcccataaaaaaccaacataaaatgagatgtgatatttcctactgtacaaattatttgtatcagaaaatattacatcttatcctaggttacttttttatgagacggagggagtatgtttgtcgacatcatcatgatgttagtatggtatctaggtactagatgtgttacgtataggtatcgtatctggtatcatcggcactaagtgtgttacctatggtatcatcagcatcaacatggtaggtactagagtttaaggcatcatacttatgtctgtgtgatatcatcacttaaaatgttccttgggaccaacggtataccgatctagtatttattatccgtttgttaatccttagtcatttttttagagggcgactagacgataggatccagttaggacgggatacttaagtgactcctccctcttcctttcctatgtctagctgagctttaacgtgcaagcggatagcaaatgcacttattttttcccttgtctcgtcagctacatcaacagaagggaagggaaggggcatgttaaggagaggaagggagaagaggataggagatgacagcaaggggctcactggtcggtctagcggcgatgacgtgtgctccctctcacactcggttcgtacctggtacctatgggtaccggctagtacctaggtatcaaatcttggtacctaggtactagggctgatatttgtgggcatcattcatgattctccgtggtaccaggcctgatacttggtatcagccatgataccctagacatatcatgactgatacttgataccagtcaaggatgacttacctacccacaataaaggaagcagcacaaggagctagcgaggagtacgatgcaacaacctcagagacccgcataaactctgagattaccctcacgctgagaactactgaccctgcattaccgctggctgttgagaacgcgaagggatgccatattgat

SEQ ID NO: 67563 - DNA, 53700 bp, Oryza sativa
  unsure (1)..(53700): unsure at all n locations
gggttcccacccgcgagtaaagcccctttctccaccagtgtattatgcaacccctgtgctacatgtatagtacagaggggatgcataatgtataaaaaagtggagacataaaatataggggtaggacatactcttattcattcatccattgctcaagtgtacaatagtgagtttccaaccctctatttataagcataatgcatatataaaaagtaaggtgaagggtcttataagtatgttgggctgggtcttcatggtccaagcccaaatgtttcctaataagtgagacttattgcttggatgagcatatataatggtggttgcgttggataagcttatgtactgcgcgacatatggctgaggagttgtgacacctgtagtgcgcaacgagataatatttaaatgttcgacgaaacgtcggcgacctcggctagacgccgggcacgggcacgcggagtatggggcgaatgatgaggtcagccttccggcgaacaccgatgccgaacgcctcagtcatgtcgagcttggtcgggtcggccattccgggcacctcccagtcaaagtggaagagcaagctggcgagagggagctccacgttggcgagcccgaacgccaacccggggcacatccgccggccggcgccgaacggcagaagctcgtagtcggtgcccttgaaatccaacgcggcggctggctcgccgtcgccgaaccgctccggccggaactcctcgggcgagccgccaggccagtaccgcgggtcgcggccgatcgcccagacgttgaccagcacctgtgtgccgcgcggcacgtcgtagccgagcaccttgcactgctcccggcactcgcgcggcagcagcagtggccccggtgggtggagacggagcgtctccttgatgacgaggtgcaggtatcggagctcactgagcgcggcctctgacacaacgccggccgctgcgaaggcttgcctcacctcggccgtcgccttcttcatcgccatcgggttccggattagctcagcgatcgcccaccccagcgtcgtcgccgacgtctcgctgccggcgccaaagacattctgcatgcatgtgatccatatttttagcacgtggattttcatccctcgaggaacatcccctctttttttttttgcatgttatattaaaaattttttaaaaaaattgacaatatagattaatacgaaatatatgactccacaaacatgcaagaccaaattcaactactataagttgcaacaaaaataacaaattaaactgaaaatagttatcgtacattcgtagctatatttgttatttttgttacaacttgtagaagttgaatttaaacttgcatgtttgtggagtgatatatttcataataatctatgttgtcaatttttttcatattttttatgactatttaggtgatatgcacgaaacgaggggatatctcctcgatggatgattttactttcccatatttttattgaagctgcgtagctgaccatcacgaaagaacgaacagattggacttcatggctttcaatggcgatcaaattcgtaccgtaggctcactctaataaacccgagatacaagatacaaaaaaatcagacaattagaggcatagatgagggagaagcgctgaaaagaagcagaggaatgagatcagatagtaggaatttccggaagagggggactgggggaggtctctattagtttctacaggtgatgtttttatatatatactaccttcgttcttcgttttcttcaaatagatgatgtgattaaattttaaaataacatttagaataacagttagatacaagccctacttaaatttatataataataaaataagttagaacaaaataaataatattaatatttttcttttgaaaataagacaaatggacatatgtcatatcaaaagttaacatcatctattaaaaaacggtgcagtgttatctaaaaagttaattacaaatttgataagatagaacaatatattgtatatcagcccacaaatatgtaagttcaaatttaacgtatgtggtatatcacttaataaacatgtaagtttaaatttgacacctatataaatatatttttttagcatgtttgtggggtgatgtaccatagatctatcttttattttttttaagaaaaaagtttgtgactttatatacgatatgcacaaaccgagaggatgtccactccattctaccttgaagacgcagcaatgaacacgaagagagccaactggcccaactctaaggttttgtagtgttcttatgatgttcatcatgtcttcactctgtacactcccatcgtttaaccttcagcttataagctatagccgaaatttgatatgagttacatttcactctttgtggtttttttaattaaagtttaactttcaatatttgattttaatttactaacaaactcatgtataaaagttttatcataattatcttttgttgttctaagcagtaacagcttatacacactactatagaacttcttctaatagggctcggctcatagtagccgattcaattggaaccggtacttattaccatttcccacctccatgggccaaaaaagtatacaaccgatacctttgaacaactataagtactggttttagagaaaaactagcagcaatactattgatattgattttttaaaagaaccagcacctataatgtattatagttgctggctaattaaaacacaggtatccgtaaaaaccaagctaagttgagcctctcattcttatccattcacgctgagtcctctaacccactgttctctcattttcccctcgccaccagcgagcactggtggcaccctctccctcgcgagtagtggcaacatcctctcctttgcgagcggcagcaacaccctctccctcgagagaaacgacgacatcctctccctcgcgagtggcaacggtgacggcggtggaaccgatgccaagtccagcaggcctgagttcggggtccatcggatttggcccccgcgctggtccccgagcagcatctgtcttctccttccttcgacgtcaacaagggtgagcggcggcgcccgttctagtgctctagtgcttgttctgggatgttggatgatgaatgcttgtttgattctattatgagcattcttgtgttattgtgcctttcaattcattttttttgttggatttggagcatcggttcaactcacttgagctgagtcttttcttttcgcaaatcgtacaatttataggtgccggtctatcgatagcgctcctcattagtgcgtctgttagatgccgagtgaaaaatccggcagctatatggctttcccatccgacacaatttacttttgtgaagtagtgacgtaagcaaagcgatgaccgtgcttaccagctaaaaagctatgtactgctttctggttaaaaaccatatgtgaccagatgccatagtgtcaagctggaggacaagttgacagttggaacatgacacggaaaatgatctaagggtctgtttaagagcaggtactgcaaacatattttatgaagataaataagaagagagaaaggcagtgagctacagatttatagccagctgtagcacggatcccaagatacagtgtgcgtatgacatgtgggaccaggtattaatagtgtagtatgtaactattgtatgaattagctattagattggctatagatgaattggagttagtagttagttatactattgaacttgctctgatagagcttcaatttttccatttaatgtaggagttaggtataaagtggagttgtggaacagtttaaatccagctccacctatcgagttaagaacactctacctagctgtgctcctattttaagatggagctgaaactatttggctgcgctccaacttcaggagagatgaagctggagctatgctaaacagtgccctaagataactcgtggggggcgtagtcacttacatggatgacagacttgatgacgtccatgtcaaacgggaactggagcccaccctccttctgtatccttagcaaaacatcgatgaggtcctcgtcggtggctccagcgccgccgccgctgctgccattcttctggaggtgctcctggatggtgctttcgaggacgctggacatcgtgtcccagcatttcttggcctggcgtatggtgccggtgagacagccggcgaggcgcgacgatggccacaagtccgccgggttgaacccggccgtgagctcgatggagcggtcgagctcgcggaggaacacgtcgcggtgggggaaccggtcgcccatcacggcgcgcacggtggagtcggacacgagcgccgccaacagcggccgtatctcgacggcgcacccggccgccgcgtagccgcccacggcgcgcagcatggcggcgacctcctcctcgcggatggcgcggaaggaggcgacgcggcgcgcgctgaggagctccgtcacggtgatcttccggagctggcgccagtagtccccgtacggggcgaacacgatgtccctgccgccgttgctgaacacgcgcgtggtggagctcagcggccgcgtcgcgaacgacacgtcgtgggtcttggtcacctcgcgcgccgcctccggcgacgacaccaccagcgtgggcacctcgcccaggcggagcatcatgaccggcccgtggcgacgcgccaggtcgcgcatcgcttggtgcgggagcttgccgacgaggtggtgcaggctgcctatgaccggtagctgccatggccccggcggcagccgcagcgcgccagagccatgcgccgccgacgagcgcctacgcctggcgagttgcacggcgagcagggaaacgagcgccaggccaaggtacagataggtgtgaagatctgccattttttgtgtgtggtgtacgacgatgcttctgcagctgtgttgggaagtgagaggctctatgtactcgtatatatacgcaattcttgggtgttggttttaatggcgtctatatggagcaccaagacacaagagtctttcataatcagatgtgttctgtttttcacaaagaattaaatgtacattggtacaactaaaattaatgagtacaaaacaggaggtttgattatggtaacaaaaatgaaagtacaagtacgtattacgaagtaccgctaaaggacgagttacactacttacatgcttttataatatatcaccctagctccttcctccctctcgagacgtttgtaaaaaaaaaactactcccccccgggacccaattaaatatttaagggaggaaatttttttaaaagggtttttttttttgggcccttttttgggggccccaaacccccaaaaagggcttaccactcgtcttattcaaaaaaatttgaaattattatttatttttttacttactttattatttaaagtaatttaagcacaacttttcgttttttatatttgcacaaattttttgaataagacaagtgatcaaacagtacaagcaaaaacttaaaattcattatatcgtgagacggagggagtaattgttcatgctaagccatcggtgactctcttgccttggtaaataaaatttaccacagtacacgttctaactaagacctccagaaaaatttaaatagattccatgtagtcatttttaattttttttccatcatgatagtatgacgataaattatctctttatcacaagtattactacagtgaatcaccattttgtttttcaaaaaaaaactacttactgaaattctagaaataaattaaaaaaattctacattgtcaattttcccactttattttacacaaaaaatcaacatataggttgggcaaaggagaaaggaactctcatcttagattaagtttcctataaataacaaattatggaaaatgaatcttgatattttaatttgtcaaaatttccttggaaaaccaataggatttagaggttggtggacgggagcgtccataccctcatttcaaattaggtttcttataaattgaaataaattagcggaaatgaatcatgatatttctaaaatttagcagaaaatcaaaaaattttgaagagggatgggaggagagaagaaaaatactatgagatatggatgctcagtgccaaaccaactggcataagggttgggtattggtattgagacatttaacttcagtgccaatagccttaggcgcgagctatgggtccactttcatagtaaagtttagaaaggggccattgtaaaataagtttttagaaataaccaaattgtaaaaaaaaatctggttatttgacactttttgatatggtgtgtaggctcgtatttaccacgaacaaaatagtgttggaattaatagatgggctaaggctcatccgaaaattaattctttagaaaatcacaaaggcccacctcatgggatggcatgcatgtggagtttagtaccaccttgcttattctaggagagggggaccttcttaaaagggaggatgccctcctagccacttgaagcatgtgtggtggagagaagaggggaaaaacgcgcgcacgctcgctcgcctagcctgggcaggtggcccgcgtgcacgacgtacacgtcgaatggtctgcgggaaatttggatttgttttgtttctgtttcaaaaaaatccggtgcgtggagtccggataggtttacgcgctttgtttctttttccaaaaaatgcccgcctaattcgaaatttggatttgttttgtttctgtttcaaaaaaatccggtgcgtggagtccggataggtttacgcgctttgtttctttttccaaaaaatgcccgcctaattcgaatggatttgttttgtttctgtttcaaaaaaatccggtgcgtggagtccggataggtttacgcgctttgtttctttttccaaaaaatgcccgcctaattcgaatttgttttgtttctatttccaaaaaatccggtgcgtgaaaacggcgtggagtccggataggttacgcgcgacttatccggttcggtttacacgagtgcaaaaatccggtgcgtgaaaacggtgtggagtccggataggttaggcgcgacttatccggttcggtttacgcgagtgccctgatcaggcgacctatctctatataaactgagccgccggtttacacgagtgcaaaaatccggtgtgtgaaaatggcgtggagtccggataggttatgcgcgacttatccggttcggtttacgcgagtgccctgatcaggcgacctatctctatataaaccaagccgccgccttcacgcaacacacgcgaaatctgtcagggttacgggttaggcataccctttacccttcgatatacgttacatatcggtatggtatacccgcgcgcatacagatactttctgtatattctatggaaatccttcacggaatctacggatgggaagaatcctactcggacaagactgggtcattgacgtatcgaatagggtctgatatctccgagttctacttggagacctccagatctgtgatataaaaaggaacccccggtgagggcttaaggcatcgaatctcagagccaacacaacccacatagcctatgaagccggagcctgcaaggagccaagccatcgagatctagtcgaaccaactcgactacgatctcgccggatccgacaagttccattgttccctttgtaacctgtgttttccaccatataatcccatatcaactggattagggctattacctaccaaggggcctgaaccagtataatcctcgtcttttgttgcttgatgtcgtattacgtagatccttgtaccaacgtaccccaataccctctatatccggtctatgggtaccacccgtcgacagtggcgcgccaggtagggggacttggtactcaaggttctactactatgtcatccagcttcgtcgacaacggcgtcaacaccaacctctgccaagtacaccctgcttcaacgatgctggtgtggactcaagtcggcgaaatcgtcttcccggtttacaccacaatgctgatctcaaccggtcccccaatgaccggaaacgagaacgtagtggctacaaaccaagacgacttcatgtcgaaaaatcctcccgctgagacggagaacagagcatcgacgacatccgagctcgagaaggattctgatgcggccaaaccttgttcttccgacatgaaccgcgagccgacaaagatgacttccgaagccacaaggtcctggtgttctatccacaaaaccagaaaacacactttgcaagcctgctgggttttcctcaacgtccgcgctgaaattcacgcctgcaaagagcgtggaattcagcgtgtttctccaactcgtgatgtctattgtcctattcacaagacaaagaatcacggcctctcaagctgcaaggtctttcttggcgccatgaaagatccgtctcctaagtcatacgtccccatcagggataacgacaaggaacaaggagcgacttcaatttcagatcgatttgttggggtaatcgatatcgatcctcacgaaccatcagtcttacaccttctcgaagactatgggtcatcgaaaacgagtgtgtcgtgggaggtattggctatcgatgacgttggcacgtcagcgcacgccaacgcagaagcaggaggacaattgactactccagcccagcaccataagggccattcaagctatactgagggaaactccatacgatcccattctgaacgatgacctcgagcgtttgatagaacgactacgggaatcagtgaccaacctcagcaacacgttcgaagaagccgctatcgcagcacacccggagcagccaccaactgacgatgtcaatggtgaagacctggaacggagggaatcaccccaacgagctacccctccacctcgcggcaccggcgatctccgagatcacatcaacggccgccgagaggcacgacgcacacgagacaatgtgaatcgttctcggcgtcatgtctcttcacggcgccatgataacggaaatcaaagagaccgctcaaacgaggaccgagaccaggacaaccaccacgatcacaacgatcgcgaacgacgggtgcgagacaatacaggtcgaggccgtcgccataacgacgatgatgacggagatcggcgccgagacaatagtgggagacgacgacaggattcccgagatccaggccgacatcctcgtaatcgtacgctggaagcaagcgacctgtcgtcatcgtcatcatcctcgtcctcctcatcgtcagacagacatccacgaaggacacacaaccgccgacaacccaccgcccccaacgctgggtgtagggctttcggtcgttccctacgtgatgtccgatggcctgagagattccgacctagagtaatagaaaagtatgatgggagcaccgacccagaggagttccttcaagtctactccacagtactctacgctgccggagcagacgacaacgcgttggcgaattatttaccaactgcgttgaaaggttctgcacgttcatggctgatgcatcttcctccctactcaatctcttcgtgggcagacctgtggcaacagttcgtcgccaatttccaaggaacatacaagcgccacgcgatagaagacgacctacacgcgttgactcagaactcgggtgaatcattgagggaatatcttcggcgcttcaatgagtgcagaaatacaatccccgaaatcaccgatgcttctgtaattcgcgccttcaaatccggtgtcagagatcgctacactacacaggagttggcgacaagacgcatcacaaccactcggagattgttcgagattgttgagcgatgcgcccacgcagatgatgcgctaagacgcaagaacgataagccgaagaccgggggagagaagaaaccagccacggacggatttgagtcaagcaaaaagaaaaatcgcaaaaatgggaaaaggaaagctcaagtggaagttctcgcagcagaatatgtgaaccctcccaagcgcccagacccacaaagtagcgacacaaagaaagcatggtgccccatacacaagacggacagacattccctggaagattgccttgttttcaaaaattcgctcgagaagcacatcgcatttgaaaaagcaagcgagtacgcgtggtcgagaagaacgaggaggaggttcctcacgaatcggatccagcgtatccagactccgacctccacgtttcacacatctttggcgcttccacaacgtactcctcaaagcgagaatacaagaaagtggaacgtgacgtttgttcgacatggcagggggctgcacccaagatgaagtggtctgagcagaagatagagttctcggaagaagaccaccccaagaccgccatcatcccaggacgatatccgatcgtggtcgaacccactattcggaacatcaaggtagcgcgagtcctcatcgacggtggcagctcaatcaatcttcttttcgccagcactttggaagcgataggaattccgcaaagcgaattgacaccaaccgatcaacccttccacggaattactccccaatcatcgtccaaaccattgggcaagattacgttacccgtgattttcggccaagccaacaacttctgaacagagcagatcacctttgatgtcgctgaattcgacacagcttacaatgccatcatcgggagaactgcacttgcgaagttcatggccgcatctcactacgcgtatcaagtgctcaagatgccgggactgaatggaacaatcactattcaagggaacgcaaagctagcggtgcagtgcgacaagcggagcctcaacatggtcgagcaaacgcccagcccactcgccacgactacgccacccaagaaagtgagtaagacaaacaagacgccgaaaccagacggcaccatcaagatcgttccactctccagtgccaaccccgacaagaccgtcaagatcggggcgacactaaacgagaaataggaactcacgctcatcaccttcctccgcgataatgctgacgtgttcgcttggcagccgtccgacatgccgggggtccccagggaggtgattgagcacaaactcatggtgcaacccgatgccaagccagtaaagcaaagactgcggagatttgcaccagaccgaaaacaagccatacgagaagagctcgacaaacttctcaaagttggctttatcagagaagtacttcatccagagtggctagccaatccagtcatggtgcggaaggccaatggaaaatggagaatgtgtgttgacttcaccgacctcaataaggcatgccccaaggatcacttccctctccctcgaatagatcaactggtggattcaacaaccggttgcgagttgttgagcttcctcgacgcttactctagctaccaccaaatcaacatggcaaaagaggacgaagagaagacagcattcatcatgccgtttggggtattttgctacgttaagatgccgttcggactgataaccgtagggaataccttccagcgtacggtccagggcgcacttagcgaccagcttggcaacaatgtcgaggcatacgtcgacgacatcgttgtcaaaaccaagacatgcgactcattgattgccaatctgcggcaaacgttcgacaacctccgacgatatcgcctcatgctcaatccagagaagtgcacgttcggagtaccgtcgggcaagctactcggattcctcgtttctggcagaggaatagaagcaaaccccaagaagatcaaggcaatcgagaacatgaagtcgcccacaagactcaagtaggtacaaaagctaaccggatgcatggcggcactgagcaggttcgttgctaggatgggagaacgaggacaacctttcttcgctctgctgaagaaacaagacaaatttgtatggacacaggaagccgacgaggcatttgttgcactcaagcgctacctatcaaaccccctgtacttgttgctccccaacctaatgaagaattattcctctatattgccgccacaccgtattccgttagcaccgtcattgttgtcgagagagagaaagtacaacgaccagtctattacgttagcgaagctctccacgacgcaaagacaagatacccacagatccaaaagctgctttacacggtcatcatgacatcaaggaagctacgccactactttcaagcccacagagtcacagttgtctcctttttccctcttggcaaagttgtgagaaacaaagatgttgtcggccgcattgcgaaatgggtagtcgagctgagccagtttgatgtccactttgtgccacgaacagccatcaagtcccagatactcgccgatttcgttgccaattggactatgccggataacaagttagacaaccaagtcgataacgaaacatggacaatggcgttcgatggcgcactcaacagccaaggagcaggggcaggatttatcttgacgtctccttctgaagatcaattcaagcatgcaatccacctcaacttcagggcgaccaataacacagcagaatacgaaggactactcgctgggataagagctgcagctgcacttggagtcaagcgactaatcgtcaaaggggactccgagctagtcgcgaaccaggtgcacaaagattataaatgctctaaccccgagttatccaagtatcttgcagaagtcaggaagctagagaaaaggttcgatgcgatcgaggtccgacacgtctaccgcaaggacaacattgagccagacgacctagcacaacgtgcgttcagacgagaatcgctcgagcctggcacttttctcgacatcctgacgaagccatcagtgaaagaggttagcggcgaagttagcccggacacccccgacatcgagaccacagacgactggcgcatcccactaatcaaattcatcaacatcgaggagttgcccgaggacgatacagaggccgagaaaataacccgtaaagcaaagatctactgtatggtcggcaacgatctatacaagaaagcgccaaacggggtacttctcaaatgcgtctcgtccgacgacggcagacacctcctcctcggtatacatgaaggcatatgtgggtcacacgccgccggtcggacattggttgggaaagcttttcgacaaggctttttctggccaaccgctcttaaagatgcatgcgacatggtccagcgatgcgaagcctgtcaattccacagtaaacacacaaagctacccgcgcaagcgctccagactatccctctaacttggtcgttctcgtgctgggggctagatatacttgggccattcccacgagggcagggcggctacagattcctattcgtggcgatcgacaagttcaccaaatggatcgaagcagtacccacgggggaaatcaaggccgacaacgccatcaaattcatcaaagggatattttgcagatacggactaccgcaccgcatcataactgacaacggctcccagttcatcagcgccgatttccaggattactgcatcgggctgggggtcaaaatatgcttcgcctcggtctctcaccctcaaagcaacagacaagtcgagagggcaaacggcatagtactacaagggataaaaacccacgtctacgacagactcatgtcacacgacaaaaaatgggttgaagaaatcccatcagtactatgggccatacgcaccacaccgacaacgtctaacaaggaaacacccttcttcctcgtgtacggctctgaggctatgctccccggcgagctacgacatcagagtacatgagtacagaagcactccgacgaggaccagggggaacagcgggacatcgatgtaaatcttctcgaggagcatcgtgaacgggttgccgtccgagcagccagctatcaacaggccctccgccgttaccacgagaagcacatccgagcacgcatactttcgatcggcgactacgtcctccgacgagttcaaagccaagcagggcgaaacaaaccctcaccaaaatgggaaggaccttacacgatcacacaagtcttgcggctaggcgcattcaaaatcgcagacggcgacggtcgcgagttagcaaattcttggaacattgaccaactacgtaaattctacgtatgagtcaataccatccatacctgtaagacatcttacagtatcaatgaagcctatttttaggcccatattacaaccaaagtgttttcgcccgatgatcccttaccctgatgacacctagcgttgaaacctgtccttatgtccctttacgccgtcttggcaaggcctccgaggaacctaagggatcttcggctggggacgcccagagccgataaggtcttgtcagatcctgtagagacgaaagaccatgtaagatctggtcgtgtaagagttctcgccgtgcgtattaaccaagccgtgaaatcggaaatcaactttccaacttcacggctgggggctaggatcagagcttatttaaccaaggcgggtcaaaggtccaagagccttatcctccgagaaaattccttcgacgacaaggctgggggctagggagagtgtgcgactcaaacggctgactaaagtcgttaactgagaacgcactcttacacacgacatccagagtaagagacatttgttaaagatagatttctttactatttcacacaatacttcttacagtttttacacaaatcttttctacattacatctttttcctaagatatttgtcacagggtacgaaaactaccaagaaggccaacgccagtccatagactggaagatcttctcggccaacggcgacatcgacctcgccagatggtctatctccgtcggagtcctccgagaacgagcaaaaccctcatggagaaattcgaggtccaagcgcgggcgatgatctcgtaggcaagccaacacgtgccctccggcgtatcggcttgatcgacgacactcctgcttcaaggcctcgtcgatacgcttgccgatgccatcgagttgggcacaggccccgttctgccacgagatgtacccggccgccgactcctcaggatctccgcggaccactcgaagttctgtacagactctggccatggatgtgcagcaactcttcaagtacgagttaaaccacacctcatgacctcggagcgtttccacagcctgctctttcttcatggccagcatggttctctcgagttccgccacttcaaacttcatcttccagtattggatacgacgatcttggctagcaagggcaccctctaggtcggcataatttgataaccactaagtcaagctgtacgcctctttcgagaacatggctgatctagtcgggagggcatcaaggggtgaagggactactaacctaaggaagtcgtcgttatccctgtctccgtatcaagggtctgatccacattgtcgggcgacacgtgtggttcaaactcgagtaccggaattatcgccagtgactcgggctgcccgcgctgctggacatcctcgtcatcagcatctctacaaaggacaagagttcccgaggtcaacatacaaaagtaaactaggatgataattgcccgcacgaaggtggtcagaattcaggttttacaaattgtgccttggaagtacaagaagtcctactcttcaaatagggggagaacagactcccccaaatcaccgacttcttccatcacctccctccgcgtgtcactagccgccccatgatccaagatctcgcgcagatcgagttcaggacgcgacagctttacacacgcgaggacatgacacgccccggtgtagatcccgttcgacgtctcctccatgatcctggctgcatgcttggaggggatctcccccatcgccgtcgccagttccgcaagggaggaggtcagcgagaactcgtcgggattcaccgggatcgtaaacttgatgccgcactccccggcgagctggtgcaggccagtgtaggtgacccgcaacgagccccggatctccgacaggttgttcccgagatccgacatgcggtcctcgagccccttccgttgtcgctcgttgccggccaccaattccctcatcttcgtgaggtcttcacgagcttcagccaactcgcgcaccagccgatcagcacgcgcgttcgccagcgctgcttccgacctcgcctccacaatctcgcagccgatgccgcgagcacccgcttcgaggaggcgcccatcttgacttggagctcctcccaggtgaggatggcagctggtggatcatgacctgccgcgggatcgctgactggaccgctaggcgtcgcctctcggctcccggctgcgggcacgacatccgtcgaggccgcggcaggcgacgcgctggaagtccctccggacttagcttgcgcagcctttgcccgcgcctccctacgggacgaccacgggtcacacaacgcttgtatagaatcacggaaatctaaaaattcatctacttacttctcgccgatcgtcacaatatgttgtcgtcgtgctggtgggggtgacgtgtccgaggcctgaaagacattcaatgcaaagtaaggcaaaatccttctggctgcacaatctgacgataggataaattaccgagggggtcggcgccttgcgacgatgtccgcttacagaggagaacttcctcccctttgtcggaacattgccaccactagtggtggcagcagcagcatcagacgcctccttggcgaccttctctttcagagacgccgccacctgatggtccatgagtggctcgatgatgtcagtcagaggaagagcatacgcttaatcaagtcataaggtgatctcgaaggaaaaatccgcgatgcttatcggatgcacttatgttgatagcatcatcacgctcagccgcccccttttcacagaggggcgtggggatgttgctcgccgttgtcggaccgctgatcatcacctggccgacacggcactccacggcctcgatgtttagacctgtgaatcgagaaccaaatttcgatgagtcgataggaacgcgaacataagcatgtcaggataaatgtgagaaagataccccgaggagaaaccctggtcgcgtcctccggtccggaatagttataagctggataggcccgagcctggagcgactggatccgcttattaacgaagtctgcaacgacttcataccccgacaagccccgtactcggagatcatcgatgatgtcgataaacgactgaagagagggggtcaaggggggctttgcggtccaagaagaaatcttgtccggttgttctttgggaacaacaaagacggggttcgaatctttgatctcaaggtagaaccacctattccgccatttgctgcgagaagaagggcactggaaggggatataacgcgacttcaggccttcccgaagtcggaacccgacgcaaccagataccctgttggattccatccaacgcagttcatagtaagagcgaaagagatcaagaaaaggctctaccccaatgtaggcctcgcaaagatgggcaaagatgctaagaaaggcaatggaattggggttcaaatggagaagagaaagaccatagaaattcaaaaccaggagaagaaactcggaaggtggagtgagaagactgcagagaacataatcttcgatcgcaaccatgcgacccaagatgggctggggattagtacctcctgtttccctctccatggttccatggccaggaagggcgccgtattcctgaagcttcttcagcgacgcactggtggaagatgacttgccgaggttgattgctgattcaagatcgccggagaaagggcctaggttgatgaacgcttacaggtggaatgttttcaggtggaatgttttcaacacggttggcagacttcaaaatggatctccaaaattcctttaaataggcgcactaccgacggtgcgaattccaaggacagagagagatgcccgccggaaatttctgggtccgttatgcgcggcggttttttggacttcaatttaaaattcgctcatgaccgttgggctttgaatggcatgctcggctacggcctgtctccgcggtcctcgctccaggaatgacaacagtctcgacacccgaagtcgtgaatggttacacgagcccatttttaagcagaagtcgggggctactgtcagggttacgggttaggcataccctttacccttcgatatatgtaacatatcggtatggtatacccgcgcgcatacagatacttcctgtatattctatggaaatccttcacggaatctacggatgggaagaatcctactcggacaagactgggtcattaacgtatcgaatagggtctgatatctcctagttctacttggagacctccagatctgtgatataaaagggaccccccggtgagggcttaaggcatcgaatctcagagccaacacaacccacacagcctacgaagccggagcctgcaaggagccaagccatcgagatctagtcgaaccaacttgactacgatctcgccggatccgacaagttccattgttccctttgtaacctgtgttttccaccatataatcccatatcaactggattagggctattacctaccaaggggcctgaaccagtataatcctcgtcttttgttgcttgatatcgtattacgtagatccttgtaccaacgtaccccaataccctctatatccggtctacgggtaccacccgtcgacaaaatcaatctagggtttgcctcctactttgtgctgcgccgtcgctcgtagattactctatcccgctcacatgcgaaatcaatctagggtttgcctcctactctgtgctgcgccgtcactcgtagactactccatcccgctcgccggcgtgcaccggcgatcgggagagtaggtctccggaacctctgccttcgacgtactgcaccgggagaaggcggcaataaggtttttgggaagcacttcgcgcgactgctccctgttcgtccgcgttggctcgccttcctctccgccccctaattgttctgaagtggttttcgtcccacgtggtgtacatgtggtagtctgatcggtattttttaaaaaaaataatcggtgggacccacatgtcagcttctctccccctcaccccctttctctctctctctctctcttccatgattcatccttctctctctctctcatctctctcgcattttgtgcggcgacgacggtggtggacggcggtgtcacggggagggcacggcagccggtgggccgagccgaggagaacggtggaggcgacgggcggcaccgaggaggacactggaggcggcgagcggcagcgctcgtggggagggcgcggcggccgatgggccatgccgaggaggatgatgggggcaacgtcggcgacaactggctggaggaggtggggttcgaggtaagggcggcggccagtgatgaggctttgaatggggaaagtggccagtggcggtggtggaggatttctaggcctcctcccgcttcagcctatattcctcctcctcctcctcctcctcctcctcccctctccttccagcaccgctctagccacagcggccatgtcgggctcaggatggggcaagaaagatgaagaagggggcggccgtgggagtgggaactagttacgtgactgggcgggctcaagtgaggctgtcttaggcgaggcgggcgtcatccactgccgtccctcttcctctcctcccccggaggtatatggacaccggcgaggcgagcctcaccgctcctcatcccttcctcccgcctccacccactcctcctctttctccgcctcctcctcggccgtggctatggcagccgacgtccagccttcatgtcctgcgccgcagaccaccgcctgcccctgcgccactcacctgcgctcgtgctcgcctccttctccaccacgctcacctcgccgtagcctcgccttgcaatgcctcccccgccaccgcgctcgtgttgcctcgccgctgcctccgccgtcgccctaaagaagagagagagggagtgagagattgggaaagagatagaggagagacaaactgacaggtggggccacctatttttttataaatgaattgctgactagactgccatgtaggatcaaaaccaccgcggattgagccggaggggttatttgtccggtttacaagatgaagaatgtccgattttgtggattggggggtaattcggtagagcgcgatagttcgggggaggggtaattcatacttttcccccacatatatgaaacattgagtaccaacaagcgaaactagagaagtaatacgagagatacaatatacttgaaaaagcacaatattgttgaaatattttttttacatgaatattaagttgtagctattgaaaccctacaaaatgcttaccaaaacattgcaagaacacggcatgcaacatttgcaaattaactagtgaaacatcatacgtatactagttgaaacattcacataaaacatgtgcaacatttaaaaaatacattaacaagctaaatattatttttattgaaatactacaatatgtggtattgttctaaagatttaattgcaaaaaatttagcggtgtaattatattatagattgaacaagtaatttaagagaaaaaataatttaaggattgctaaaaataggtataccaacccaactaaccatggttatttttactagtagtgaatttagcatacatgtatctagtagtgactaattacatatggagctccgtaggatgtagctccgccaggtctccataaccgtttgctggttgagcgacggaggctgaggagtgaggcaggtcgcgtcatcataattggtagtgctaactatatatcggacaacggtcagtcaaaatagctaggtccgcttattcagtccaactatttgtggtagcaccaatagtacccattattatgccgtgtttagtttccgtcctattcccaactttcgatcacataatatcacatcaaaaactttcctatacacataaactttcaacttgtttttcaaactcctaactttcttcaaactttcaacttttttcaggaactaaacacacccttacactggtagagaaagtgtcttttctccccccttatactcctggttttgcaaccggaagtatgaatccgggactaaagatgagtatctttaatcccagatcaaataaccgggtcaaaatcaatttttagtcccggttagtgttcccaaccaggactaaaaatgctagagctagaactggcgacgcgcagtttttttaattgttttttttctcatattgatttcactaatcactacatcacctaatcatccccaaatagagaaatccccaagtcatccccacatcacatctccaaaatcacagatcaaattcatcataaattctaaaaaaattacatcacaaattctggaaaaacaatcacaaatatatcacatattcacaacacagatcacatcacaaattctcaaaaaaatactacaaatcctaaaaaaaagaaaacaaattccgaagagctctgtgcctccccagccaccgttgctccaccgccgccgccggatctagtggaagggagcgcgaggcgccgccgccgaccccgcccgcccggccagccgccgccgctcccgcccgatccagcgcccgctcccgctcctgctcacccggccggccgccgctgctcccgcccaccggcctgccgccgccgctcctgcccgatccagcgcagcagcgctcgcccgccgccgctctcgacttgccgccgccgccgaccccaaccggccgctgctgaccatagaggtcgtggtaggaggaggaggcggggagggggaggagaggggaacggggaggaaggagagaggagagagggatcagagagagacgattgagatgggatcgaggctggatagtggagatggttttaatgagagaggaagtggagatggtttttatcggtcttattgataagaccgagagagagaggactcggcgcgcgctcgggaggatttttgtcctagttggtataaagaaccgggactaaagatctatttttagtcccggttgtttataccaaccgggactaaagataattggggtccaactcgacctgataacttctttaaatcgggactaaaaatgatctttagtcccggttcctattcgaactgggactattgtgatttttaggcgaccgatcaaagatggtttctccagtagtgttaatcttctagctacaacttccactattgctgcagagaagctgcaaagccagcaatctctcctgaatacatccacaaaaatacaaatacacaattttatgatttgtataatgatatttattgataattatttagagccaataacatgacaattagagtttagtctactaaccctacacccgctagagatacatatacatttatatgaccacacttgattaggtttattatggtgaaaatacatgattttcacatgccttaaactggtgtccaataaatgaagattaagtaaggacacaaaatggaaaaaaagtaattagcacaagattaattgagttttaattattataaacttgaaaaatagatttatttagtattttagatcaacttttacaagaaaaaaatcatacgaaacacaccattcagtagagcagtttgaaaatcgtgccgatgaaaatcgagaaaaaatttgcatgtcaatgaaaaaagaacggggcttagaggtcgtgtagtgtggttgaccccatgcaaaaacatgctttgaccaactatataagaatagtttctacagtagtgcagtacgaactaacacattgtaccccatacgtgtacaaaacaatttagtctcaccacacacttataccttatacgtactaaacaatttagtctcatcacacattgtaccgtaccccatacatactaacgtgtacaaacccaataggacagggctattattgcctgaacctgtataatttttttctcatgcacatataagctggtcaatgcagtgcagtatcaattgtctttacataaatatgatcatatacaaacttaaaagcactagtagttacaaaaataatcatccacggacaggactatggtcccgttattttctcccacaaaagttgaatgaagattaagattttcgtggaacgcttttcaaacttctaaacgatgtgttttgtgtgaaaattttctatatgaaagttgctctaaaatatcatattaatctattttttaagtttgtaataattaaaactcaatcaatcatacgctaagaccacctcgttttgtgtaaaaaacttaatcttcatcttcatcttcattttcattatgtaatttagccccatctatgatgagatctgctttcgtcacaaatattaaaaaaattgtcacacacaagatcattaattagtgagtaaattttataaaactgcatatattttgaccaaactatcgcaaaactacacatattcaaggcattgcatcaaaaaactacatatattaacagcaagtttatcgtaaaattacatatttaaggcctactatcacaagactgcatatttaatattgaagttatcaaaaaaaataaagtatagggtttaaatcccttgcaattccattaccttggactacaaacattatagctttgtgttcacatcagcactacacctatagtactcaatctatttattttttataacattttgctaattaatatttatttttataatactcaatcttaaataagttgttctgagagaacttctgcactaaatctatatttttgtgatacaacgccttaaattcgtagttttgtcatagtttgctcgaagtaaatatgctttcgtaaaatttactcttaattggctgaagtatacatatcaatgtacacaagccttcccatgtacacatcatgcacatcaactaataaatgtcaccgaaaaatctagaaaacatatactttcaatagcattatatctatgtataaagtttcatctttaaatttattttacatagtgcaataaaaagacaaaattctaataatagacttgtagtcttagaactgccaaattttttatggctaaaataaaatgaatttaagcttaagattttatatgtaggtgtaatactattgaaaatgtatacataatttgttctagtttttttatgatatttgttagttggtgtccataaagtatgcacgtgaagcttgtttacacaaaatatgttctcgtaatgcatatacgcaaataacgatatagctaactatggtagtagattttttttattagtgggatatacgttttctattttgcacattatttggtgagtatttgtcacatccggataaatttatcccaagttaaaaaccacctttctaaaaagaataatagaaataactaaaaaatctaaaagaaatatcaaacactaaaatacatccaagacaaatttgaaagtggcttggaatatttttatttaattctccatgctctaaattggtccctcaatttttatttgaattttcatagcacaagaaataattttaaatcaaccaaaaaccaaattcacagttaattaaaatggaaaaccaaaaattaaatctctccttctaagcgcgcccccgccgataaccagtggcgccgccgccgcccgccgcaccacctccaaccgtcttcggccacgccgcccgtgcgccagccgactacaccgtcgtcaccccctagcaccgcgtgacgttgttctccgctccggccaagcctcgtcttcgccggccccatcgcagcgccgtcggccgcgccgtctcatcctcggttccatcggctggctatacaatttcgagggctctacacaaactcggtatcataggctcttaagactattcttattcttgtaatatttacactataactacttatatcctttacagagaaagaagtaacatttctaacatgatatacaataaatcatacataataaataatatcgatagtataattgataactaaaaaacgttgcataaataaagtagtatgaatacctcttaataggagatcacaaatatcacttgtctcttataaaaaaactttttcaggtatttcttaaagcaaaatcactaacgacagttttgagatcaatattgtccaagaaattcttatcaatgttgcacataaccaagccattcatgctttcctgcctatgcgaatcaataaactgttcgtctcgtctccttttcttttgtattttttgtgagcacctgacaaatgctttttaggtagagtatttttaccatccttgagtaggtaccatgaggttctagtactgggaggcaccaactccatccatccgtccgttcacaaaggatacgatcggaatagcgcgtctgcgcgtgtggtacccctccgctcctacacctaacatcgtctcttctccgtcttcttcttcgtcctcttcccctccgctccgcatccttgtcttcacttgctttggcgccggcgcacatccctggatggtgcggcctctcctttcctccaggacgccgtcggccgcccatctatagcgccgcctccacccatctatctcgccgccgacgatcgatccacggcgtcgctgcttcataaagccagcctccccgcttcttctgctagcgtctctgtcctccccgcggtagggtgccacttctccctcccctggccgtctccgattctttgtcctttctgctgcagccacagtgcgccgttgccttcatctgtcggctatctccccctttgctcttggtcatcgtgccctgcccaactccgcacagcactagagctccacacttagacagtcatgtcgtgtccatagcatgcatagtggtttgtcttgtgctagtatatatgccgtgcttcaaagctcgcatgaagtacgagtgttcagtattgtgaaaatgccaagttcagttcctggaactctgaaccagtgaaccttgtgaaactcaaatgaagtggaagtgtggaactctgaaccttctttagtgttgtacgcagtggttattcagatcttgtctgtggaatataggatttgttaggaatttatgtcagacatgtattcagaactttctgatgatgactgttcttcaagctccttgttccgttttagttggagtattgttcttgaaaaggctcttttgtaaacctttctgtaattagttgtggttcagcgcataacgatgcaattagcttgcaaacaaatgtctggtttgcaggacttctaacttcttgccatgaggcctctgaaattcgtggatttatattggcttctctagatgagcttctcgagtgaaaagctttgtctgcttcaagtttcctggtggcctcaccgtagccctagctgccaatcgccctggcgctatttgaccttgcagctgccggcgcccttgcgatgcccgtcctcgctctggtggaatgggtaggagggactagaattaatgcggcgccgtcaggatcgaaccgggaggagggaggaagcgggagcactgacgggagggaaccacgaagtcgccggcgttccccatcggcccacctcccccgaggtcactgccgcccggaagaccaccacattggttgtctcaggctcgtcgccgtgttcgcctatacggtttctgttcgatttgatagtcgatgagtagacgactgcatcggacagatggtgctccgctccaacttgattcctgcatgcgaaagtacaaaattgccctcccaccatcaacaacattccgtacctgcttttgcgggagatgtggtaccgctaggtaccaagccttcctaggccgttagattgagtggaatggatggctaggatatggtacctcctccaatcaaggacagtaaaaagcctcttttaggtaacattgtaacacctaaattaaattaaatagcaagaaaaaatcatacaaacaagaaaaatcctacgttcctaatctttcttagaactaatcaaggaggaagtaagaaggctgcctgctatgttgtgcctctggtcctgcactgctgtgcttgctttgattgctgcgagatgggatcactggataaacaaaggaaagaagtactcccttcgtactcataacgaaagtcgttttggacagcgacacggtctctacaacacaattttgacttctcgtttctataaaaatatttgttgaaaagtgatatatgtatacttttatgaaagtatttttcaaaacaaatctattcctataacttttacattttcaaattcaacaatttaaaagttattcaagatttatatttccaaggtttgacttaaacattatcctgaacgacttccttaacgggtatagagggagtattgttattagtaaggtgagccattttaataatttggaatagaaaatgagccggaaaattattttggggctaagtgctctgaaaaaatagttcagaaagtaaaatgaaattctttttttagaaccgtaatacttgacacagattagagcggcataattccgcagctttttccttcaattatttctccacttatttaacagagaagctacaacatggcttgttgtgtttgacatatataattacgatattagcattactagtgacttgtataacggtgattaggagatgtaacacaagaaagaaggctgagcaggtggctgaaattctggcaacgggcgtcgactagacgccgggcacgggcatgcgcaggacggggcgtagcaggaggtcgcccttgcggcgcgctgtgatgcctaacgcctcggccatgtccaacttggcagggtcggccatgccgggcacctcccagtcgaagtggaagagcaggctggcgagcgtgagctcgatgttggcgagcgcgaacgccaccccggggcacatccggcggccggcgccgaatggcaagagctcgaagttgttgcccctcaagtcgaccgcctcggcgccatcctcgaaccgctccggccagaactcctctggtgagccgccgccggcggcggccggccagcaccgctcatcacggcctatcgcccagacgttgaccagcacctgcgtgccgcgcggcacgtcgtagccgagcacctggcacggctccgagcactcgcgcgggagcagtagtggccccggcgggtgcaaccgaaacgtctccctgatgacgaggtgcaggtatcggagctcgccgagcgcgccctcgccctccgacacaacgccgggcagtgcgaaggcacgtcgcacctccgctgttgccttctgcatggccatcgggttccggatcagctctgccattgcccataccagcagcgtcgccaccgtttcgccgccgccgctgaagaggtcctgcatatgaagagatggggggtcattgaatagactataggaatatgtggaagaaacaatagtgaggaagagtgcacaagcatgagcattctgtagttgcatgctcgtggtgtcttagtatcttcaccatgcaacttttagaaacaattatgtaattagaatataatgatagtacatgtaactataatgtaatttatttgtaactttcacgtaattttgaactgttggatttttttcaagatttatgtaagtgggaaagaaaaaaaggcacaacgcacacacgtgtgagaatataatgatagtactctctctattccataatataaagcacatctattttttttaatgttccataatataaagcatgcatgcatgcatacaattaactaggacctattctccattaaattattaattttttaaatcatccaccctcaagatctctaattctattggatacatgcattatatttattagggtgatctaaactaggagatgataataatggtttcttggtctttgggttgagggtggttgtgtcttatattttgaaatggagggagtatcatgttatggagggctttttctaaagttacatacaagtttaatgtagttgtagttatagtttaattacattatgattgtatattataattacaactgtccaatttttgaaaaaaaaaattgtagacaaaagtataggtgatttcttgtactccatccattccatactataagacataactactttttttttataatataagacatgcatgcatacaattaacttagtatattccctccaccaaattattattatttaactctttcatattcaagatttctaattctattggatcgttgtgccttatattttaaaatgaatggggtaactttttgcatgacataaggttggacatctacttaagtgattaattagagttcccgtatcttcaaccgggcacaaaagcgaaaaggctggtgagtgaatgttctacgctttacttctcttggcaccaaataaaccatcggtagatagcagtgatttacactttcgctttcattgaaaatttcggtatttcagcggcaaccgaaatttctgaaaatggggttttttgccgaaattattggaaaatataatattttttcataaatttgaataaattttgaccaagttcacaaaatattgaaaaaaaaatcggcaatatatgtgcttgtcggtggggggcaaaattactgaaattttgaaaatttcgttctgaaattgcaagccctctgtccatatgtcatagtgtcatgctccgtggcaagttgcaggttcctgttcttcataagaaatcacatgaaggcagttgatgaataaaatttaaaaatataccttttttttcataatttgcgtttttatatattgggaggaggatttacgcaaatatacctctcctgcgtgctaggaaggcaggagcgaaacgaatatgcgccgtggtgagccggtcccgcgccaccgttgcgcgcaaccgctgcgcctttcggtcacgcactaccacgccacgcattcgtttcgctcccgcgttactaacaagcgggagaggtatatttgcgcaaatcctcctccccgtgtatataaacgtaaattatgaaaaaacatgggtatattttcaaattttattcggcagttgatcacttacagtgatgactaatgtgatgtcgtccatgtcgagcgggacctggaggccgccggcaccgccatccttgtgtatcctcagcagcacgtccagaatgtcctcgctggcggcggcggcgccggcgccgccaatcttctcctgcaggcgcttctggatgatgcggtcgaggatgcccaacaccgtgtggaggctcgcctcgatcttgcgcacggcgccgctgagacggccggcgagacgcgacgacggccacaggtcctccgggttgaacccgctcacgagctccatggaacgatcgatctcacggaggaacgcgtcgcgctcctggcaactctcccccaccatggcgcgcgcggtggagtcggccacgaccacgcacagcgccgctcgcatctccacggcgcgcccgtccgccgcggccgcgggcaccgcgcgcagcatggtggcgacctcctcctcgcggatggcgccgaaagaggcgacaccgcgccccgagaggagctgcgtggcggcgatctttcggaagctggcgccagcggtccccgtacggcgcgaacgcgatgtccctgcctcccatggtggccgctcgcacggtggcgctcagcgcacgcgtggcgaacaccgcgtcgtgcgtcctcatcacctcttgcgccgcctccggcgacgacaccaccagcgtgggcacctcgccgagccggagcatcatgaccggcccgtggcggcgcgcaagatcgcgcatcgcgtggtgcgggagcttgccggcgaggtggtgaagactgccaatgaccggcagctgccatggcccgggaggcagccgctgtgccgtcgccttgcggctgcgcttggtgagcagcacgccgagcagcgccacgacagccatggcgaggtagacgtaaccgtgagatgcatcctccatttttgcgtcgtgcgccatgcttgcttgagcagctagctttccgttttttgcagcgtggggatgtgtaccatatcgttatatatggatcgatcgagatagctagttcaccatcaagggaccgggttgtacttaatggtataacggataagaatattcattcattatgatagttatgttttatcttcgccagttttacttaaaaaaaagcacaacttaagagcatcactaagagagtacgtattatctccccttgttttttttcctaaattaaaaatagagctgtctatacatctattaacagaaaatcccacctttcatctttcaaattttggaccattggatgtgctttatgattcgtgcaaatgcattaaccctgcctctcctcctctcgttcccctcccatcgcgttcgcgagcggctctgcccaatcccccgctgccaccgccccaccgcaccgccgccagcctcaccggctggcagagggcgtcaacggcgaaggcgagcccacgccccccttcccccgaccagccttctccccctaccccctcctcccctcctttcttctcgagccgtcgacggcgaggtgcccctgtcaccgatgctggcccaccaccctcctccaacgctgcggctccggtgccgccgaagccgcctcgtcgcccgcctgatccgcctcccaccgncgggctaccgcctnccccagccatccctctagagccggcgaactcctccccttccccctgcatctaagactcccaccccaccccaccccgggaccctaacccgtagggtcctcgccggcgccagagaagaagaggtttgccggagttggaggagatgacatggagcacgaatctcaaagtccatccgatgtcctaaaatctgtaagatttggagatgcaaaatctgtccaaaaaagttagcaattccgttttgttaaacaaaaaataaaattctcttctttttttccatctaacgtggtgaatcaaaccaaaattgaaaaataggaagtaaaaaaaaactctccaaaagaaagtctaaattttattaaaaactaaaagtgagccgctcgattaaactaccaacaaaattctcctgttttttccatctaacgtgccgaatgggatcgtgagatcctccatctaacacacgggaaggagaggagtgacgtgggacagctggtgatgctgtaagacgttggggccaccaacttgcgcgcaattgcaaacaaagcactaaaaaaaataaaaaaaactaagggtgagtttgaggagaaggtgatcgaggagattgggaaaacgcaaaacgagatgagccattagctcatgattaattgagtattaattattttaaatttcaaagatagattaatatgattttttaaagcaacttttctataaattttttttttgcaaaaaacacaccgtttagttgtttaggaagcgtgcgcgtggaaaacgaggtgttatctcctcgatgttacccgaacgaacgcagcctaagattattacccacattgggccaaaaagtaaacacacccaacaaacagcagaactagacattttcaagacactactacattgttgtcgcaaaaacggcacataagccactgctattccacttcctcctcgccttgagctagcttcttcttcaccgtcctgaccgccttcatcttggttcgtcctctctttccaagcccctgattctggcaagcagcaagttcttgaaaaagtctacctctccattgatcttcatcgatccagcggcctccactgttgcatcaaattcaccaccttgtcagcaatgctacaaatgttcataatgtatttagagatttactccggtccagtaaaaagtacctcgaggtacttagaatttcacagtatccaatctttttcgatggttgaatataacaatacctatcctgcacagttagatccaacgatcggaaacaatttagtaccgtgaagtaccggtacctcgagatactttttattggaccggagcaagtctcatatatttatcattgaaaactaaatcatttctcataagccaaatggcccaacaagctgcagaaacaaggcaaatacagctaggttgctcttctctccagggtccttcaaatttctgagcaagtcagctctgccctttgcttcgaggtacagagctctagtttaatactccatccgtttcacaatgtaagtcattttagcatttttcatattcatattaatgttaataaatctagatagatatatatgtctaaatttattaacataaatatgaatatggaaaatgttagaataacttacattgtaaaacggaggaagtatatctctcgcacagcaccatataaatcttgctggagcacatctaaacatcacatggtctacttcaatttctccacaaagtgtacagagttggtttcccagccaattcattttcttgagttgcttagcagcttgaaatctccctatcagcattagccatataaaaattttgattttcagggctattggagtttttcatatttctcaaccccccccccccccccaaaaaaaagtctattccttatacgtacaaggatttgactgagaatttgccccatttttttagtttccatttcatctcatctctgttagtactataattgagttgcacttcctgtagcaattccgggccttccattcctctagtttctcagctgatattgttagcaccggtagcaattttggtctcggtctgttctcttgtcagttagcatgatcaatggaaaattttcctaaatgttcctatcaatcgagaggaagatcatgggcttatttttgataatatataattcctgctgtgttgtcttagaagacattcttcaataatgatctttctctcctttaccgagtaaatttagatgagagagatctcttctttcctcttgttaaatatgtagtaactcttttttaatagtctattttaatataattttttatttactgtgcggcttcccctacagtattttttttaaaaaaagttgatcttaactggtacattaatgcggttcagaaaaagaaaacaagtgcttcattaaaacacgtatgctggcccatacggtttagaaaaagacatatataatcatgtttgcctagtgattcttgatggagaagaaagagaaagaataggacggatggatatgtggccctcacagttgtctaactagaccctctcgttattgaatctcttttgtggatttaattttttagaacgtgccaatttcatccaattttatatagcatgaaagttatatgcatttgaaatagttgtacaaaaattaaaagaaaactaaggtaagacattgtgagagtcgttttatccccggtaggtctcaggttttggtctctcatttaaccgacgcaacgaattcaaaaaaagggatggtgtccatatctatttaactaggcgtaaactcctcagcaccggaaccaggctctttacnannnngncccagctccacaactctagtatgttttgtgagatagctccatccaactccattcccagttttggtggagctgaaactatttggctgagctccagcttcaggaggggtggagtaaacgcaagtactataagcatcttatcactaattacaagatgccatgtagactcaaatgatgatgtggaggagaaaaaagaagagagagagaggagcagccacccctcatgtaaggagcaacctccacacaagtttcaagaaatatgagagacagagagttggacaaaattagatgtgaccacctcctctgttataaaacttgacctaagaaggctacctgctgctgtgcttgctttgattattgcgagatgggatcactcgatcagggccggctggctgcactcaatcagacgatcaacagccctcgtcggcttcttcgcttcgaggtcaggagagaaggcgcagagacgatgggagagaacggcgcggcgcagcagtagatcgatgggatcgaagacgaagcgacgtgcggtggcctgggctgaatcctgaatggccgcgcgcccacgcgcccggtgagactcggcctctactggagtactgggcctgtacgtcggctgccacgggtgggggcctgggggatggagagttggtgggtggggccgtccgctctagctcttaggcgatcgcacaaccggcctaggccagagccatccaagaatgctgcatgcatgcagcgttaccggcctagtctgcttttctttgtctataaaagaaacatttaattagtctccagcaaagagtaatgcattgtgaagtaaataagtgaagttcagacaattgtgctttccagcttttcgttgctctgttcctacaagtcctctcagtagtgtgtatttgtgtgatgtgaatccactacaagaagaagtatttttgcaagctgtcaaaatatatttttgcaggcggaccctttctccgtctaagaaaataaatttcgcagacgacctctccatcttcgcaggagctaaatccacccgactatgaaaatattttcaacaaacaaaaaaaaaattctccgccaccacccttacccgtcgccgccctcctcctccagccggatctagggttaggattttgggagggagagggaggggaggggaaaaaccacgccgacgcccttcccctttggccagacttgagaggggatgggagggccctcatctgccagatctggtaggtggaagctaggagaggggagtgcccccacgagcccttcgtgttgacgccacccttcacccctccccccccaccggccggatgggagggaaggggagggccaccatcggccggatctaggatgtgggagctaggggattggagcgccgccatgagccctccgcaccgcctctgcggccctccctcctccgaccggatctgggaggggacgggaggggagggccgctgtcggccggactgggaggtgggagctagggaggggagcgccaccacgagccctccgtgttgccaccactgtggcatgtggtggttgctgccgccacactcccatccttctgtcgaatctaggagggagggagggaggggaggggagccacgccacctgctttgagaagggtggagggtgaggtgaaggagagggaaagagaggtgggagagggaacgaattggtgggagagccattttgataattaggagtgtgaaataagcggaaaattattttgggggctaagtgctctggaaaaatagttcagaaagtaaaatggacttcttttttttacacccgtagtcggacaaaacatgagagatttgtgcggcataattccacggcttttctccttcaattctttctccacttatttaacagcgaggctacaacatggcttgttgtgtttgacatatataattgcgatattagtgttactggtgacttgtataacggtgattaggagatgtaacacaagaaagaaggctgagcagatggctgaaattctggcaacggcgtctagtagacgccgggcacgggcatgcggaggacggggcgtagcaggaggtcgcccttgcggcgcgccgtgatgcccaacgtctcggtcatgtccagcttggcagggtcggccatgtcgggcacctcccagtcgaagtggaaaagcagactggcgagcgtgagctcaatgttggcgagcgcaaacgccatcccggggcacatccgccgcccggcgccgaacggaaggagctcgaagttgttgcccctcaagtcgaccgcctcggcgccatcctcgaaccgctccggccggaactcctccggcgagctgccgtcgccgctgccgccggtccagcaccgctcgtcgcggccgatcgcccaggcgttgaccagcacctgcgtgccgcgcggcacgtcgtagccgagcacctggcacggctccgagcactcgcgcggcagcagcagcggcgctggcgggtgcagccgagacgcctccttgatgacaaggtgcaggtaccggagctcgccgagcgcgcccttgccctctgacacggcgccagccagtgcgaaggctcgtcgcacctccgttgtcgccttctgcatggccattgggttccggatcagttctgccattgcccagaccagcagcgtcgccaccgtttcgccgccgccgctgaagaggtcctgcatacgaagagattggggtcattgattgaatagattataggaatatgtaggaagtggatttttgcatcactcaaatgattatgaaaaaatttgaaaaaaaaaattaagaagatgtattaacacgtgatatatcactccacaaacatgcaagtaaaaattcaacttctacatctcacaacgaaaaaaacaaatttgactctgaatatacattaactagttgcggtttaatttgtttttttcgctgcaagatgtagaaattgaatttaaacttgcatgtttgtacattattatatgacatgttaatacacctcaatttttttattaccatttgagtgacatgcaaataacgaggggatatcccctcaagggattaaaatagttttccgaatatgtatgtgctgtagtcgcccatggtgtctttatcttccccatgcaacttgttaaaataaaaactcaagtttatggcgtgatgatataatattacgtgctagtctttcttactaattttaattaatttttaaaattgaaaatttttgcatgatatataaggttggagttccactccacttaagtgtgaatgccccatgctttccttttgttggcacccaccaaataaaccatagtatatcggtacgtaaaatctaaaccgagtttagaataggcagctacagatcggacgtccgatgaaacctatggcatcagacgcccgcctgtgatgactccattcgcagctgcacatacaggttttgtgggcccatgcgctactaccatactacacactacacctctagaagtattaattagtgcagcaagcaaggtgacatgctacatctattcaacatcttctctaaaacaacctttaacaaacctttaagcatcctttacttgtaaacaaattatcttatgtaatattcaattgcatcatcatatatattatagttaagtctttaaatcaagatctcacatgattatatttctaatatataaaattatttttctaattgacacattagtatataatacatgaaagtgaaacatcacatggtacttattaaaacatccaaattacataacatgcaacatttgcaataaaatagtgaaacatcacaaaatactggtgaaacatctaaataacattgcatgcaacattttataaatgaactagtgaaatatcacaaaatacatgttgaaacatccgaacaacactatgtgcaacaattaaaaaatcaattgcaacataacagtttgaaatatgcaacaatgtcgaattcggactgaaacatacacttctcacatgtgaaacatcgaaattttatggttgaaacatatatttattttagattaaaatacaatcatgtgtgatcttgtttgatagatttaattgtaatgaatataacggtataatcggattgtggattgggtaaatgaagtgaaaaaaatgtttgaagtttgaaaatatagtgtcatagatgaaatgaatataaatgatgtatcgatgcaagtgtaggtgatataacaaaataaagggtgctgcatgcacatgcctttctacgtataagagaaagggctcattagatgttgtctgtgttcgatattttgatctccatcagacgaccgaaagtaagcattctcggcttaaccagtgagggaagtactacacatgcatgccttttttctattagacatgcatgtcttttttcctctttttataaagttttctcttaaattacttatccgatctacaatccgattacaccattgtgttcattgcaattaaatcttcacaccaagatcttagatgattatattacgatgaaaaaatatttatacttttaaattacttttattatatgcgtaagttacttttatcatatatataaattacttttagatttgactgaattacttcttatacattcataatgctctaagttgattattttgttatttttttaatcaattttataatttatggactttaaatttaattttagatagaccatattttttctccctacaacgaatttacttttaatgttgtaacaacttacttcaattttgtgcttaagttacttttaggattgatataaattacttttagactttattaaatttacattcatagatacattttgtcgacgagtgatactcgtagaccagatgattagggtattggggtacgttggaacgatgaactacgtaatatgacatcaagcaaatagaagacaaggattatactggttcaggccccttatcaggtaatagccctacttcggtttatatgggattgatgatgaaaaaccacataatacaatggaagtagaccaaatcgatgataccgacgagatcgtgatcgatgtattcgacgagatctcctggcgacttggcttcgcacactccggcttcgtaggctgtgatgggtgtgttggtgatgagattcgatgccttgcacccctacctgcgggtccctttttataccgtgtaccatcttgatctccaagtaagactcggaaacatcggatcttgtacaacatactagaaactctataccttccaagtaggactttagaaatccttgactcgtagagatattttccatattttgtaatggattcctacaacgtatacgggaacaacccgtgtacatgaaggtataccatatccgtatattccataagtcgtagaataggaggtatttcttattcgtaatcatgacaaatatagttctatatggaaactataaggactactcggattgtatccatattggtctccctagttctacttggacaaagggacacctatgggtataaatagactccttaggaggagagtgggacaatcaagatagacacagaccaacaagacacaacagatcaacacacaagacaagacatgccagatatcaacatcagagattagtctagacataccccatccggtgcctacagaggccggcaagagggatctagcgtcatctctgatctcgacgagttcatacttgaggaggaagactaccttgtcgtcgactacgtgtcggttatccatgccgccaagtcgacgacagctagatatgttatcccaattattgtacttgcgtaattcagataaatgaagagcaacaccgactttggccaacaggagtagggctattacctatcagataaggggcccgaacctatataaaaatctttgtctccatacttcaatctcgtatataccctgataccaacgatccccatactatgcaaaataccgtagtcaagatctcaaatgttgacaagtacaatgatgcaaatagatcttgaaaacaatatgtgatttaaaagatataagttattaaagaggttaaatctaaaagtaatttatatatatgataaaaataacttacatatataataaaagtaatttacaagataaataatttttttattagaatataatcatgtaagatcttgttataaagatttaattgtaacgatcacaacgatataatcagattatagatcggataagtgattttaaaaaaatttctataaaaagaaaaagcaagacatgcactaatgaatgtactagtagcaatcaaagtgaggtcaactgggtatgcgtgttgcgtggaggacccagtgctttttgtgcaaaaacaatgtgtgattttatttttagtaacacagtgctggtcgcggattaggactaacacgctactatgctcagtatagttgcgtccatatatcatatatagtgtcattgctccacatacggcaagttggaggttaccggcggcgacaatactttttttttaatgactcgcaccagacagtacgaaattcatattgataaagtaggaaaaaattataagattataaccttaagaatatggctgtcaacaagctgagcttgatcgaacgagcttatatgtgtaggctcgagctcgatactaactcgagccgagtctggtttgaacttcgagcataaaaacgggcgcgagctcggctcgctcgagcctcgagctttttcaattttagattttaaatagtctgtatagatgagagcatggggaatcacgacggcattggacaagtatacccaacattagggcaatagcaatgcttgaggtcttggtgaaaataaggtatgtcccaccataccctatgtccatggccacaatattgaaggcaagaatatatattaagatgggtcccacatctatgtaaataaattctattttaaggtaggttccaccatatcataatctattctcatcctctttaatgtgcatgtgtactttatctcatttttttttcttaaggttgagccataagctttatagttattttttagcatttaatatcttatggctagtgcctacaatatatatggctagtcattcttatagcacaatattgtagatgtccttagacttgtaccggaactattatcgttttaaaacatgatgtgactaataatagtaatattaatggagatgcatgcatgctaatagtactagcaggaggccagggcctgcaggcgtgaacccatgctctatttctatgcagctttttattaggagttgggagatgagtagtagttgtggtgtctctgctacaagaaaaattttaaaaatgtgagagacagtaacgccagctgaaaagaaatgttggcaacctaggctcaacgaactattcgagcttggctcgtcaagcttgcgagcttggaggaggtagacttgggctcggttcggattattcacgagtcgagcgagccaagctcgagcagctcaaaaggattcacagtttcggatcgaaatttttgaaatttcggttctatcgtacccccatacgatattattttggctgaaatttttagatttttttcatttttttcgtgaatttggtaatattttgttcaaattttgttcaaaaattcatataatttcggtctgaaataatttcggacacaccttcaaccgaaagtttgaacccttcagctcacgagcctcgggctttttggacagctatacttgggaggtcatactcaggaaaatgaaaaaaaaaacaccacccacactctgacagcatcaaaacacaaaacgcggcgacaatacttgttcttcatgagaaatcacacgaaggcatgcatgcagttggtcacttacagcgatgattaatttgatgctgtccatgtcgagcgggaactggagcccgccgccctccttgtgtatcctcagcagcgcgtccagaatgtcctcgccggcggcggacgatggagcagtcttcttctgctgcaggcgcttctcgatgaggcggtcaaggatgccaaacaccgtgtggaggttcgcctcaatctcgcgcacgccgccgctgagaaggccggcgagacgcgacgacggccacaggtccgccgccgggttgaacccgctcgcgagctccatggaacggtcgaacgcacggatgagcgcgtcgctctccttgcaccggtctcccaccacggcgcgcgacgtggagtcggtcacgagagcgcacagcgccgctcgtaactccacggcgcgcccgtccgcggcggccgcggccaccgtgcgcagcgtggcggcgacctcctcctcgcggatggcgcggaaggaggcgacgcggggcgcggagaggagctgcgtggcggcgatcttcttgagctggcgccagtagtccccgtacggcgcgaaggcgatgtccctgcctcccatggtgcccgctcgcacggtggcgctcagcgcccgcgtggcgaacaccgcgtcgtgtgtcctcatcacctcctgcgccgcctccggcgacgacaccaccagcgtgggcacctcgccgagccggagcatcatgaccggcccgtggcggcgcgtaagatcgcgcatcgcgtggtgcgggagcttgccgatgaggtggtgcagactgccgatgaccggcagctgccatggccccggaggcagccgccgctgagccgtcgccgtgcggctgcacttcgtgagcagcacgccgagcagcgccacgagagccatggcgaggtagacgtaaccctgagatagtacatccgccatttttgcgtcgtgcgccatgcttgcttgagcggctagctagctttcagtttttggcagcgtgggtgtgtacatgttgaatttataagcacataacataacgatttaatttatttcatcatgatattacagagataaactagcataaacgcatcataaaatctacacatgtaaactagacagtaaagaatgaacagaccaaatatgcgtaatatgttgaacacatactgagggtatcggaaaaccggctgcttagcaggaaagactcgcggttgcgggctttaacgacggcgcgcagcacgcaagcgaaaaggaaaacaagccgttgtgatcgaacagggagcagtcgtacgaagcgcttcccataaactttattaccgccttctcccattgtatgacgtcgaaggcgaaggttccggagacctgctctcccgatcaccagcgcacgtcgacaagcggggtggagtagactacgagcgacagtgcagtatagaggaagagccaaaccctatattgatttcacgtgtattgcgtggaggctgtggtttgacttatatagagatatcaggacgcttgatcaggacgcatgtacgatctccactccacgtaactgaaccagatgagttgcgtgtaacttattcggactccacaccgtttcaccccagtgcaggacgtcgaaggcgaaggttccggagacctgcccccccatcaccgtaccggtgcacgccgacaagcgggatggagtagactacgagtgacggtgcaatacagaggaaaaagcaaaccctaaattgatttgacgtgtattgcgtggaggcggaggcttgacttttgatcaggacgcctgcacgatctctattccgtgtaaccgaaccggataagtcgcgtgtaacttatttggaccccatgccgtctcacgcaccggattattcgaactgcttccaaaaaacaaatccgaatttcccgcagcaaaacaaaactacaaaagtagaactgtttccgaaaaacaaatccgaattttccgcagcaaaacaaaactacaaaagtagactgcatctacacatgggtgatgaaccaattttgtcggaacattcgatgtgcacgtgcgccaccatgccaggtgaggcgaggagcacgtgttcaccctcttctctccgcacatgcctaaagtggctagaagagtatcatctttataaggaggtatccctctgtgtatggtggtactaaacttcccatgcacgtcatctcataaggtgtgcttttgtgattttccaaaaaaaatattctttgaatgggggtaaggtccatctattaattctatatgttggagatagctagttcaccatcgatcaaggactggatagtattttaatggtgtaaccggataagaatattcattaattatgatagttatgctttatctttatcttgaccaatttagtgagtagttgtaggttcgactcttgtgctagcgcaagatgattatatgtatatgtttgtccatctattatcttataatcttaaaaagaagccaccattctttctatgaaaacctaaaaattacacattaataggataaaacaagaaatatttatatagctaaaaaattactaaattaaccgaagaaatatatacgactaacttgtgtgttacacgacatgtgattactaaagttgttatctttaaaactctatcggtttatattaaaataaaagtccacgtcatttacagcccattaattattaattttaaattttataaataaataaaatattaaattgagagttaaagatagatctgatataccgtcaaattatagaattactaaattagagttcacgatagattcgaaggtgatgaagtatagtggttgaaacacatactccaacccaaaagtggtgaagtgcggttgttaagcgtctatttgaaagttcgtttcgcttttgctttttttttctgcacgtaaaatgagaaatgacattattatataatttattaagcattctattataaatataaaaaatatatttatttgattttcaaagaaactttatctatataaaaagtttgtgtaaaaaaatctatcatttagcaatttagaaagtgtgtggtgctgaagccaaacgaaggaatgaaagaagcctcgagcagtacagtaggatatttatttacagcttttaagaatggacgacgtgcatatatatcttcagtagagaggacgcggctgcaaaacatcatatggtgtttctccatttagcgaacaggatgagattagattggtgccggcgtcctgttgtgagttcgtcatgatcaaatcaccaatgagaaccggtttgggtcatcaatgatttggcttacgttcggcgtgatcaatgcactactgccacagaacgggctaacaataccggtttataggcctatcactactggttctctttgaaggttcacaccggtagcaattttggtctcggtcgtctgttctcttgtcagttagcatgatcaatggaaaattttcctaaatgttcctatcaatcgggaggaaaaccatgggcttatttttgatagtataattccctctgtgtagtcttagaagacattcttcaataatgatctttctctccttttccgagtaaatttagatgggagagatctcttatttcctcttgttaaatactactacgtagtatgtgtaactctttttaaattgtcctattttaatatactttttactgtggtagcttcttctacagtttttttttaaaaaagttgatgttgtatctttttttttaattttcctattttaatataatttttgatgtggggcttcctctacagtgttttttaaagttgatcttaactggtaattaatgcggtttagaaaaagaaaacaagtgcttcattaaaccatgtatgttggcccatacggtttagaagaagacatatacaatcatgtttcctcagtgattcttcacgaagagtcgtgatggtgaagaaagagaaataatacgacggatggatatgtggccctcccagtttcctaagtacatcctctcgttatcgaatctcttttgtggttttatttttttacgaatcgacgtttaaaacgtgccaattttgtccaatttcatttaatatagcatgaaagttccatgcattaattaaaatagttgtacaaatattaagagaaaattaagataagaattgtgagagtcgttttgtccctgctagggcttaggttttggtctctcactgacctttgcagtgaggaaaatcactgagagttctccgcgctaaaacaccctttggatccttccttttcatatctcccaagtcactagtagatatacgaatgataagattttcaaccatcaaaacaatggatttaatattctaaagtataataaataaagataattctaaagatcatacttaggttgaaataaaaaaaatacgggaaagagggaaggaacaaaataatctccatttttccatcaagtatgaccaattttagggttattgtataaaacctctaatttaaagtcccaagccattttcaacttcactttaattctagccttgaataagttcacttcaggtctctcatcttgttccttttcaccagcagatcctgctctaaccacaccacgtttcattatcgtctaataccgtattattgttaggtcatgtggactttgtcacaatgtttctcacccctttggcccctcccactgtatggcgttgtctcttgccctctcccctcataggttcctccaccgtgccaagcctagctatattccgtggcctaagctcacggggctccgacttgaccattcaaagcttaggctattcaaatttaaaagatttgcctctagtactctctccatttacttttgataggtatatttccaaatctaaaaattttgtgtttgatatgcatatttcaatccaaccacctatatcatcttaatgactttgtcgaatttgatgactctccatacttccgtgcaaaattggtgggcatcgagaaatgtaaatattgataaatcgcttgtttataaggaataactagtagcatgtttaaatggatgatatacttatccttagtaattgtgccaagataaaatataactatcaaaaatagatagagagagtatctaaaaccgatgtcatgttccttccatcccttcctcccatcacgtgtagcacgtccatatgttccgtgtgcgtaactacttctgtcaaataagtatgggcatattactattacatgtttgaacttgttggagagttaaaaagtaagagcatattcagtaaagcaccctaaactaaacactcatacaatttttgtttttgtgtgtgtggatgtgaagaaacgaggtccatacggacctctaatatacggccaaaaataagaaggcccccaaatcaactcgtatatcctatagacctgcggactccacatgcaggctgcagcccccaatcgtcttattttctttggcgaggaaaaattcttgatctcgcgtgccatcccatccttcctcagtcacgcgccatcgtcgtccttacactttatcctccagctagcaacttcagcatggcatgaactgatcaccattagttttctttccctgtagtagcaggctagcagctagctacatgcatgacgatcacctttcactttctttgtattgttagtatttgttactccatccctatctaaatataagggattttagttggacgtggcacattgttatattaggatgtgtcacgtccaaccaaaatcccttatatttagagatggatggagtatattgtcttattgacatgtagcatataatcctgtggcatacgtggcacttatcagatcatttagaaacaggagaagtggttgggtagttgacttatcactcatttatagctagcaatcatgatatagtctcaaacaaaaatcatgcatgtgtacgctacctttcagaaaatatataatattccctccgacttataatataagagattttagagaaatgtgctacatactttgttcagattcatagtattatgatgtgtctctctaaaatcccttatattatgggacagagggagtatatattaccatgcacgtatatgcggtttagagagagagaaaagagagggattaactatttttcaggatgatcttgattgaattgaaaaggaaatataattaattaattccatcttttgaccaattctcacttaatttaatatattaattgtgttatgaaaatagatgtacaacggaggcacgaatttttacgtggaaaacacttgcgggaaaaaaccacgggcgccgaccggcaatgatcactatagaggagatgattacaaacgtaggggaatcacaatgggaacgccaccccttccgtacggcttacaagagtatatataggggataaaagaaagacacctaataggactcctactaggaaactaatccgaatatattgtgggcccaaaattcggatcacatatttaacaatctccaccttgagacgaatttcctcttgtagcataaaaacatcaatcaccaaaaatacctcatgtaggtaaaatcaccgcgcgccaaatagtctctaagactatactataacacccaccaagcttgagcaaagctcaaacttagtagcaggaactggctttgtcatcatatcagctgggttatcatgagtacttattttgcataccttgacatcaccttcggcaatcacacctcaaataaagtgatatctcacatcaatgtgctttgttctctcatagaacatctgatcctttgtaaggcatattgcactttgactatcacaaaatatattaatgcaagacgtaactccacaaagctcagtgtacaaacctctaagccaaatagcttctttacaagcttcagaaatagccatatactctgcttcagtagtaaataaggcaacagttgcttgcaaacttgccttccaactaacagcacatcctccaatagtgaaaacataacctgtgagcgatcttctcctatccaaatctccagcaaaatctgaatccacataaccaacaagtccatctctagatctcccaaactgcaaacaagcactagatgtaccacgtaggtatctaaaaatccattgaacagctttccaatgctctttgccaggattagctatgtatctactgacaacactcaatgcatgtgataagtcaggacgacaacataccatggcatacataagtgaaccaactgcacttgaataaggaactctagacatgtactcaatatcataatctgactgtggacataaatctgaagataatctgaaatgtgcagctaaaggagtactcactggttttgcatcatgcatattgaaacgatgaagaactttttcaatataacatttctgactaagatataacttgccagaatgtctttctctagtaatttccataccgagaattttcttcgctgcacccaaatccttcatctcaaattcactactcaattgtgtcttcaactttgctatctctgatttatcttttgcagcaatcaacatatcatcgacataaagaagcaaatatatagctgaaccatcaacaactttgagataaacacagctatcataattggatcttctaaacttctgagaaagcatgaaagagtcaaatctcttataccactgtctaggtgactgcttcaacccataaagagatttcttcaacctacagactaggttctcttttccaggaacaacaaaaccttcaggttgctccatataaatgtcctcttctaactccccatgtaaaaatgcagtcttaacatccatttgctctagttcataatcatgcattgcaacaatactaagtaaagtgcgaattgaactatgcttcacaacaggggaaaagacatcattgaaatcaatacctggaatctggctataacctttagcaactagccttgctttgtatcttgcctcatcacttggagacataccttcctttcttttgaagatccacttgcaacggataggtttcttctcctttggcaacttcaccaattcccaagtatgattcttttcaagtgattccatctcatcatgcatagcagttatccatctattgcaatcatcagaaacaatagcctcagaatatgtagaaggttcggcattaccttcaatttcttctgccacactcaaagcataagcaactatgttcgcttcttcaatatatcttcgaggaggtttaatatttcttttgggcttatcttttgcaatagaacgttttggagactgatgaacaatagaagaatctgaatcttcaataacaggtgcatcttggttaatagcaacatcttctttttctggtgcatgccctgaactgatcaagtgctccacctgcacacttgctttctcctgactctcaacaggaacattagtagaaggtttgtcatgtaatatacctgattcatggaagacaacatttctactaatcacaacctttttggtttcaggacaccataacttatagcctttcacaccagacggataaccaagaaaaatgcacttaatagctctaggctccaatttaccattatcaacatgagcataagcagtacaaccaaatactcttaagtctgaataatttgctggggaactagaccatacctcaattggagtcttcttatcaatggcataactgggtgatcgattgataagataacaagcagtagaaacagcttccacccaaaattgtttaggcaaacctgcattagacaacatacaacgggcctttgatataattgtcctgttcatacgctcagctacgccgttttgttgaggtgtgtgaggaacggtgtagtgacgcacaatgccttcagacttgcaatatgatttaaatatcttagaacagaactccatcccattgtcagtacgaaggattttcaccttcctctcagtttgtctttcaaccatagttttccactctttaaacacatcaaaagcttgatatttgtgcttcaagaaataaggccaaacttttcgcaaataatcatcaacgatagtcatcatgtaacgagcacctccaaaagatgtcttacgagcaggcccccataaatcagaatgcacataatcaagaataccttcagtagtatgtgtagatgtgttgaacttcaccctcttatgcttgccaaatatgcaatgctcacaaaatttgagcttctcgatgctttgtccatctagcaatcctcgcttgctcaattctgccaaaccaatttcactcatatgcccaagacgcatatgccaaagattagtagcatcggaattagataatgaattagaaactgctgcaacattacctaatatagttgtacctcgcagatggtacatgttggcaaatttaatatcagctttcatcacaacaagagagcctttagttaccttcaaaattccgtctccaccggaatatttgtaccctttgcgatcaagagtacataaagagatgagacttctcttcaaatttggaatatgccgcacatctgacaatgttctgatacagccatcaaacatcttgatctgaactgttccaatacctgcaacctcgcatggtgtatcatcacccatcaaaacagtaccaccttgcaaagcttcataggtggcaaaccaatccctattcgggcacatgtgataggtgcatgcagtatcaagaatccacttgtcactagtttgtgcacaaccagcataagcaacaagcaattctgcatcagacttctcatcagtaacaactgtggctttaccttcctcttctttcttaccttttggtatatactttccggttctcttgtctttgtcctgtagcttccaacactcagagatatcatgtccatctctcttgcagtatttgcatgacttatacctgcctctggactttgatctcccacggtagctacttgagcttttatctcttgattggttctttgtgttcttctcctgttgcctgccccgaacaaccaagccttctgcttgtgaatttgaaccttcagaggttaccatcttcttcatcttttctttggcatgcaaagcatcataaacttcttttaaagttagagtatcacggctataaagtatagtatccctgaagtttgcatatgagctaggcaatgaacacaatagaataaggcctaaatcctcttcatcatactttacctccatagactcaaggtcagcaacaatttccttgaaagcggagagatggtccatcacagactcatcatcttgcaacttgtgcaaaaataacttttgcttcaggtgcatcttactggtcagctccttagtcatgcatatctgttccagcttcaaccacagcccagcggttgtctcctccttaagcacctcctgcaaaatattgttagatagatgaagatgaatatatgacatagccttacgatcccttttcttctcatcgttggaccaatcctgagtcctcttgtcaaatctagaaagcgcatcatcgaggtcttgctgtgcaagaacggctcgcatcttcacttgccaaagtgagaatcttgtgtctcggtccatgagcggtagatcatacttcaaactcgccatgggaattaatcctgaatttgctggtaagaaattagggtaaaatagcaaaaacgccggaagacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaagggatctgctaaagaaacattcaaggagtcaggtccacttacttttatctttctttccaattttatggggtgggttggtttgataagacccctttttgctttgttgataaataataaaaaaagagtttttttctataacctgcttgttttattataacaagtcctagcaatttcctccctggaaaaaagcctgaacagaacagccaagctttcggctgattgttttaatcctcgtgacgcgtgcgctgcttgtagtactcctctcacgacgcctgagcggctgctgctgcggtgctgcctttttatctcgcgcaggcgtgggacgaggccgactcggagtcgacaggtaggggggtgaacagattgattcgacggaacgacgaacacgacgacgcgtgccaccgattagatcgatttcttcgatcgggaaaaatcgccggtagccgggactgcagtagatcgatcttcaatgctctgataccacttgttatgaaaatagatacacaacggagacacgaatttttacgtggaaaacacttgcgggaaaaaaccacgggcgccgaccggcaatgatcactatagaggtgatgattacaaacgtaggggaatcacaatgagaacgccaccccttcccgtacggcttacaagtatatatcggggataaaagaaagacacctaataggactcctactaggaaact

SEQ ID NO: 67564 - DNA, 911 bp, Oryza sativa
atatgtatgtgtgtatatgtatctccctttgtatgtataaatatgtagatataaacagtgagagtgtgtccgggtgagtgtgttcatcaagggacatgcatgatcttagaattataatatttatgttttttctagagtgtttattcgagatatccttttttcgctttgcatatgtatcccagtgtaatatatccatatatatatatatatatatatatatatatatatatatatatatatatatatatatttcattggagaatagttaatatgatccctaaagtttcgctcctagattagtttagtccttaatcttttatattgtccaaacaagtcctttaaatttgtcatgtgggctaatatagtccttggtcccaccaaaatcgccacatggacctgccatgtcaccttcttatgcaaaatctatatgatttgtccaatttacccttacgcacaggaaagtaaaaaacaaaaggaaaaagttaaaaaatatatggtatttgtaagagcaaaaatatacctcaaaagggtgaaaaaaagaagtatttttttcctatggttatatctaattcacccttatatttatttttctatgatatacgtaagggtaaattggacaattcattattgattttgcatgaatgatgacatggcatatccatatgatgattttggtggacccaacgaatattctaggccttatgaaaaaggttaaggatttctttggaccatttaaaaggttagggtctaaactgatttacagagaaactttagggactaaagtagctattctccctatattcatcactgcttcttcccctatgggtatatatatccgtagtcgatcgaagaagcaatgataaatatataggaagagaaatatagtatgcaactgaatgattgtattgggt

SEQ ID NO: 67565 - DNA, 50819 bp, Oryza sativa
taatgtagagaagcttgttttagtgtgcatttgtgcccgcgccagttatatgcaacatggtttacatatctatgagtaacttctttctctctctgtgacagtactgtgcatgcacacatttgtaccaacacaacatataaatctttttaatggcatgttgcctagagctagagagctttgtagccagcaaacctatggctaggttcacaattttcatgattgccggtaatatgtactacaagttactactgttccaaattaaaagcattgcaaaggtagggattaattaattgggacaccaaattaaagtgctttggcctacagtgtacagtccagtcctaggctggaaatctagggttaagcatatgggtaaataaggtcccgtttggcacagctccagctcctaactccaacttacctggagcaggagctatgccaaacaatccagatcctccatttttgggagcggagttggcagagctactccacaaatttgtactacgggggtggagctgggtttttgctgctccacaactccactccaaaccaaaagacccactaccctttaaattttttacatatttacacaaaattgccactcaactacccctaactcatctctcacccctctctctccctcccatcaggccgtcaccctcactctccactccgacgagctcgacggcggccggcgcgcggttggcggcaaggtcgacggcggccggcgcacggcgggcggcggggtcgacggcggccggcgcacggcgagcagcacatggtgggcggcgtgcggcgggttggtgcgcggtcggcgcgcggttggcggcgaggttgacggcgggcggcatcggggacggcgcgcggttggcggacggacggcggcaggcggcgggcaacatcggggacggcgcgagtggcgcgcggccggtgggcggactgcggcgggcggcgcgcagcaggaggcggccgcccgcacacggggacggcgacggcagcagttgcgattggggagtttttttctttttttttttgtaatttcagatctagagctcaaaacctaccaaacacttttcagcaggtctccaactcctacaagagctagctcccactagagtgggagtttagagctgagagttggagtttggagccctaccaaacggggtctaaaaccatgagatcactactacaaaaaaaaaattgtagccacaaaaaaatcactagtaataataacagggagctcctatgatctaaacccgcttccgaaaaacaattgtcaaggcggctgtcaattttcacatcaatgtccgtaatatgtatagcgaggttgcatttatttggaagcaattaatttaatttatctcaaatttagactttatttccaaataatttgcttttaggtatctattcctacctatatatgtgtgtgcaaatatgcatgtacttaattactaaaaaagttgaaagaacacttggtacataaaaaaggttaattagtactatggtgtatattgctaataaacttcactctgcactagtaacaattttgccaaacttctgttcagagatctatggctttcatcgagcgtgtgcaatatggatcctcaacatttggttacagttgaggtatggatactcatcagattgacctccctgtattctttccttaatatactacactgactgaccgtgtacatatatccgtgttggatgtataggccgggtttcaatccatcatccaaaaaaacatatactacactgacattcagtttaatttctttcctttataacttacatggtatatattactgttttataaactacactgacacacataaatttgtacaattggatcaggacatggagccttgtagatcaagcagcttgcaagtatccagccatgaactgagcagccctagcctcgagttcacgctaggaagaccgagctggcacagcatagatcatgactagctagctagcaagctcttgcttgcttgcttgctatatatatggacccatgcattgcacattcagatatactgtttatgaccatactcagatcgatacctgcgtcgccgcgatatcagcaatgcgcgatgaaacaagacatggatgaaaaaaaattaattaggagtggtttgtttgttttgtcgaaacaacacgatagtcccctctttcactttgctctcttttttcttagtttttcattacatttttgtatttattctcaatgtgtaagtgcagtagattatattctcatgcactacatgacactaggggtgcttgaaagttgtaatgcctctttgcaacttggtgaccggtgtaatgtatcatttgcacatgaaaaaaaaacagagaaaatatctaacctgacaatgattatattcttcttgtgatgcatatatataagtatgtgtcttctccagtctctacctagcttcaactctctacttgttccacctagccgattatacgtgttctggttttttttttcaaatacatgtggtggtaaagttgtaagaattacttcatatatcagggttcaaatattgatgcctattatttaaaaaaaaaggtggtgtatgcccatagttgccaaacatatgtaacagatttagaatgtaagtgactgcatcataaaaaccgatatatgttgatcataatttagcagagcaacaaggactatgtacggcccgttctaacttcataaagatatagatttttcctcgttttccgttagtacgcttttcaaactactaaacggtgtattttatgcgaaaactttacatatataagttactctaaaatatcaaataaatccattttccaagtttgtaataattaaaacttaattaatcatgcgttaatgactttctcgttttgcgtgcccgcttttaatcttcatctatagaagattcaaatggggccatactgcgctataactagtctatatatattgtcatgtgacaactcggattattgccaccaaatccagatctatatttctagtctttaattatgtccttaatttaagattagttggaatggtgtggcacacataacaaaacgtaagccacatccaactgttattattgacagggtacatatatataactagatgacaccttgcgctttgtcgtgggatatatgaatgaaagtgtgttgaatgttgtataaatgattggtgaatttggattgaaataatttgaaaaatgatttgaggatgatgatttagcgtgtgtgtatacatttgagtttagaatgtaataaaattgtaaatataattactatgcttgcatgttgagctttaggtgtttagtagattgatgtggcatgcttacatggtaagttttaaaagtactaataaataatgcttgcatgttgagattgagatgtctggtgggttctaactttatatgaggtcaagattagcaaaggcaagatttttgccacctcacaataaatatgtgtgtagttgggcagccatttaattaactagtttttcacatatatattattgctattttattccttttcaactagggcttgtgcaagtaagtgttactatcgttaagaggttgtcatacaattatgcacacggtggtcaataagttagatacgtacgggtctctaatgaagtagtataaaagctagatccaattggatatataatataataatacaaaatgggacctggtctgaggtttgaagggatgtcggtgttgttcatctaaagcctagtgggaagatcgatcatgatatgagaacacctaaattggttttctaaataatatagtcaagctagcttctaatttaattagacccatcatgcatgataacgtgtattaatgtcagtggtgtttcaagtgataaaacttttaaaaattgcaacaatatatttttaaatatgtagattagatgtgtgaaaatcatgtttatgtgtgttgattacctcgtaaaggtttttcaaatgatcaaacttttaaaaatcatatcaatatatttgttaacacatttagattcaatgtgcgaaaatcatatatacatgttgatttacctcgaaaacactttcacaatattatactttatcaggtttttaaatgttttacgattgaaattaaggattaaggtctgtatttcggagacatctatgtctatgtcctaaacttatgaccgaagcctgaaggagtattttcttgagaaatatgtgtgtagtatacttagttctcaatctaaatttaggaaaagagtacttactacctctaatatatttggaatttactaaggtattccttgtagctaatagtaccatctttccaaaaaggaatattggctacaaccatacatgattttaagtttacttgtggattgaaatgcatgatgatttattttagatctttacagtaagataaaaattcactgatgttgaaagcaggcaggaccatatatactactgtacatatatcgacagctatgtgttgtcaacaacaaagtagttacagtaacacattacttgcaagaaagaatataatgtagtactacacatactatacattgtttccaggcaacaatggtatagaactgttccaagctagggggaaaaaataacactgaaacatgagtaccagctagcagaggagaaaataaaaaataaacaaaaaacaaataaaaaagaaagaaacagctccaatcataaagcaatggattgcaaaatcattcagtggtccaatgcatgtccccacaaacgatgtcattcacaatgcttactttgtcggcccttttgctcagtatctgacaaaggagagggccaaaaaaaaaagagaaaaatgtttgcaaaaagaaggaaaagcatgggttgtagtactactaccaccagtacatgtacaccatcaaggaaaaataaataaaataaaaaaatgtgacaaatgcatgtcctgtgtaacatccctgtgtgcatttaaatgatttgtccggtgtgtcaaggctgttttctctctccgtggcactgtgcgtgtgcagtacagcgtctgggggcgctacgatgagatatgctactagtacatgtttcgaattggccatttatttgcatgggggccttttggcaccgtgcagatgggtagttgcactgatttggaccactgtctagtctactgctgcccattcatgtctgtgtaacctacagctaatcatatctaaataatggttcctaagttgattgcaacgggattgaagaagtccactggttttgtaacgttgaactttactttacgggaacatatcctatcctatttacacgagcttcctgtgcacaatccgtgcacaccacctagcaaatgtcatagaaaattgtaaaaaaaattggacgcatacttctaatagtattaaaccaacctatgaaatcttaacttcaaattcattatattttagctgtaacaaaaaggataaaattctgacagatttttacgataaaaactgtcagatttttcacttttttgttacggataaaatataatgaatttgaatatgagactttgcatatatgtgtaatactattaggagtatgtgtctattttttttctagaattttctgtgatatttgctagttggtgtgtatggagtgtgcactggaagcttatgtgcataggatatattcccgaactttaccaacggtgtttaaggggaaggtggcaaccagggctaaccatcaacggcaatgacgacgatgagctcctcacctatcctttgccgtcgctgacaattccctgtctttagtagagaatctatggatgaaggttatggttttgggtaggagtacgacagagggcaacgaggcgggggggggggggggggtgttgctgaagccccgtgatggaggtcagcagtgggtagggctgacaacaatagcgcgagggaagccgtggagttaagaggcgacagtcagcaatggtgaatattctggcggctgagctgctagagacaaggaagagggcgatgcgggggaatggcaccattgccagcttatgaaggaagagagagggggaggcagagaagggggacggggaataaggttggtctggcaggctttgacggcaccgttgatggcttccgacgaggtcgggcaatggcgcgcttgagcagtggcggagatgggaattgattgggaggtgtcaggagttgggaagaggataaggatagggctgcacgattgaagatatcttagccgtctaaatttgaaccttttttttattctttcattcaactgaaatgaagagtcccttttccaaaatctaaaagtcaattatggacttctcaaacaattagtttaggtgaaggggaaagtgaacagcttaaaaaaactgaatgttgagtaatgtttgtttagtagttccattttcaggttttgagaaaagttaatgttataaagtaaccttttgtcttgtatgggatactgtaattaatattttatttttttgccaaggaaatgtacgtaataatcttgtttttgttgccccatgaaactatggcgaatatttttacggtaggcttgaccattttatttttcaaataatccactatgtaaatattgtacactcgtggatgatctcttattatatatatagcttgcatatgtgcggtggtgtgtctctttcttgttgtctaaaattaaaaagatagaggaactatttgattcacatggatgctactctatgaacaactgtttgtcctaaaatatacaaatttaatatgttatttgtataattattttattactattactgtgttcaaccaattcatagaattaattaaggcgtgcatttcttatttatatatatatatatatataggacactcatatggggcaccatggtgcccgggcaccatggtttcaaatgcacaaaattactcaaatttttcaaaaattttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatatatatatatatatatatatatatatatatatatatatatatatatgtcggtggtcggtggttgctacttccagccgcgggggccggtgttaaaccgctacatcccctgcgtcctccgcaagaagtgggacgactggaagagcgactggttctacacccccctcgccaacgaagcacgcctccaacttccaagccagcccccggcgcagttctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacaccgggcccgaagattacatgcggacccaccagggagccagatgggattgggctcctgaggacttcaagatcgtggtccaaagggtgctgaatctcagctccgtggaggcgtctcgcattcctcaggagatcctccccctctgcagcgatcccgaccgtgcctccattctaaccattatgatgggggtcggggcctcagaggagagaactcctaaggaccacgatggcgcgggcgagagccgccgggggaaacaatctgccccaggagggggtcgtgcttctgggccccgcgtcgggggcccggggagcaaccgccctgccgacgcccaggggaagaggaagctgggaggaacacctcccccatctcctccccgagggggcggggcggtgcgtgccagtagtcggcgcccggagggggtcgcgccgaccttgcagcccgagggggagcgcaagaagaagcggctccgcaagatgggggagacggaaccatcccggggaaacctgatttcccctccaaggtggtcatttaaccgaccccctcgcaggttcgtcccattctcattgcgaccgtctttcttctatcccattaagcaagttttctcttacccatcttgtttgtcttctggttttttattctgcttcagcgatgccccgtcacattccccccgccaccccaagtccggccagtccgaggccgaagatccagcggccgcagaggagcggaggcgagaatctgaccggcgtgaagccgcagatcgccttcgggaagctgaagaggccgcccgggaggccgcccgggttcgccaggcggaggaagctgctcgggaggaggccgcccgggctcgccaggctgaggaagctgctaaggaggaggccgaccgggctcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgcattttctccaaggcggctcttctcctcatcttctgtcgccccgctgagcgccgagccccttctgtaggccctggccgccgcaaacaccgcagtgctggatgggttcaacgcccaagtggaggccctgcgtgcggaacgagcggagctcgaggccgcatgggcgcgtgttgaggaggggcggcgctcggtggacgccatggtggaggtgggccgtaaggctcaccgccgtcatgtctcggagcttaaagcccggaaagcggcactggcggagatcgcccgtgaggtggaggaggagcgggcggccgccctcatctctaccaccgcgatggtcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtccgcgctccgcctccgcgaggatgcactcgctgagcgggagcgagctctcgaggaggccgaggccacgacgcaacggctggcggacagcctgtccctccgcgaggcagcgcaggaggagcaggcgcgccgcaatctggaatgcgtccgcgccgagagagccgcactggagcagcgggctgccgacctcgaggcgcgggagaaagagctggacgcaagggcgcgcgtcggtggggcggctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgccggtcggcaagcgggcctctggaaaggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggaccgaggacgacgcgcgcgcgcgcgtccgggatgccgccgaccacatcgtcaacggcttcgagggctcggcccctcggcccgcgttcgcccccaactccgacgaggagggcaacaccagcagtgcagacgatggtggtgacgaggccgtcgactcgggcgcgtcggaatgagcccccaagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgagggcaaggttgagtacgagtgaccttattttaagtcaagattcttcaaaaggaaagaacagcacagacacaacctttaggaaattgaaactgcttctattgaaatgttgaaaaaagagaaataagaatgtaatgcatgtgtggtagcccccggccaaccctgcacacccgaggggggtgcggggttggcctgagccaaaacctgacacccgaccccccccccctcctcaggggtagaagcgacgaaggtgttcgatgttccatgggttaggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtggtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagatagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgcccaccagggtgcgcgaggcggaatgggctccgcactcgccctcatggatgtcaacaagaagctcaacgccttgttcctgaggaatgcacttcagaaggattccgttagccgcgcgccgatagagggtcccttctaccagcacatagcgtttggaaatgcgttggacgcgttcactcccttcgcggtcctcaggtagagtcttatctgtgaggtatgcttggatctcagagatccacgcaatcaatctaagggagcttgaagcgctcccttcgggtcccgaggcctggactccgacgggcctcgggggccggtcaggcgtatccgtttcccctaaggggtcgggtcgcgccgacggctgggtaagcctttcttcaaaggcgcccggtggggtttgggctcgcgaggacgcgagccttgagagttcgtcggcaaccacgttgtcccgtctgggtacatgccgaagctctatcccatcaaaatggcgctccatacgccgcacttggcgtacgtaggcgtccatctgtgggtcggagcaccggtactccttacagacctggttaacgaccagctgggagtcgcctaacaccaagaggcggcggatccccagtccagctgctactctgagtccggcaaggagtccctcgtactctgtcatattattagtcgctcgaaagtcgagacggaccaagtatctgaggacgtctccgtttggagaggtcaacgtgacccctgcaccggcgccctgaagagacagagaaccgtcgaattgcatcacccagtgggcggcgtgaggcagctgtgaggggtccgcgctggcctcggggattgagacggtctctggagccggagtccactctgccacaaaatcggcgagggcttggctcttgatagcgtggcgtggttcaaagtgcagatcgaactcagaaagctcgattgcccattttaccacccgtccggtaccttctcgattatgcaagatttggccgagggggtaggacgtaaccacagtgacccgatgcgcttggaaataatggcgcagtttcctcgaggccatcagaatagcgtaaagcatcttctgggcctgagggtatcgggttttggcgtcccggagggcctcactaacaaagtaaacaggccgctgcacctttcggcggggccgatcctcttcgctaggggccgtatccccggggtgctcttcgtccaagtggcctctcggggcacactcgtctcctgcgctgatgacctcggggtccgaagatgacaggtgcggccttcccacagtggcctcggggccgtcctgggggtcgggggctcctggcgtcgtcagacaagcgggcaaagggccagctccggtcgtcaggggcctcaggcctccgttcggctcgggggcctcttctccctgctctctcccgggtcgaatcagcacagggttagcctcggggtcaaagggtggtaggtgcggccttcccgcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgtagaatgaggattgtcctcatcgcgctccactaccaacgctgcactaactacttggggggtcgctgctaagtaaagtagcagggactcatttggctccggggcgactagaaccggaggagagctgagatacgccttcaactgggcgagggcattttcagcttcctccgtccaagtaaacggccccgagcgcttgaggagcttaaataagggtagcgccttctctcccagcctcgatataaaacgacttagggcggccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagttttatgcgggcggagcggagattttcaaaagtttccgctagatctgagagtaaggtctcttggttgcgcgtctttacaaccaagtcatcgacatacgcctcaacattacgtcctatttggctacccaaagaaattcgagtagtacgttgaaaagtaggacctgcattctttaacccgaagggcattgaggtataacaaaaggttcctacgggggtaatgaacgcagttttctcctcatcctccctagccatgcgaatctgatggtaaccagagtatgcatctagaaaacacaaaaggtcgcaccccgcagtggaatcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcaactccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccacaagggcccggcatcttcatctggaggtaggcgtagtggaccgccgccataaacttcaccaacgcgggcctccccaggaccgcgttgtagggcagactgaggtccgccacatcgaagttcacccgctccgtgcgaaagtttgctgatccaccaaaggtgaccggtaggtcgatgtggcctaacggccatgtgtgccccggcgtcacaccaatgatcggttgagacggctggagaaccatccccggggccttgatagcatcaaaggccgcgggggaaaggatgttgagagccgctcctccatctatgaggacacgccccaacttcacattgcagatggtgggggaaaccaccatcgcaatctgccctccccgggcaaacacaccgagaaggcctctttggaacactaggaaagacaaaacacagcatttaatttctgtatgatcatactcacacatgtacagaacctatgactgtaaacacataaatgagaaaaatgtaggtataactgtctggatggtccacatgaaaaatacaacaattagattaggtgatatattgtaaattaaaggagatttctttgaaaacattggaccccatgctaacttatttccttgaaaaaaaatatatatgcagtaggcaatttcaaaggaatcctttgaaaggattttctataggatttgatcctacaaaattccctccaaatactttgttccaaaaggggcatttagttacgtatttgatccactggaccatgtttgaaaaaaataaatcctagatgtgtttgtactgtgttcaaaagaatctaaaatcgttcttgggtagttaagggtttagctgggttttaaggtttaacttgaagtacgggtactatatagtaacaattcaccaacagattacgttagatcatagtattagtgtattagtagtatgtacttcctccgttttctaataaatgacgccgttgactttttctcacatgtttgaccattcgtcttattcaaaagttttattcaaatgtataagatataaatcacacttaaaatactatgagtgataaaacaactcataacaaaataaattgtaattacgtaaattttttgaataagacgaatggttaaacatagaaaaagttaacggcgttatctattaaaaaacggatgtagtaataggagagtattaatttgctgatcatgcatgtattgcgtacgtacggtaataattaatggtcgagaatattaacaagtactcctacaaattactgaatttaaaagtacaaacaactacaagttaccagaggagagaggacatatatgtatatatatatatacacgtacccagaagcatgtacagtcgcgtacgtacggttgcgttcgtacacgtatgatcgctaattgatgtgagcactgtagctcagcaagtacatgcgcgaaataattaaacatgcttaaaatgtactccctccgttaataatacacggattttgagtttttacttgcaacgtttgaccactcatcttatttaaaaaattttaaaattattatttattttatttgtgacttaatttattatctacagtattttaagcacaactttttgttttttatatttgcaaaaaaaaattaaataagacgagtgattaaacgttgtaagaaaaactcaaaatcctttatattatggggacggagggagtagtaacattgagctagcgagctagaggtactagcagcttcaaggaaatccaggagtaactctatggagatgttgccaatatgactctcatgtttaaaatgactccctatattattttcataatggttttcactgaagtgaagcccacatgatatcctaatcaccaaaaaaccggagaaaggagagaaggaggatatgacatatgagtcccactctactttttaatttccgagatgattggaatgagtgaaaactgactaaaaacaaccgagagagtcgttttgaatggctttaatagttgaaggggtagatatacctggtttttcagttgaaggatatgaattaaatccaacctacaccctctatctttactattataaaaatgaaagatgtttttaccggtattttggtacgtcatccgtgtttaagtcggtttttaagtttgttcgcttttggaaacacatatccgtgtttgagtcaaattttaaattcgtttgattttaaaaatacaaaatgaatcgtataagaaatctctttaaaaaaactcgcatgctaacttaagatgaatatcggactcctaattgcagcttatggttttccaaaaagtatatccaaacgaatttcaccctagctaaaccgtataataataataatattaaaatagccttgatccgtcagaactcacgaacatttactttctagtcttataaaaaaaatcaatttctagatgaacctaaacaagcatgtatccaagttcatcccccaaaagttatctatttttaggatagagggagtgcaataagtaggaacttaggcccttcacagtgctccaccctggagcgttccttcgtcccaccacgtagacttcgtgatgtcatggaggagagaatgtgtgggcccgagttcctccgcatgattgctcggttccttggtgagcaacgagttcctcataaaaaagcctgcaaaaaggtctgaagcatgcacaaaaccatcggaaagaggcgaggaagagcatgaggaggagaacgggaagagtctgggtcacgcgtctggctcgccacttccccaccgccgaggccgccgcgctcgcctacgacgacgccacaagccaccaccgccgccgcgctcgcctacgacagtgtcgcgagcgcagcggcgcacgacgacgctgcaagccgccgtcgtcgcgtcccacccggtgatcgtcgggctcgccagggaggtcgccggcgagtgccgtgggctgccactcacgctcatcaccatcagcatggaggaggagaacgccggcatgctgtaggaccgagatgtcgactagaggagggtgaataggcgatttaaaaactaaatgacacctaatcaaaactaacctaagttgctaggctcggtgagggttaagtctaactaagcaactaagttatgttttgcaaacctagggtgatagtggctcaattaattctctaggaaagtaaattacactcctatgtcaatgttttgcaatcctagggtgatatgatctcaagaaagtctctaggaatgtaaattgcacaaatgtaaatgcgacaatcaaatgagacaaggagacaagagatttttcaccgaggttcggaaactcgccggtttcctattccccgttgaggcgagcccaactccaccgctcaaccacgaagccaccgcacgcctccttcgtcaaggggtgggcaaggcgggagccgacccacggagaggactacccaagcctcgatcactcggggtagttcttccttcactccgaagttggtgaactccaaaccacccacaaaccggcaccgggcctcctccacaatcttctcggagaagtcaccgggcaactcctccagaagccatctaggaggcggcaacctccaagagtaacaagcaatgacccggcgtagagatgatcaatcaagtgccacactagctctacaaatggaagcaatgcacttgactcttggctagaacaacctcaaccactacaatggatgaacactaagctaaaaggtgtgtgagagagatgcaaggggtgtatgcaattgaattgggtgccgaaagagagcccccttgctgctggagggggagtatttatactcccaccaaccaaaactagccgttgggggcgaaatcccccaactctgtgtgctgctggtttgaccggaggtatgaggccggtcagcccgtgctactctgcaacggctagaaaactagccgttgtagccctgtcagagggcccaatcggcctggccggtcagaccgacatggggtggccagtcagaccgccctcaacttggtctgaccgaatacggctccgtcggctctatatcggccaccccgagcaacaccatcccggccttcagggggccggtctgaccgcacaagtgccgtcggtcagaccgaccttgtgcgccggtcagactgcccgcttggggccggtcagaccggccagggaccgccggtcagaccgccacaaggtggccggtctgaccgcccttggtcaggccgaaaaccagtgaatacaaggtgttagtgtgtgttgtgtgaaatgtgagcacaagtctaaatgcataatgacctaatgtggcaattaaaatcatctctttgctagatcattacccctcttaatagtacgtcgaaactaaaaataaactagcaaatttgatcgccctacacctcgattaattcaaaacaaaagcactagttttaccgtcttttttccctttactttgcgccgtcaattttaatccatcgataatcatccatgcgcacatatgacgtgaacctaacttaaaatatatagctcaaagacaacggttagtccacaattagtgcttgtcattaattaccaaaattaacaacgggggactagatgcttcacatgcaggacccgctacctcgccacgcgcgcagctgtcccgccatcgaggtcgccgccgtctgccctcgacaaggagaggaatgggcgggcggagaagctcgccggctcgatggggaaagcgtagagaaggagaggagctcgaggtcgaggccgcgtccgagctcgctgttgtcgccttgatccagtgagcctaggccagatctggctgcttagcctggcgtcgtcgccgtcgccgctcgggccaccgctccgcccggcttcaagaggaagacgaggtcgcgtggctcggtcgacagcgacctccgcgaggacgaccgtgccgccgcttgtcgtccgcgaggaagacgaggtcgcgcagcgacctccgcgaggaagaccccgccgagagtccgtcgttgcagagggggtagggggagggaggcgccggtgcggcgtctgtggcatccagcctcgatgatgagaggcaccggcgtcttcgcatccttgcccgccatccttgccccttgccgcttgccgtcctggtttgggaatgcgaggagagaggatagagagagaggggaggagagatgatggatgtgaaaagagagatgggtgggacccactaacatgtattgcttaagacacatgcactgtaaagtgtggttctttacccggttcgttgtctagctggaggctttgagctcctcatgtgcgttacccgcactgtgaccggccttatattagacattttgctcacacatatacagcagacaaagcccaagagcatcatcgattcatcgtcatcccgggatacccatacgagatgggtctcaaacgacccatgggacataaatctcatccagcccaatcccagcccaactcgcgagcccgtcacgtcacgcttcgcacccaccagtccacctcctcctcctcctcctcttccgcaccgcgccgccccgtcgccggccgcaaccaccaccaccactcgccgtcgcctccgccccccgcacgcgctcctcccctcccctcccctcccctcccctctccccggccgcgccgctcgccggatctctcccctcctcccttccaggaaccccagccaagcaggtagcgtgtgacgggggaagggggggatggggctctcgtcggcggcggcgggggaggggccgcagctgtgcgtgttcgacctgaggcgggggcagcaggaggggcaggagctcgacaagatcctcttcttccaccccaccgactgccccatcctcctccagctctccgtcatcggcctctgcgaggggatcatcaccttcgctaggtttgcagttttgctccacccccttctcactcgcatccccctcctgttcgtgctgctgcttggctcctcgcgcaggttggagctcttagcttattcggtcggagctttgttgctcgtggaggttagttgtttaggaacgatttgtagcacttagttgcgtggacgagcggaattccaacgaccttgaagctcatgggatttcaggcgaaggggtttatatgggaaaattctggcgtgttgattgtaatcggagttggaggtgaatgaatttggttcatcagggtgagatccttatgggggataattctggcgtgttgattgtaattggagtccgaggtgaatgtatttggttcgttaggatgagatccttcttagatccccatagaacttaacttttatctgcttcgagatagtatagtcagacatactacccgttctgttcttgaatccaaattaggtgcagtttcactgcttgttgctccttatttcagaatccgatttttaaattatttcacaaaattgtagtatatgtaactaggggcaaaatttgcctgttattttaatttttgcttttagttccaaccataagcactttctcgcgactggtgcttctgcacttataccttttgcttttatctgttggcttatctatctaaatattattcctgtgcagaatattttctcctgatgatgattgtgaggtgatagaatcagagaaacactcccatgttttttaccaagctgaagcagatatatggatggttctggtaatggctgttcttacattaacagttcatcactatttgttataaaccaaattgttgtactctagagcctcttcaattgggtgtagttaaaaacagcatgtaacctttgtctgtcacctattgtcattgaacaatatttactggaaatcctgaaaacattcaagaaccaagagtatttctagtctgccaccaaagtaaattctgtaacgagaacatgggcgttcatactcaagcatactatgccttcagtctcgcagatagtataatgaccattttggatttctttatttttaactgaagaagctatgagtttgcttcataacacttgttcctttcccagcaaattgtctgtaaatctttttttgcacttataacttgaatgattatcatactcatttccagtgaaaacttgttcatgcataggtagtggagaaaaacaaggacattgagtcaacttggcggtgtggtgcattgcaaggaattcttaaagaggttcactcgcttttcacaatgttccacggaccaattcgaactttacttgacaggcaacccagtgcagaacttgcccgtggtcaccttcgcacatttttcacagattatttaagtggtgagtctcgtttccattcatattgtgtataacatgagcgcaacattgccctttaaagaaatatacatttggtcttcatgaacatgttcttgagcagattttaatgctggtaaaaagatacaattgccaaccttccgtgattgcctaaaggagcgaggaactgtccaaatgctaacaatctcacgagaagtggcacttgaagttcaggtaggaaatgtactcttcaaacatgaaagacctcctagttacagaaatataactgtagtaccttttgatcttttcagggtacatgatagttgtctcttgcttttataattattgcttgtgtgaaatatgttatttttcttgctagcggcctgttatttatgtcctgtccagagttgtagtctggttttcagattatgagatcggcgttttcttgagggtctagtagtcattttcgaaggtagctaatgatgttataggcttaaaaacggttgctctgttgtacttgtaggagtatgtacttatgcagaagcctgctttccgagggggagaacttttggaatcaactctcacaacttaactacccctagatagctattgtctcactgttatagtgttatgaagctgtgcttaaagtactgtctaaagtcatcttgactctgataattacatagatttgttttctctgtttcaactattgatgcatgaatatttgcagtcactcaccacagttcttgggtcatgtcttggaaatgtcatgtgccaatcacttgtattatttgaagatctcttggtgtccacaacacttccaccggtacggggtctccctttaatcatcacttcttttataactttgttttctttgatggctttgagcagttcccatgtgattaatgtagttttaccactttgtaggatgatacactaaacctatatacttatgctatcttgaggttaactcctcgtgctttattgtccaatgcaacttcctggtcctatctgcggaaaggaacttcggttcatgctggccccacttctagttcatcaaatggaacagcttcagtagaaaggtatcgtagtcgatctcgtgatacttctcctggtggacaaaatcagatgcatcattatttcaggcctctccagcgtgagaaactatacaaaggaaaggatggttttgttgccgctggttccactacttcagaagttcgtggtgctgtggcttgggttcccatactgtggttccagcaggcagaagaccgcatgcatctctgtgtttatcagcacaagaacataaccattctgctactgattccagcttcatctctaataaatggagatgatggcattgctcatgtgaagagacatcttcttgaaaatgtgagtggcccttgcataatttccacccttttcatgatttcttgatgcggtactgagctcaagcaggccatgttgaatgaaaataagaaatattctcatgtctggtgtggcttgcaaaatattgatactgtggttgtgaacacatgctcatttttttatatttatattgcaggcatcacagaacattgtgactctggagctgaaattatcacgaggatggggaggagaaaatgcttatcatgttggtggatatcgctacttacttgttgatccagatagaaaagtatcaagagcctccccacctgggaaagtcaccaccctctcaaaggtttgttctgttgcatacttgcatatagagtaaacatacgatgtttcctacaatatgtgttaatggttctgttcttctcttcacctcaatatttccataaattttagatcctaaagattgttaatgttggtctgtttttgtagactaatatgttttagatgatcaattcgtatctcctgttcatttcttcctcactattgttcttcggttgcaattttacgtttttgtgttgaattggattgccatgcatttcttttaaccgtgctctgcaatgaaatcatgcaggattctctactttccttgaatagactaagagaagaaatagatttggagaagtcaagggccaagaggtctgactcttgtcatgacaaggattttgaagtatgcatcagagccaaaaataatgcatgggtcattgctaaagttacccgaggaagagaactttatatggcgttagagaaggctggtgaaacacttctttatgcatctactgccatcgagaagtttagcaacaggtatatttactcaataccttgtaaggtcatgttcggtaaatccctaggtggggggaatggaggggatttattccacacctattgtgatgtggaattattccctctcaatcccctccgatcctcttcaatccccatcaaactgaataaggcctaaaggggcagaagcatatcttaccacattatatgaccagctttggtttactgtgaccacttgagttataattccactgtcatgcattaaccgcctaaacgtggtatatctcaatatcttgtaaaggggcagaagcatatcttaccacattatatgaccagctttggttactttgatcacctgagttataatagttccattatcacgcattggcctaaccgcgtaaacatgctttcgatttttctaacgattgccttcctctctcaggtactgtgaaggagcattctctacagactagaacaccgaaatgacaacgattgttttatccaaaccactcacctatccagcttcgtcatttaggctgtgcggctcgctccctcatggtgtcgtgaatatggatcttgttattttgaagagattcgtacatgttgtacagctgccatgttgttgcctttctatgcatacaaaacaaatagcttcgtcagagaacaatacagcgcaggaaacagtcagtttcccctgccctgcgctccgacgtccttccagttccagattcgaccatcttaatttgtttgttgtatattctgacgatggacctgctgacttatgtagtagttcattcgattgcttcgatatctatgtttcaattcagtttgttgttgtgatttgcgtaacttatacccagagtgattgatttcctgggggatttgaagatgtgccagaaagaacgtgggatgctcaccgggaagagatcatgagaatggttagaaaactataggtaagatgagattctttggacacagtaaagccgagtgttcagagacaaagataggaaataaacatgttgatgaaaaaagaatcaatacaaaccaaaaaatagctgattgcttgaaagcgttcatagagaaacgtaatgatgaaaatcaatacaaaaaaaatggcaaaaatattctacaaaaccgattgctcatccggggaatcgaaccccggtcagtaccgtgggagggtactatgataccactacaccagatgcgctttctgtcatcgttctgaaaatttaggtatatgatgatataatttcccggtgagcgaacgaagataactgagggctttgatcactttcttatcaaaatcaacgttactaaaattttgtaatatcaaatttcgatatattttaatgttatcgaatttttgtagtgttgattgtatttgtcttaaagtcttaccaatttttcatagagtatctaggagagaatctttcgaaattaccaacatttaagtagggtacaaatggtaaagttatatttaactttttttaattacccatatatacggcatgtttggttggagggagttttaaaagggattgagagtttagagggatgatactattaagtgttttgtttggaacttcctccttttcaatatctggtaggggtaggtaattgggaaggaattcctcatttactttatctaagcaaatatcaattatccgtttttattaatgatctaatctctaactaaactccctatcaatttccatcacctctaccaaataagatattgagattaaaaattaaattcacatcttaatcttatcatcaattcactcatataaatttccaatcctcttcgctcaaattccaaacaacaagctatgagcgctgggggcgtctatgggagcagtcacctaacatgtggaccctatatcgccacgtcctaattaacccaggcggccaggtgggccccacgcctaggccaaaacccacttacatctgggccccaccctcgcctctcccggcgcgcgaaaccagaccatcgcaccgtccaccaccagtctcgtagcatcgtggcgccgcaccgcgccgtctccctctctctctctctctctctcttccccttcctcccctgaaacctaacgcgccaccgccaccgccgccgccgcctccctctcccaaatcttcgccgggaatcgcgacgatcaagccacgaggatcgctgctgctgctgcagcagctttgcctgtgcttaacgcccaggtataatgcggaccaggagccagcgcgacggccaccacgccgccgccgctgccgaaaccccgccttccggttcgtctccgcccgcccgccgcgccgcggcgatccaccccccctcccccccccccaatcctgttcccacgaaccccgcctccgtcatcttcccaactgaaaccggtgtttgttcgtcccgcaggggcaagcggaggatcaggaggggacgttgcgaggggcggtggcacgcctcgccgtcgccggagggcttcgccggccgcggagaaagggaagtcgcccgccaaggtaaattaaattaaatcggtgtttgtgaaggactaaaggctctgtgcttgatttcctcattgcgacaagtcgagaactattttaccatctgtggcttgttcaggaacttcgggctctaaatgttccttgtggttaagcgcgattgttcgacatatgttcacattgtatgacttcaaactctctaaactagtaaattgatcaaaaatgctctgggtccttattatttattcaagtctaagttttgcactcttaaggagtgtaattgagtcggaagcatatgtcaaaaggatgccaaataattactatagaatgcattgattttgagacaaaaaaataaaccaactcgatgtgttgaatcatggataggttctggcttaggactctgaaggtttaatgatgttggtggattttaagtattactcctagctgatagggctcaactgctattgtctcttcaggtggaaatggaatcggcattggaggataaaagtaaaaacgttaaggtccatgcagagggttatgacgatgccgggatgacgaggttcggtagggatggctctgaaaagaacagtttggaggaagaagatccagatgcagctgatatggactgggaagaagggattgttttcgcggcggaacacgatgagtgttattcccatgagcttggagagacagtcaccgttgagttcactgatctaccctcttccactgaaaagaagactgctcggaggcttactgctgaagaaaaggtaaaatatttcttgagagaaattttcagttaaggcgtctgacacagatgagctcatggacatttgcattaagtttataacctgttactataagtctaattttatcgttgaaaatttttttataaaaaaattctatttgccttctaagagtttcctggcgccagctcatttgccaagttgtatgtaatgctcaggagtttcgtcacaagctttggaccatatctaaaagagtcactgccttttcctttcttgtgtgctttaaatatctttgttatctttgaattttgacctgttagttttatttctgattatccaggagttggctgaactcgtgcacagggtccatttgctttgcctactagcaaggggtagggtaattgacaaggcttgcaatgatcctctgattcaggtgcgagcattacagtggtattcattatttcatttacaccagattctgtatttctcatgttccaaaatgatgaagtggcattatgatttatgaatcatagtggttaaaacagaggtgtgtttcaaacagaattgtgtcaatattctttgaaatgttctttccaggcttcaattctctctgttttaccacaacatgtactacggaattctgtagacactccaattctgaaagctaatgaactgcgtagtcttgtgagctgggtaagtccccttcatatattattttattgactaaaaatgtgaagttttatgaaatagtagtttttagatgaaatcttttaatttgcatttatttgtctgcagttccacaacactttcagtgtaattgcacaatccgacgacaaggggtcttttaaatcaaatttggcatttgctcttcaaagttatgtaggcactgctgaagaggtatcatcttctccctgaagattatgctgtgaaacaaatctgctgtctttatttcagcaaacttatttttcttattcatgtttctcagatttggaaaacctaaaaagtgaataagagttgtcatatttcaatgccccaaaatatgttttccattgagatttgatatggattgtcaatgtctacttcatttcttttggaaaaaaaaacaatctttagttgccactgaaagttgacaccattggttatgtgccgtcaggaaacttggtctcccttcattgtcacccctaaatattgttctgttatttctattgtcgtctgcccttttaggtaaggttgccaccaacatataaaatactgtcagtttttttttctttttggggccaaaatagaaggacgagagactccagcagctcggtatgcgcatgccaagttggtggcatagagtgttccatcagtaactgtgcacaaaacaccaaaggcctaccgacatgactcttgcctatagtggtcatgagttacgcaccatgcagtaacactaccaaaggaaagcaagagatacattcacaggtcgacggtcgaccagtcttctcaccttggaacgagggagaatagggatgcattaacaagctgatcagtcctagggccatcaaacgcatggtgcaggtgtgctttctcatggcgtgaacaggtttcagtgcacaaacattgaaaccaataagcatacgaggtagaatgcgtcatgaggagtactgtgtagttgtcagtgggaatcaactatccttttgcaattccagtgaggaaatgctctgaaacaaatatggtaaaatgattgctttaggtaaagaaatatgggtatgggaacacatctttacgctgctgaaattgttcttggacccctggtgctccggttctcaatggggaagataatgatggagaggttccttgatgtcacaatggaaggaggatggagccagtgcacctggagtgaccatgactaccttgactcctttttggctggagaagatgcagaactgtcttttttttttgtggaccacttaacagcaaacttatacaggactgtcgagtggcaaataaggtaacaaaactctgaaggagtagcaatgaagggagaacttttcctatggcatataaggtataatgtcaactttcagtctttcaatggcaaataaaaaatctcctcttttgtaaaacaagacgctatttctgtttaaagctgccaaataattcgtttgcaatgcaggtttgtgcactttcagtggcattgtttagggctctcaacttaacagctaggtatggatttcactctgtaattagttttatgattgattccatccattccagaacgttagcataaaaaatccataaatcattttgcaatccattctcgtcgaatgctgtttgcttttgttccacgcaggtttataattatagtaaacagtttccatgatatgtattatatgtttaattccgtggtgaaaactggattttctgatctcttccagagaatagatttcttctttttctttgttctgataaaaaaaaagaatttgtcatattctaaagaagtggttcagtagaatggactcttaactaactttcaataaactacagtttgataaaatcctcgggtgcttgggttagaatagttgatattactcctccccagactgatttatttttttttcttcctatcgaacttcccataaagatcaaggaaatttcaattgtaagaccatctattatagttagtaaaagcgcatataaaggttcattatgttgtcctgtggttttgttcgataaccttctgaaccaattctaagtatagcttcccttctaggtttgttgcgaatctggatgttgctggtctcaagcctgacactaaatcaatggggacatcaaatcaggatgaacctaggctttgtacaaaggcgctgccatctagttcttttgttgcaggccataatgagtataataacctttcacctgtcctgtcacaaaacaatactgaaggtagcatcaatacaactccaaaacaagtcaaagttcaaggctgcaggaaaagtttgtctaaaaaattgtcgaagtgcaaggcaaatcagagagatagctctgcatcactatcaaaagatagctcatccagcagccaatatccttccacctccagtaatgctgaagtaccaagacgaaaaggggatttggaatttgagttgcagctggaaatggctcttttagcatctgcagctaaaagtcaagacaacaagctagcaactcaattaaatcagtcaactgatagcttactaagttcaactccaccattgaagaagttacgaaaaagtgaagaagcctcaagcaactcgagcgtggtttggtcgaggaatagagcaccgttattttgggctgaggtattttgtggtggcgaggcatcgtctggaagatgggtccatgttgatgttgcaaatgatattattgatggtgaacaaaaagtagaagctgcttccgctgtttgcaggaagcctttgagatatgttgttgcctttgctggaaatggtgctaaagatgtgaccagaaggtttacctctttcataattcctaacttagtagctatatagaatcatgaggatatattctttgcttttggaaatttgtaaaagaactggtttgagaactgtgttctatattttcctaggtattgcctgcaatggcacagaattgttcaggggagagtgaatcctgagtggtggaaaagtgttttggcacccctagagcgtcttgaattggcagcaacgaacaacactgaagaaatggaacttcagaccagggccttaacagagcctcttcctaccaatcaacaggcaatgcacttactgagtttacgatattggttaacttctagttatgccttttgcttctttcaaaggttgcctgttggcttttctaattatttatgtaaccataaccacttaggcctacaaagaccatcatctatatgcccttgagaagtggcttcacaagaaccaagttcttcaccccaaaggcccagtgcttggcttctgtaaagggaatcctgtttatcctagatcttgtgttcagacactgcaatcaagacatggatggttgcgggagggtctgcaagtcagagaaaatgagttgcctgcaaaggttcataatagaatcacagcgctagcagtttttttctgtcttcatgtgaagtaaccatttttctgtacacaggtcgtgacgcggccaaagaggactttcaattctcagtcaattcaatctaatagtaatagtaatgaagatgggcttaagccaaccatggaactatatggtaaatggcagctggaaccgctgcaacttccccatgcagtaaatggtattgtaccaaaggtagacctccttgattatgactattgattttcattaggtagctatcagtgcttattttgtggtgttccatgctgattaaatgctaaaatatgtccaagaatgagcgtggtcaagtcgatgtgtggtcagagaaatgtcttccgcctggtactgtacacctgaggttaccaagaatattccaggtcgcaaagagacttggaattgattttgccccagccatggttggatttgattatcgaaacacccggtgccttccagtttttgatggaattgttgtctgttccgaattcaaaaatactatcttagaggtatgctgagtacttgatttatttttcaaaattctggtcccattcatcctgctgtctacaattttagtcggatcctttatgcaatctgatgtggatgtttaattaggtaaaattattaacaatctttaacaatcacaaattagcccaaacctgttagcaccttagtcaaaagtgtgtgcttgaaaggtatttgcacactttgtaaatatttttattttgttttcttccccttgatgaaatgaaatgcagttctctcgttttcgagaaaaaaaaaggtatttgcataagcatgtttcataatagcgcttaactcattgttgagcatgtctcattataatgcactcaatgttatggaaagtagtgtaatgatcaagagtagaattgttatattcatgtatatgctagaggtagtgatggtattatagtctctaggttcctgtactctcttgcgtaacaagaactaacagggaaaattgctcagtaacactaatcactcgagttagaaaataacatcgatgtgtcactgtcatgtaggcctagggccaaagctaattctcctagtttcatcaggtacatacaaagctagctctatagttggtctaacttactcctacgctttctgccaggcatatgcagaacaagaggaacggagacaagccgaggagaggaagcaggaggaagctcaggctcttattaggtggtatcagctgctgtgttccgtcgtaaccacacagcggttgaaggactcttacaaagcaccctcatcagagcacggaccagaaggaccatcccaagatgttagtcagcagaagggcacacgcaaaagtcgaagctcggaaacgaagactcgctcaagcagactacaggcggaccgaccatttgattctccttttcctgtccatgaccatgagcatgagtatccagaggaagatcagagcttcgacgaagagacgtttgtgaggacgaaacgctgtccatgtggtttttcaatccaagttgaggaattgtagcaaaatgatatcagaaatgcactaacttaaggtgtagcctgtttttggtcccaggtgaactctcaaaactatggtagctgtgatgcttctgacgaatgcaggttttgatgcatttgtcttgagttgggagttaagagtgagtttgctaaacccatagttcagctgttgcactgaaatgaggtgttgaaagttgaagctgatggtatgaaatgtagtgggtgttaaaactgttaacagtatatgcttgtttaagtttcagcatagtgccatcacgctaagattttatcaaactaatgttgagtttgccagttatttcttttacctcttcactgctaaacttgattaaatttctatcaccaactttattgcattcacatgttgagaaagaatctcagggaatttgagaataatgaaataaacaatccaatccaacgtcaacagtgtgtgaccttatgacactgcagaatcggcagccaggaacagtagaggaaatggaacaacaacaaatttggcaatgtctccttactgaaagggaactcgagggaaaccgtggacgccgcacgccggcccggctcgccgccggtcacgccgacatgctccggctgccgtccgtgctgccggagtcggcgttccggcacgcgtcctcgacgatgcgctcgatccgcgcctccacctcggccatggccggccgccggtcggggtggtgctcggtgcactccatgcccagctgcagcagccgcatcatctccccctcggtgcgcgcctcgttgccgatggcggcgtcgaacacctccgacgtccactcctcctgcaccaccgaccgcatccaccgcggcaggtcgacggcggcgccgccgtccggcgtcgcgtcgagcggcggccggccgctgagcagctcgagcagcagcacgccgaagctgtacacgtcggcgctctgcgacacgcgccgcgcgtcgaccacctccggcgcgcggtaccccgcgccccgcttcgtagtcggcggcgccgccgcgccgccgacgagctgggccaggccgtagtcggtgacgtaggcggcgtcccgtgtcgcggtgacgacgacgttggacgacttgatgtcgccgtgcgatgagattggccctccgcggtggatgaacgccacgccgcgcgccaccgccagcgcgatgcgcgcccgcgccgcgaagtccagcttctcgccgttgcctacataaacatcaatcaaatcttatatgaagttactattcaggaaacgtattgactccaactttaaacacaactacaaaagtgtgacatgaaaaaaaatactccctccatcataaaatataataatttttagccttcagaatttattctaaaatttataacaacttttctaccaacattttcttcacaaccaatcacaaccctccaccattcatttttctcacctacctcaactactcatccaatcacaaccctccaccacttacttatacctactttcttaataaccgtgtccaaccttaaaacttcttatattctggaacggatggagtactaaatactatgtgacggagcataaagacagcggccatatggatatttatcaacttcatgtgcagatttacaaatagatttgaataaatgtttgtctttattttgtgttagggttattagttattgtttactacttatttttctggtttatatatgctctctattgagtgaaataataagagccctttgaatcgcaggaatgaaaaaaaaataggaaatgtgcatgattttaataggaaggtaaatacaaaacaaatgattgcaaaatataagaaaaatataggaataaccgtttgattggactcataaaaaatacaggaatgggatgagagatatagactcaaaagaaaaatttttaagaggttagagctcttactaaatttcctccaaaatccatataagattgtccattccatagaagtttcaaagaataagatagggttcaatcatttatttcaaataccttcatggaaattttttttatagaattaaaatcctccaaaattcttatgtttttccgccaaacccataatctctttataagcaaaagaccgtgtttctttcgctgcacgaagagaagtgagaaggcgaggtgatgtgatgaacgaaccgtggaggagggcggcgaggctgcctgcgccgacgacgaactcgtagacgaggagcttctcctccctgctgtagaagtaggcgaggaggcgcggcaggctgtcgtggctgacggcgccgatggccgcgacgcggtcccggaactcgcgctccgagaggctcacctcgcgcagccgcttcacggcgagcaccggctcgccgccgtcgagcgtcgcgcggtacgtcgtcccagccgcgcccttgccgaccacctcggccgacgcgcgcagcagcgtgtccaggtcgtacggccgctccggcgcgccgccgacgaacaccagcttggtgctgccttcgcccggcggcggcggcgagtgcgactgcttgacggcggcgtccatgtccgtcctcgccacggtcaccgtgatgggctccgccacgtcgtgggcggccgccgcggcggcggtgctccgactccgtggcgccgtcgcccggcgccggaagcacgccaagaaccccacggtgagcgcgacgacgagcgcggccacggcgccgaggacgatgccgatgatcgcgccacgggagagctttccgccgcccttgctgtccccgggcggcgacggcggcgtcggcgaggggttggcgcacggggcgagcggggcgccgcagagcgacgtgccgaggaaggcgctcgccggcatcccggcgagcgacgccggcacggcgccaccgagctggccattgtacgacacgttgaaccgcgcgaggttcggcagcgtcaggttaccggggagcgtgccatcgaagccgttgcggtcgaggttcagcgtggtcaggctcgcgagccggctgaactccggcgagacgccgccggtgaggcggttcccggagaggtccaccttctcgagcagcgccagcgagaagagcccctccggcaacccgccggcgagccggttcccggagaggttcagcgaccggagctggacgcagccgccgatgtccgcggggatcccgccggatatcgcgttcatccggagcgacagcgtccgcagcgcggtgaggttgccgaccgtgcccacgggcaccgctcctctcaggctcttcccggggagccggagctcggtgacgcggtcgccggaggcggagcacccgacgccgcgccacgcgccgccgcacggcgtgggcgccgaggggtcccacggcaggtgccgcccccccaccgcgtcccgcagcgccagcagcgccgcgcggtcgcccgccatgtcggccgccgccgcgcgcgcgacgagcaccagcagcagcagcagcagcaggacgtcgcggcgtcgcccggacgacgccatggcgaagcgagagcgcgcgaggaaggcggaggatgctgtgctgggtaagggatttatgggcgggcgaagaaggcggcgcgcgcgcgcgcgcggcggcgagagagcttaggtttctccatttggaagagctcggtttttgtccagctcgattgatcgccatgcgcgcagctggcatgcacacgcatagcatcgtggacgacgacgtcgtcgggtggtgaggtgaaagaactgaggcggcgggtttggaaggcagcgagcgagcggcggcgaggaagagcgacgccgtcaatggcgccggcgacggccggccggccggcgagcagattgggcccgacatagcatgctgaaataagcccattgatttgatgtgactgcccaaacgtagcattaggcccatgataattaatacagtactccgtattaaatttccaaatttgaggttgcccatttttttctttagtgaaatggaacagtaagacaattaactttgttgccgcaacgcgatcaatgtttgttgatatgcatttcacaaatggttaccaagccaaacatgtgggttttttttgtttgttttttttaacatgtttgattcagattattgagtaatagaattatacaaaacacaatactgagtagaagaaagttttctgataaaatgtatttttccgaatcgaggagcaaacaatccatttcaattatctaaataatccgaaaggaacgaggactttaccgttgagctgtcgtgtattcatgtggttcctaaagcaaacattaaaattcctcgtaagtagtagtagtattagtatgtctgcatgcataaacaataggaatggaaagataccgctaaaagtttttccgaatgtgaaaacaataagtatcttttttaaaaaatagaatgataagtaaattaaaatggagggagtactttctgaaagttccttatgcccccaagtcttcacttcatcctctttcatgcatatgagtttttgccttattcatgtatgtctttgtttttctttataataattacatcttgggccaaagatttttttttacccaagtttcaccttcaaactactctcgatataattgtcaacgggggatacatgtagatcgtattctgaggtattagggtacgttggtacgaggatttatacgaaacgatatcaagcacacagaaaacaatgattatattagttcagacccctcgtaaggtaatagtcccaatcttgtttatatgggattatgaagaaaaccacagagattataatagagaaccacagaaccatcgagttactgagttcacccctgtcgagaatgacccgacgagatcaatcaacgagttggctttaagtccttcggattgcttctgctatggctagtggcaaaggtatgattcgatgatcccgtaccccctgggagccttgtatttatacccttaaatgtcttggtttccaaatagaactcaaagagtaccttacacgtacgagatcacactcctccaaataagactctaacacattatattcggggagtcagtttccttatacatcagcctattttaaggtaacattcccgtatacttgaggatataccatattcgtataccgcgtaacccccaggataggaggtatgtcttatccgtaaccctaacactaatgttttcacttcaagacaggtattttacctattttacactttagaccaccgtcacaccatctctctctcccttctccacctcatgttctccaccgccccacctgttattgctggtttgccacctcccccgagctcaagctcaacatttgactctggtgtccccaatattaagctcagtctcttccttgtaggaagacaacggtggggagctcaagctcgacaacgaggacctctacaagctcattgttgccttgttacctcagcttcattctaaatatcaatgtccggagtaaggaaaaactacctccttccttcttcttgtcctccatgaaaccattgatgccatccttttccctagatctaactgaccagagttggggacgactgccactaccccgcttttacttcttcatggggattgccgatgcagttgcactactttgccctccagctctgctccatgaggagagggagatcaacggcatcgacaagacccaaaacttgatattcacttgcaacaccagaaacttgagcatcatcaagaccatgagctcgatctctatcatcgcctatgctctcatggctcccaagcttgacctcctcctcctccaatttcacttgatccagtggcgtttgtggtcgaggtgctaagaggcatgatggagaaatgggattgggaggaagaatgtcgcggttcaagagaaaaggagcacacagacgccttgtcaatcaaggtccgaatggtggtggtagggaaccagaggtggagaagagatagatggagagagggtggtccaaagtgcaaaaggggataaatataccatggtaaagaaaatggggacaaatatacatggctttcaatgaaaatattagatatgggtagtcttagtgaaagtttggtaaaaatcttactcccaaaccacaatttactccatttcttttgatcgctctattcccattccatttgttgactatgagctgattgttagattttttttttacgttgactacattgtacttgttggtcataagtaagtgcttgcttaaaaagcataattgtcatgtgaacaaatttcaacaagaaaattgaaagtgaaatagtaattagttgaccccggatttaaaaattcttatatgaaatttgataaatagttttagactaaattttacgaaatattaaaggatagtttcactctactctttccaaagaaatttaaagtaggttcaattttacttattttttaaaaaatacaaattttatttatgagtggaagataggaaaaatggtgatccgtgtaatttcccttttaaaatttcaccaaatttggttgcaattcactagaaaaatttaaattttggttttcaaaatttggaattttggccccttaaattgttgtataattgaagcttttcaccttgataaattttataaaattacatatattttgatcaaactattacaaaataatatactttaaagtggtgtatcataaaactatagatttatgactgaatttatataaaaaaaactacatatttaagatgaaattatcccagaactatatggtttgcacaaagtacagtacaaaactacaacatttgtaactacttaacataatagtatgtagtcgtagggatttaaattgtaaaacctatagttttgtgatgactgtagtattaaaattgtagttttgtgatacttggcattaaatatgtagctttgtgataaatcttgcgttaaatctatagttttacgatacaatatcttaaatatgcagttttacaataatttaattaaagtacagttttgtaaaattactcctacatatttataacaaggtacacacaacttttactactatataatagcaggagacaatataatcattttatttttaaaatgacattcacgtatagtgattggtttggtcggaaatacatgacgtcataactgctaaccacaattccctcgtaccatcacatggcaaacacgcgcgaaatctgacacgcgaaatagtacgaccgtgacgcgccacagctctccccctatccgatccgacgaccagcattgagcgcgctccccctgccacgtcaccgatccgcgtactctctcctcattggctgcctcctcctatataggattactccccctcccgcttccacccccaacccaatccactccactccaccgccgctcgctcgccgccgccgccgcgtcgtcgtcgtctccggcctccgcttcctcgccgacggaatcctagcttagccatggctggtaggggcaaggcgatcggctcgagcgccgccaagaaggccacgtcgcggagctccaaggccgggctccagttccccgtcggcaggatcgcccgcttcctcaaggccggcaagtacgccgagcgcgtcggcgccggcgcccccgtctacctcgccgccgtcctcgagtacctcgccgccgaggtacgccacgcatggacgcactcgaattcgtggtcggattggattggatggatgaattcgggctgaatttcgtttggggatttttgaattctcgcaggttcttgagctcgccgggaacgcggcgcgggacaacaagaagacgcggatcgtgccgaggcacatccagctcgccgtgcgcaacgacgaggagctgtcgcgcctgctcggcgccgtcaccatcgccaacggcggcgtcatgcccaacatccacaacctgctcctccccaagaaggccggctccagcgccaaggccgccgccgccgacgacgagtagagacgaacacagattcctcactatgacgaacactacatgcttccttccgccgatggattagacaataggcatcctgcttaatttagtttttaattgtgcttgtttcgtagacaagggattagttgctctgtaattggtgttaatttatatgaaatagtgtcatctttctcgatgacttttgtcaaaagaaattctctccgggtgttcagattttccaggttgatttgaatgcgttgtctataaatcgtggtaaatgtttcttgatttttttaactcttgggactttttttttttgaaacaacaactcttgggaaattgggttgttgtcaaacgtcgcgtctggtttttctagagttcgtgcgttctcagcgtggtattcaaattgagacttgatttggttctcaaaattgttggatctagcgcaggatttggtttgaaattgagcattggcgcgggcgggcagctttgaaattcatgtgatttcaaacagtgccaaggcgggaagacgaaaatttccgccaagaaagaaacggcttaacggcaggaaagagagagagagagagagggggatggggaaaatgaaagttgaaaataattttaaaccagctccttgcaagtggaagcagcctctatacattaacatgtgggtcccacttgctttgggcccacatgtccgtgacaccgcctgcacgttcagtatcccattcccatgaaaggtacacatacggctcattagagtagggaaaacaggagggtcataagtcaattactatgagcttctattgaggtgatagatacaaaaaaatatatggtgttgaatttttatgtaatactatctccgtcccaaaataagcgcagtcatacgtttccgcgtccaactttgatcgtccgtcttatttgaaatttttttataattagtatttttgttgttatgagataataaaatatgaatagtactttactcgtgacttatgtttttaattttttttaaaaaaaattcaaataagacgaacggttaaagttggacgcggaaaactatagctccacttattttgagacggatggagtagctagctctacacatggtttaatatggatatattaatttcatagtgagataaagagagaaaacaataaaactaatctattatatatatattagctatagtataaatttatacggggtagttgttctgctattaaacttgctactacgagaggattaggctgctgcagtttaccacctgacttcacacagagtacatactttcttcgtctaaaacaaaccaacctcgtattaggatgtgacagcgaatctgaatatactctatatccaaatttattgtattaggatgtgtcatatcttactactagatttttttgggcggatggagtacatacgtacatggtatcgacaagggtttaccatccaccctaaggccccgtttgttttctccattgggaaagatttttcagcgcatacgtagtgagaaaacttattagtacatgattaattaaatattaactattactaacttatttgaatcttataaacaacttttatataaaaattattgaattctagttaatttatgacatattgattagtatattagtgagtaattagataattagtgtgtattagacgcagatgttttttttgttgtggattcgccgctacgttcatccttgtttcttttatgatatctaatgttttctattaacaagatgttatcatgacagtactaacgcagtatgaatctgtgatatatacacttaaattaacatgaaactaattaatcgctgatactcgagatggaaatgaagttcaagcagaaactaattagatcaaagttctgacgtggactctcctctcgcactagtgttgtcacattccaattcggtggttggagattaaaagagatggttagagtggatggccgcatgcaccggttgctgaatatctatatgcttaattagtgagaaaaaacgtggttttccttttgatttgtgcagtcgtttgttgttgctttgccgcttccatctagtgatggtcagcacatatatgctctgcacgtatgtagctgttcttttctcccgaagacttaaggaagattatgttttttacgtaaaacgagatggtattaacgtatgattaattgagttttaattattacaaacttgaaaaataaattaataggatattttagagcaacttttatatagaaagttttcgcacgaaacacaccgtttagtagtttgaaaagcgtctcacgaaaatcttaaacttaatccaactcttgttagagtagtcataatcttgcattaggtgaaaagttggaggctaatccatataaaaaaagtttgtagttctttgattttgccaaagtgtcaatgcgtcataagtttgatatatttcagtgaacggcatcatatataagttgatatttattgaggtcagtggcgattaacaaagcaacagtgtacgtatgaggtctgtaatttcacttggtggttatatttgttgttgaactttggagtaattctgaggtagaagtagagcggtagatcgatgaacccaaaccagaaatagtcaaaaaggaaaaaaaaagagaagctttgcaaaaggcaaaatttactttgagatattcttggttaagttcgtggcatttgctattggatactctcgttttgtggatttgtcataggacattctagttttacagttgtttgataaaaatacactttgaccattattttagtggatttaatatattctcttccaatggagctataaaactgcaaaataaaagtttagctgaatttaaatatattatgcaaattcaaaacttgtccaaagttgtggaaacgagaattgccaaagattttttaaaaatcgaacaaagaaacaaatttgaacaaatattggttgcatttaaataaatatttgtaaaatgtttttatttctgtaatttgagacaatttttgaattttgcaaaatatgtttagatccagtcaatatttgttcaaaattacatcttgcaaggtgacctaacgataaaatcatcttttcttcatttaaagatgatatattgaaataatggtccaaatgtctcttactacctcccaagaaaggtattaggactgagagagtagtaaacaatcgtaaaagtgtgtgctatataataaagtacacaactaaagtattcttaagcaaatgtcgtggatttagagtctcctagagcaaattttacctcagatattggtgtgtgcctttaatacacagttgaatagtacaccatacacccaaagtgcgatttaatgcatatatatacccacaagatatgcacacatatttatactcataaaattggatagcattagtacacaatttaagatttgaacacaagtgagcggaatgcacaacttcaagcaccaggactagcttacatggccacttatatatcaagatcttatttatggaagggagtagtccttaattaagaatttcctcatcagattatatataaaaaaagattttacgctcctttcaagatgcttaagttgaacagattgctgagaggggaggtcatatttcaatttcgaaatgtccatctgaatacctgtgttaatttgtacgaacacgtacatggccgtttcttccacgcacccgacgaaagaaaatgactcggcaaccatcaagttttctgctcattgccttttttgaagagcaatccacgcaacaatctgtcctctttttagtccttgtatagattgtatgaactaccttcatttttttaaaatgcttgttttccaaagcatggcgtctcaaatgaagcaaaacaaggtctgatcaattcagcagttttgttaaattttcctcacaagaggctttgttaacaatgtgctagcaatttgtctggttgaagaggaggaattaattcaaaccatgcatggaactaatcctaatccactcctaacaatactttttcaagagggtgaaaaaaaaaaggaaatggcatatgtcactgttggaacaatggagatggttggccccaaaggtttctttccaaacagttgaaaggagcctctctccaactgttcacaaagtttgtcacatttctcacccaccaaatcttccctacaaaaatataatccccacaagcaacaccacacccccaagtccttctccacctctcactttctccctcatcttctctctctagctagctcttctcttgcatatatatatatatatatgctgtgacaccagtatttcatgttctgggagtagcaaagcacatgtcaagattgttgatgctggctactactgctacaatggaggaggagatgctggaggagcaaggtgaaagcaggagagtggtcaggttggagcaagaggtgctgatccacatccaggtcaggaggatcaagcaggaggatgagaaggccagggggcttctccagaggctgcagctgctggagatgaggcccaccgccaccgccgtcatcggtttccgcgagctggcgcgccctccctcgccgtcgccgctacgccgcgccggtcaggccatctccgttggagattgagggggggggggggggggcatttttctttcccttgatcaatgtggtgtaaatatgtaggagagttcagagtgtttcaggttttcagttcatgtgatccatccatggattggcataacttgatgtgttctcttcctttgtgctgtaaatacaattgagccgcttaaattgccaggttgcattgtgttggtttttctctttgatcctttcttggccggaatagcttcagataagaatgcagaggtcacatcagcaagcaaagcggatgaagcaaagagggaggattagccactcaaactttgtataatccatagacagcagattggaccagaaaacatggattatgtcatgctaaccattggatggatgacaaaccgatgaatcgtgtcattccagtaaacaacaaagtgaatattttttccttggtgttgccgacaaggtagactagtgaaagatcccatctaccagattagaagtcagcatcaacattggagaagaaaaatcatactagcaattactactacctgataaagaaaactattgccgttaaaggacatccaagacttgggataatatagactaaactacgtaacttctacggatgatgatgagtcataaaatcccaggatttacttttgtttgggaagcttaacacgacaatctcaagagcaagcagcaccaaaaaaaagaaaaaaaaaacctagggttgcaaatcccagataatcactacacaccacagttgcgtcttcttcaaacttctagaggcagagtttgtttttgcaaacctaagcagaaagttctctgcttccaggagtactacagctcaatcgggctaacctatcataacgataatcttgcaacagatgcttatagagcagttgtgacaaaatggctgccaccaccgttaggtctgcagcgatcagtcggtcttcattgcctcagcatgataagtttccaggtctttgtccagctcatctgcagtcttcccagcttgcctccttccgcgaccacggccctggaattgaccacggcccctgacactgccagtgccacggccctggaactgggactggaatggggcacgacccctgccacggcctcggccccggccagcttggaaggcaccacggttatatctattactggaatggcaagttcaggtgacagatcagcaaaaagatcaataaagtttcaacacatttgtggtgtttttcagtttggttgtgtcaactagggaaaaacacaagcaagatgaaattgtcaccaaccaccgccaaaagtgagaataactagtagaaaacaaccttattttcttctttgtatgtcacaaatgcatacagtatccatgactaaactaggaaaaattgtagtatagcaggaacaggtggaaacatgattaatttatgctagacatgtagtataaaatgtaaacctgaaactctgcacattacatgcttcttattaaaaacaagaagaaattggttacaataataaccaaatggcagttgctttactgtagatcatgatgcttttaaaataaccaagcaaaatgatgtggtcactattcgctactagtaccagataagtaacagaataaattacacagctaagaaaatgatactgtgagaagccttacactgtaggacctgttggtctactgctggaaccactgccacgctggccaatttcaggcctgaaatatatttatttttgttgagatttatagaaaaataaggtagattgactgaatggttgataggtatatagctttaaaggctcagagaaaaatgaaaacaacaaaagcccaacatagcacattttcaaactggagttaaatttcacaagttatcaattgacttgcaacacacaactgctaacgaacgtgacgaaacatatttatcagttgaacttttatccgttttcagactatagtccttcctaaatatggctagctcattagaatatttcacacaatactagaatctgctaagtaaacagctcatattggcagtgacaagttaaattagcacatatactggcccaacaagaagtttacttaaaaatattacaactcatcaaacaaattatcagcctctaaagtaacacatgaacagaagcttgtagacatgccatattgttagcagaaaaaagaaagaagagtttatctgcaagcaattaggagttctgatagcccagtattcaatatttaacttgggacatacagactgcattgtgatgtgtgatccagcttaggttccaggtatgtcattttctttttgtccttggaagctaaataagaaattgagatacatagaaatggaaggattactcacgtcataacaactgttcttgtaggtctgccattagaagccccaaccacatttatgcgaggtgtcataggcaaacctaagtcacttccaataacttctatcttcatagctttaccatcaagcagaacattattgtaacgtttcaatgcagcaattgcatcacttctcctagtaaacaccacttctgctgtgccctgcagaaatttaacaaaaaaagatattagcacaataatcgaggcaagaggcagttagcaaaagtttcagtgatcacaaaagttcatttatcattttctttttgcagaataagcaccgcaaatggacactgtttacatgctgttaatttgctaggccagctaattagtacataagattgtgtatatataaatttttttgaccagaaaacagagagggaggtccccacgctatatatagtacataattattacaacaaatacatgtattttgcaaatgtactctaagcagatcaccattttatggagtttcaaccagaaaagctcagcaaagttcaatgtgtgaaagaataagaaagacataatccctacatatatattactaaaaacaaacatttcctatgtttgtcttcttgctgttatctcaaacgcaagataatcactaagatacatattatcctattgttgttttattgttcttggtaaatctaatgcaaggcataaatctgtgcactggaagttttcatccataagacaaggtataattatacttcatatgtgatcatctagagcaaactgaaagtactgagtgggaagatgacaaggtgtgtatggtttcccttgaaacaatgcaaattggttcaccgaagaaaaacatcactttgagtttacatataatacctaattgaaatcaaaatatgctctatttgtaaatatgataagaagtacaaacatttgggcgcccataaccatcaaagtgaacagcaaagcgcttcaagtgaccaacttctgaaaacagctcctacaaggcgaattgaaaatgttagcctgtcaactctatatccaacaagaatagtgaaaagaaatatcccaaaaaattaattagtctaacaaacctttatatcctcattggaaaccccatagtccaagtttgaaatgtacaattttgtaccagtttcaattccactagctgccatactatcactaaacagatcaggtctccaggtcatgtctttggttctgctaaaagactgaaaatggccaaacatccagcatgtgagaaaatgtgtcatcacagaagcatatcacctcaaactgttctgtatgatcatggcaactatcattagtaatatcaatctttatggtagagcagaaataagcagcttgactatgaaaatgctgcattaacttaaaatggagaggaagagagttccacaaatatcacaagtggagtagataaatggctagagcattttctctggagacatcctagaagcacttcaccatagcagatcccaaagctgtcagatgagagctgcattgaagttccaggtattgcacaaggatcaatgaagatccttccttcggcaccacatgcagattatatattgaattgcaagaataccacaaacttctttttttttcttttcatttggttcgatccatatgtgtgacaaacctccttttccatttatttcgatccatttgatcgaagagcagttgctgtccttcaaagttcccactagatgtatccaccagttatttctgccactccataaatgaaaccttagaaatgatctacccaatcaaagtttttcacaagagattaacagcaaaggaggagagcattcactagcgtggcattggttccccttgagttctctaggaacatcaaattgtaaaaactttgggctgtcaccctagttgggccagctccctgtaatctcatttcctcgttaaccgatcggcaaaaccactgccttctcctctaaaaaaggaaagactaatagcaaagctacttcttcctctcctccacctccacatgatagagagatgctctagccaaatccaactcgacaaaggctcgctccattagtgataacttctgcccctccacattgtacaaaatcttagagatgctctctcttcattcattcagtaatttatttttttttagcgtattcaggagaaatctgaccatgaacaaaaacacagcgtcagtttcggtggccttgccttagcaatagtgcgcgctgatggccgcgagttaaccccgaggccaaggggccctcgaggaggcatccctgatcttccacgcagcacatatccacctctcccaccaccacctccaccacctccaccaccttgaacacggccaccaccactaaccctatccccacccctcctggcgtaatacgccataatcccaaactcgcttcggtcagatcagattaacacggttcttctccttcttctccaacaatcaaacgatgaaaaacctgcaacattacaaggctcgatcagggggggaggcgcgaggcgcgaggcgaagagaggaacctcttccagatctagaagaagagaggggggtaggattagggcaaagagagaaggtgcggtgcggtgcggtgcggtgcgatgcgatgcgatactcaccggcgttgcgaggatgcggagtaggaagcagcaggacgccggcggctgctcgccgctgctcggccgtgcggaggcggaggcggcggcggcggcggaaacgtgaggagaggaggagatgtagtagagaaggaagcaaaggtggagtcaatgaagaggataattgcgctgggctatttgtttagcggtatgggctttcatgtgggccggtctgagtcgagtacggcccagcccggctgaaacggaatcgagaaggtgaacctcataggaataagcttatatcggaaaggaaaaagtacaccgaaggtccctcaacttgtcatcaggataaagaaagtactcgaaccg

SEQ ID NO: 67566 - DNA, 2889 bp, Oryza sativa
catagccacatgcttgaatgggccttgccaacatgacagaaatggcccatgggctcattcacgcacgcgcgcacggacatctaccacggcgcatcaagacgggctacgccattgatgacgtcagcgagcgatctcccttccgaccctacctaccggaggagaagcagcagcggtactactacggagtactttaatttccgggttttcggacagctcaaaagtagcgaagtacccgttaattaaacatggtccattctccccctaattctacagtattattatatatttgaattaggtgcacagtctggatcatagatgatttttataattataattgtgtttctgtgtgctaaaggaggggcagaaacagattgttttcttttttggatatatggagcggaaagggaggattcctggttatttcctctgtccagtaaaagagggtgcaagcaaatatggttttcttttgatacctagttgcaataatcagttagaaaaagaatcaactataggattccttcaacctaaaatatagatacttgtagcgcttggattttgttccaaaatacgtactcctcacgtcaaccaatcacaaccatctctcacttaaattcttaacatattttctcatcccaattaatcataaatatcgctcatttaatttcgaccatctccgtaagtcagtttgagataactgaaattgatggatggatagattatttgattttttttaatagctatttaagagtataaatgaatgagttaactcctacaaagtaaaaaaaagttattctagaaaagtattccaagaaaaaaaatataaagattttctttatgaaatgcatttagaagcttgggaaatgtacagatgaaaatccaaaatattgacttagaaaagaaagtggccttgatctctgcgaaaaactttagaaatacttgtattttgggatgtaacacaactttagaaagtggttttttctagtagttttggttttcctaggactaaatatccactcgattatgaaaattgtgaaaagtaaagtggacataaagagagagtttaattactgtttaggttcaaaatttggaatgaaaaaacaatgagggacaattctggaaattttgatttttttaaaaaaataaatttaagcaattatcttttgctaagtttgaacaaatagtttgctaaattgagacaaatacagcattttctggctaactacatataacacatcataccggtcccagccggtaaacccgaaatttcagaaactcagtgcagcaagatcagtgaccgagacaattagctccaatcattgagagacccaggtcatgcacttgtaaaccagcttaacgctcaccaaatgatgtcaattaagccagcaaggaccttaaattggctccaacctaaaccgcagagacagtggctcaagaacacccaagagaaagactgaaagagacgagcaccaagacggaagaggatgacaaagagcccaattattgggacacttaggtggacggtatgaatccaagggaactagtagacttgaagatatgtattcatgtcagcgtcggaatggatggccgtccccttcaaattcgatgcacattgtggtagtgaacggggtaacgatcatcatggggccctatattttgatgggatgttaattcctcgtgaatttatagcttgttatggtttacctggtgagtggtgaattggaattttattttagtggtgaattggaattttattttgcaggtttagcttgttgatcgcttaggatcagtgacagatccaagatttttttgagcctgaatttctataacgactgtttgatgagaaaatgtcatattcaatttatacagaaattattattgattgttccctcacgagaccgggtagccatccaaaatcgtggggcggtaattcctcccctatatatgtttcactacgattctctcgtcaatattataattctatcatcaattttatgggattaaatttagtttttttaacctgtgtatacatttgcccttgtcatgtgcaatgttgtgatccattaagatcatatcaatccttgtcaggaatcacgttgcagtgtccctatgatcccttgtcccttcgttgctgtgctatgagaaagagagttgccatctcgcaaagaccatcgtcttacctcagttctgaaaggaggtgcggatccaaatcagcttttgtaactgagaaaaagttcatcaacgatcaatttgtccttagttttgccttagacagcattagggtaactggacctaccgcggtacactccaagaatccatccaatgtttcgtaagggtgtgtatatatattccatggaaaacctagactttgcttcaaacaaaactatatccaattatcatagagtctgcagctcaatccatccatcttttgcaatggataataatatatattacctctgtcctaaaatgtaataatctaagatgggtttaggtctaataacatcctagactacgtatcttattctagattgctacatttttttgacagatggagtacatggtataaacccaaaacaccgatttaccataataatgtatttttggaattcagggatgattttacaaggatttcatcagaattagtttgttttccgaaggaatcaggggagaaatactcaccattcaagattttgagatgaaggtattttctgtatttcataaagaaaaagaatgccagatcagaaatcatgcctagagcatcgggcgagagagagagagagagagagagagatcatacctagaggtacgggtgtgtctagggcggcgaaatttcgccatgccgaccatgccatctgcacccatgttgaaccatgatcatgtgcgccacatccc

SEQ ID NO: 67567 - DNA, 1313 bp, Oryza sativa
ccaaatctcaatagctgctggttgctagtactaataagctctaataactatgggtttgagccatggatctggatcgaggagctgatgaacaaaagagaaggtaaaaaaaagaaaaaaaaactaacctgacaaatatatatgtgtttataagcagtacaaactcatgtgtcactcgagtgtatagacatgccccagatccatggctcacacggctttacagtaacagatgatgcagcaccaccgggaaggtatgtatggttttttatatgtcaccccgtttgtttcacttcttcctcggcttggcgcggcgcgacgtcgccgacgacgacgagccggagccggagaagatggagcagaggatgcagccggacaccctcggcgacggcgggtcgacgtccggggcgatgtccttggtcctgaacacctgctggctgcggttgtcgtcctccttctgaccgtccttcttcttcttcttcttcttcttcctctgctgcttcgtcgtcttctcgctgtcgtcgccgtcgtcggcagcgacacggcgcatcatgccgatgctcccgacgctcttggaatgccggagctccggctggggctcctccgtgccgccaccgccatcgccatcgccggccttggccgcctctgcgtcctcggtcaagaaccgctcgtcccagaccaggcctgacgaaccggaccttctgaatgttgtcgctgatctttgcaagccagccatcatctgcaccaccaaaaccaccactcctctctgcaaaaaaagaggaagcaacttatctgcaattgtggagaacaagaggtgaggatgaactgaacggtgtgttctcttcttctcctggggttgggttgattgcctctgcaggcttccaatgtgtgtatatatgtgaactgaaaagagacagccattaatgtacagacagaagagcagtcaacagccggtgccattggaaaggtaccaggggctgtcttccattaactaactaggttaagcagggattagtttatcaacaacaggtagaagaacagtacggtaaaactcaacagattaaactatgcacctttctggtctaaaccccatgcctctggttttacttttccatcacaagcatgtggaagaggagaatccaatccaagtgtgctgaagaagttcgaccattaccaccataaaaagaggacaatttgctgagagcaacaagaccctgcatgcataaattcttttggcaatttgtgcacattactgtgtgaaaaagattgtccatgatatgtcaacacaaaaggatccatagaaaaaatatctaaattgt

SEQ ID NO: 67568 - DNA, 3580 bp, Oryza sativa
attatgtaggcatataattttacatatttcacaaaagttttgaataagacggtcggtcaaacatgtactaaaaagtcaacggtgtcaaacatttcgaaacggagggagtattttggaacggagggagtatcatctaaaacaaaggtacaatgcatcgatcatgattttaactcagtggtgacaggtgaattttaggtgcagaataaatatctaatgtatatgtaaatcaccaacatctgtttactccctctaatttttagtatatctctaatgattgaatcacacatgcccccacaggtctttctcattccttccaacctcactatctctgtgttgcagccttgcaggtccccagatgctacctccctcccctgtttccacatagtttccttctgatgaactccgaaatttctccatctgccccagtaatccacagtacatggcaacaatttcatattacataatagaaatcatcatagagttgcaaagttttgaaagactgataaatatagattggtgttcctaaagaagtgacaatatatctaccctgtagatatacctaatcttctgtgtcactcacacatgagcctctcatgatgacatgaccaacgcaaagagctgagctgaccacaagcccaaactactcacattgaaaatagcaacacgatttcgattaaagtaaggcaaagcatgggtttgatctaatagagtactaaaagtcacctatcgtggaccacaaacattcaactcaaaaatgtgaacgttaaaacatttaacacaatcgtgtcagctactctgtcgctgccttcccaaacttactggcatacaacttcatcttaaatccctacacttagggtgagtttgaggagaagtggattgagaagattcggaagatacgcaaaataagatgagccattagcgcatgattaactgagtattaactattttaaattttaaaaatagattaatatgattttttaaagcaactttcctatagaaaatttttgcaaaaaatgcaccggttagtagtttgggaagtgtgcgcgcggaatacaatgggctttctcacccaatcccccaggaaccaacgcacccttaatacttctggcataaaagaaaaacatatacgggattactgggcacatatcccaaaaaaccagactagagaaaagattatgtgaaacgccttgcttccaataagaaaaccaatctaagcaagaacaagacagaatctattgtgacatttatcattcagaaaatcaagatctggtcaacagaacccaagccgactttcactgaagctaatagtcaaaatggtggtccagagtgcaacaaataaaattatcaaagtggcaattaagagttgtacctgtcacattggttgatatgggagtactaatataaaacatactccatattgggcttgcagaaattcttctacttcaaaaattcaaatttagaatttgcaaatagttcaaagaggaaaccatcatacatgctaatttgaagtaattatcaactagctatggtctcagatagggatctcttgaatgcaactcgatggtcaggtaccccatcctgttcccttctatcctcaaaccacttaacaatggtcttccgtggaaggcttgtcacttgaactatgctgctgatcattgtattctggatccaatgcaagaacaaacataaaatttaagcaatgaagtgaaatgtactccactgaatgaaaaggatgatcatagtggaaaattcacttactgtagggcgtttggttcgggagtagactctttctaatgtctccagttgcaccttttttaatcttttctgtgaagaccattctgcgcacatgacatgaacaggaagttccgtctgtggcttggtttcagtgacatcagcgttatcaactactggagagggctctatttccttgatttcaggtttagaagggtcttcatcaggcaaagaatcagacatgaatagaagttttggaggtggatttcggagcaattcaatgaccaaagtcctatccaggcctagttcccctgcaagattgctttatctgcaatggaaacaattcatataagacaacagaaaaaaaaaccttcgataatttaaagtttggatatatacctattactactataaaggaacgcttcctacaaacagaaactaacagatttcagaaatggaaattaattagaatccaagtggatatttatctactcacactagttttacggcgacctattttgagagcacgagccagcctcttaagttgccagtttttcagctctggccgtttgatttcatccgttttttcatcattcccataagcctcagagcctaatgacgaaccctctccagattcatcagcatcagcaatatccccgattgcctctgccaactcctgctcaaatcttgccatatcttcttctgaaattccatcgtcatcatcctcaacagacaaatcatcattcttgagatcttcttccaactgcttaaaaagtgcttccagcgcgtcgtcatcgtcttcaccaccaccgccaatatcatcctctactacaacctcctcattctggattttattctggaatacataacattttatcaacaacccttccagccacagcttacgtgagggaacatttaggggacagacacataaatctcaaacacatccgagataaagatatgcatgcaacaaacaaaaaaaaaaatcgataatattctccaactacagaataagataaggtcagtacgataaggaaaacactataaacgattctgcaactcctctcgatgagtaggtgtaaaacgcaacaaattcagcaattcaccaacccgaatttccagtcgctcgcagggcgccatctcatctacactactctatctacatctacagtaaaaaaaaaagaagaagaagaggggtttagaggaggaagcagtgactgcgaggtgaccttgtacttggagggcctccggcgaagggcgcaggcgacgccccgcggcgagcggcggaggagcggccgtgccaggaacactcgcgcccctggcgcggcggcggccgcggccacggcgagcggcgcccccaccatcgccgccatttccgcgagctctctcttcggatattttcgctcccacctctgccctcctctccgtgggatttttggtttcgcagagtccagaatccaaatgggccgtctctcttcgtctgggcccattttgtcctcagttctagcccataaataaaataaaataagttcactttcggtttctctatttttacgtcgagttttcacttttgcatggtgttcttttgtccgaagatgaagattaagattaagttttttatgtaaaatgagatggtattaacatatgattgattgagttttaattattacaaacttgaaaaatatattaatatgatattttagagcaactttcatatagaaagtttttgcacgaaacgcaccgcgtgccacgaaaatcttaatcttaatccaactcttgttggagaaaagaacatgactgcaataccggattatccaatgtccgagggacgcacccgtgcttcgccact

SEQ ID NO: 67569 - DNA, 19969 bp, Oryza sativa
tggggcccatctagcagtaggagtgggtagttagccgaaccggtcagagacgcgtcaagaagacgacgccaacgcggcggcggcggcggcggcgaagaggaaggcgaggagctcgtcgtcgccggcacgcgcgcagcgcagcgcagggtcgccgacttgcgtgttgcggtcgcctcgcctcgccgccccgcgctgttgatcggtcggcgaggacaggaggcgccgaggcgggggtgatgcggcggtcgtcgagcggggcgcgcgtgtcgtcggagggcggcagcggcggcggcggagagatcgaaggagtggggctgccgacgtgcgacccgcagtcggcggcggggcggagggaggcggcgcgggcgcgggcgctgcagcgcgccgtgcactgcatcccgctcgtgctgatcctctgcgccctcctcctctggctctccgcctcttgagcctcttcggtgagcaccaactaatctccatatctctctctctatgtcgatggcgagatgctaattagctcagtaggatagcgatcgtcgcggcgtgagcatgatctgatcgaatcttgcccccatttcttggaaaaagtgcgcttcttgtctgtatgatctatttacgaatcacatcccagcatcaagttgaaaatttttgagcaacgatccgaaatggtttcaggaaaatgcttaataatcccaacaatatcaagactggtatcgtctcactgcaatctgtaactctctactcctcttgtttcttcttgcttgcttgtaaatttcgttgctgaatttgcttttttttgggatgtttccgcaatcctcgtcagtacaagcagactaatatattcccttgggtgcatcaattttgttcctttctcctttgagatcgtttgatttcccgtcaggattagcccttttccttcttgctcagtccgatcttagcgaaaataactgatttgcagatctgcactagaattaattcaagaggaaagacgaatggtctggtggtgaggaggttgtttaacagtttaagctcccgaccactcgagttattggatattggggatgattggcatgctactatggcagtccatcccctctaatgtgagtgctagaactcctgtttcaaaaagaaattcatgaaatatagttgcttcagcacttcttttgcaaaatgtttctttacctttggtgaaatggaagtacggcaaaaacaagaagacataaactgatagtcttaactagttgccaatcataaaaaatcctgttagttacatgcaagcttttgttgcttatgaggaagagatgttggaggatctgggttagagaaagattgatccttgtttatggtaatcaacctccaaccttccttcctgtctctttgagtttgctttatccttagtgtgcgtgcgtccgatttgtactcgcaaaagagaaacaaccataaattagtataagctatatttatattttgtaaagaaataatgggacagattggttcaaccagtagggtaaacttttattgatgaaataattgacattgtttgagagaaattgacagctgattacatgtgatgtgataggaatataatatacacaatggtcgaacttgaaaagaactttagcatgcaatggggatcatctccagcatccgatgctaaagatgcttccctgaggctcctaaagtctttcactcctcataaatggattttctccactttgcagtttcaacgcttgtttttgcatcctggagttctgtcacatacatatatatcttttttttattcgatcagttatcgctgtagaaaatatgctctgttgtgacatcgcagtgcaacatgggatgttatgcacttgtcctcagagcagtccctttgtatgccaccactactaaaccacatcaatttctttgctatggttactctacctcgtgaccgatgaaccaattttttatagcaatcatcagttgattaagaagtgtgacaccagatcgaaatgtgctttcaactgcaatacacataaactgattttgcaatgacttggcaatctaggccttcttatatatttgattgctcattgtagatagggtccttccccttaaggcctcactgttggggcataagctccctctttctacccatatatgcaaggcacctctctaccctgtgttttagcttgcacccgtcattgtgattttgcataaatatggttatgtttgctttcgcacccaaatgctttctgacgtcaatgatttttctgatgtatgcagattgataaccaatgggtgtttcaagtggatctgacgccacaatgtagagtttatagagaaaacaaaatacaagtgaactagatcaggcatgatcaagtaaaacacagagacattaagttacaaaaagattaccacagcaagaagctcatctactacagttatatttttttggtttcccctgaaaagggtagctgttttcggtatagatattctttgaactttagattggagatgagatgatttggcgaccattacagtttgtatacaaaggaagtgtgtactcttttcctacactaagcatgtataatacttacatctgatgctattcttccaaattctatacacatgaatatgtgatttcgctggcagctaatttgctgaggttttagcagctgtgcttgtttgttgtctaaatcgatgtgaagtttttctgtagcctaagccttttctggtctagggtctgttgtaaaactttctctccttcttaatacaaaacttggccggtttcttttgctggcccggcgaaaaagagaacatgtgatttctttgcttgcctccagtttgtgttgtgcatatacctctgttgtaagttatccttttattctgtgcttcgattgcatcccccggtgtataaagggtcaaatgatagttcatacaagtaaatatatatgattacatttataatatttagatccatgattacattgataattttacatgattacattacaatccatgattacattgatagtatttagatgaataatttttttcttgttttaaagtaaatataaaattttaatccactgtaatttaacttacaaactctagatccagcactagctgtgccagacaagaagttaaagccaaactccattccatggcaattcgtttgtcgtaatcgtagccatttcgacaaaaaaatgtctaaccataatttgttttggtcgattttgacacccagaaaccaaattcttgtggatgtcaatggcagaccgaactgtcactgtttcactatcgcaacaaccatattattaataatattatcatacgttatcacaaaaggtatccatctattacaccagaaaagtatgatctatccagtgagataggcttttggatggttactatataatctgcaactctgcacacacggccacaaacacaaaagctcaattcagaaaaagaaaattgaaaccatgcaaattctggcgaaagaaatttcatgtgtcctaataaacgcaacaaaaatccgagatgtctcttttaaaatttggccaggccaatgggagccacccgttgcatccgaccaaacaaggcttgaaagccaagtgctgaggaatgttgtaccctttgtgtccaactcatactatctcgaattaatctagtttttgttggttgattaatctgtaaaaaaaacttatctttgtgcagtttttattgtttttctttgttggtcatccactcgtcctttcctgcaccgcaaggaatatgaaagccaagtgatgaagcaaagcaaaactgacggtttgctcctaaacttgactgccaagccagaagcaacccaacgaatgaattctaggagtacaatttatgcgctaaaccttggctactatttaagctagaaattttttttaaaaaaactctcagcaaaggaagcattggagttacaatcgtagagtagttgatgcataactatacttacaatctgtaaaaattatagtgaatataattatacacatataattatacactcgtacagcaaaagtgcgactatggtgcgtatctgtattttctaaaaatcaaaaagttatatacttgcactcaatttgatataaaaaatgctagcatgaatgagttgccaacgcaccaaaacttttattcaacacccctatatttattataataattcatttgcaaaactataatatttaccgaaatagacattaaagatatagtacctgatcagtaacatgcctatttcatttattgtaggtagtgacgtagttttcggtgacaagctcacacatacgtaaaagctaagtttacaactcatcattctattttagattttcaacaaaccattaaaaaaatatgctatggatgatttatgaccattcctcaggtatcaaagaaatgttatatacatttatattttgaatgcctatttaacaaatacctaattaaaagatgaataacataactataaattccttaatatcataccaataatgtcaatattacatttctcgacgatcagtcacatatcaacaaatattctctcagtactttaaaagtataaaaacaaacaaaatgaccacaaaaccccatcggtcaccgacccttctccgaacaggaaaagaaatcggcttgcaacagcaaaaaaaaaccgacagccagccagtcaccgactctcaccggtggcagcatcgccaccaagaaccctatcctccgctggccatccgatctcgatcggacggccagcagctgccgcgctccagcgccgttccgatccgacggccgagatcccacgcgatcccatcccaccctcacatataaccgcggccgcatcacggattaatagcgagtttaatcacaagaagaagaagagagagaaaaaaagagagagaagaaatcacaccgcattagcagcagcaaaagatttcctcgtttcgcttcacgaatttttgttgccctcgcccaatccacagcgcgaggagagggagttctcgcggcgatttctcgtcgcccctctcggccgctgccgggatcgcagctcgcaaggttcgtgaccccttccgattttgtgttcattttcttttctttttttctcttttttggtgttgttcctgtgcgggaattggggaggaaaaggggaggggagaaggggtggagccgcggtgaaattttggggggtggtgattgatatgctctactgtttgctttggtcccgattgaccagttcaaatgttcttgctttggtcggtgctcgggtttgatttgacgcttggtttagatcgtcttggtgcgcgtggtctggtatcgtcgtggcgctgttcttgcgcctcttgtgttgtgattgctgttgtttttctttttggggggaatcgcttggttggagttcgtagtttgttagagttgctgttttgggggtggtgtatttctcttatttttgtttggtttgttcgatttccgggcgggatagttgttctgattttgctgcaatctgccgcaaaatcgctgttgctgaggtgatggatggtccgtgcggttatttcgatcggcctatgtgatccattgcgagttttgttcttgtaatagatcgatagacccgtatgctccggatgtaatgcttccgatttccacaacctaaattgcgttaagtagtgatctatatagggcaatagtcaaaacaatttattgattcacgaatccttgttcatagcatatttcagatttcgcattgcaatctgttgtgattttagcaatgttataaactaggatacgtttttttctgtgtaatctgcattagaccttgtagaagttgaaaaaaaaattgtattgtgattcatcccgtaatccactttgctagattattgattattactgttctttttttttgtttgtgccagttttggaaaggaaacaggttgatgaagttggtcaaagggagcaaggtggaggtgttgcaggaagcggaggtgcccctaggttcttggaggggtgctgagattgtattaggcaatgggcagagcttctatgtgagatatgatccttctccagttgactcttgcgccgctgtcgagagggtgcagagaaggttgataaggccttgcccccctcgagacgattcagtatgctgggctgtgggcgacatccttgaggcctttgatagctactcatggaagattgctgagatggtgagagtgcttggcaaggatttctatctcgtcaggctcctcggatcttcgctggagctgagaacacatgcgtcggaacttcggttgaggaagcattggaaagatggcaaatggactgttcttcagaaggtaatggtccattccttcaaattcatgatatggaattattcatgattagttttttttactgaaaagtagaataagctactttatttccttaagttgaataaatcagctggcagattgccactgtcttatcttcagcaaatctgttattgaaaattcgattttaatgtatcgataaaacatcctaatgacttgtctccaattgatttcaggattctacaaagtgcttcggtggttcattcagaggtcaaccaaaatctggaaatcttggaagcaattttggcaagcaaaggcagccatattgtgcaatggacaacaatcttctactgaagaaccaaaaagctttggagggtgataagtctagaggcatgaagagaaaatcatctgctattacacacccaacccagtgcagtgaagtgactagaggcatgaagagattacagacaccccatagagatggaaggcacgcagcgctggttgctggagtttctcctcgtttggctgaaaaggtagatgctgttgattccccatgcttaatgctgggtgaaaaatacatgcatgcttccttaaataagagaaaaaatggtgttcatacaactaacttggctggggtaaatgtggatactgaaaataaattccgtcctttaacaagtgcttatcctagtgacaccgagagtatctcatcctctgttggtagttgtagtccaagcagtagtccctgtagttcacgacacttttactcagcctaccaaactggtgatatctgtagtagaactgatggtgctgaagctgccgtatctgaaagagaaacatctcaacatgataagattataccaaaggaagatacccatttgctggagttgcatgcttatcgtgcaacaatgttggcattgtatgtttgtgggtcaattagctgggagcaggaggctttgttgactaatctaaggcttacactgaacatatcaactgatgaacatctagctgagttgaggagtatggtttcctcggctattacttctagatagcagttgtagttacttgcttggtgacttttatgacatctttgttgtcttgaaatcattgtaagttgggaaatcccattaagtatgaggtatttgagtagttgatgttctgtattacctgttaaaagagttacctagtcagatcatttttgtaccatagaccttccaagaaacatgaaattttgctacattttctcaaacaattactgttcttcacttattcacactgaagtttgtagctttacattgcttatatgttgcttgtgatcatctgattgaattttacagtactatgatcaaactctgctttcatttcagtggtacaatatgaaagtgaggtctacgttagtgaagtccagttgtatatatttgagcctttatgctgccaatgattttacttacccgggctacttgatccattgtttttttattattcaacattgttagatgtcatgaacatttgtgcaggacctatcatggtgagaaccccattattaagaaaaaaactgttgagcagcgagtaatattcgtatgttatgttcagatgccattttcttgtctagatagttaactgaccttacaaattgcaaatgcatctttgtactcgggaaattaccactcaaggattgttcttggcaaagtctgcaatgagaaaagttggaaaatggaaatctgatacttatcatgaattttccagggccgaagtcggaggcttgtaaagcatccttctgtaggtccatgtcgatggaggagtctgccacatggtttgctgtatgttaaatgtggcaacattccatcgaacttctgttggtaccttgtttgtttttgttattccttttgctttagtattatcttttctgctgccttttcttgtgattggccactaaatttctcgagaacattatgaagtgcataatttccataagtttacaccacattcatagaaaataaacaaaagtacatggtaggcacatctggatcaattaccactaaaaaaaggaagatgaacttattttcatattgacatattttgatatatttttttctctttagaatgtgaggcaactgagaggagtacctgcagattttgcatgacatggtaaatagtgtttacaattggtaagtttaaatttgtaggtcagtaatgataatacaattataaacatcgtagttctaaccatgtgatttttaacacctatttgcaatatgcacattaccctttgttaccaaaaacagaaattacagagggatcttcaatctgaatatgacctgcaaagactttgtaagaggccttatttcaaggtatatatggtgactactgaattaatgtatgcaccatggcattgttgatcactgaggcatctagctggcttgttgaattccatcacaagtcactccttagtgcatgacttattatagttgactcacatggttgcttagtgttgtttgaatgagttttaccatctaatatttctacatatggatgcacaaatattgtattagacatatggatgcttcccacagtgctctatcgttgtttcatgatatcctaggaagctcaatttctatgttcagaagagtgtgatgctgaattgtttttgcttaggagagagtgtgcagtcagctcaactttcctatgcagataagttgtttgcagtatgaaaagcagggaaaatttccaaaagattactggtggtgtcactttgtcaacaacaactacttgtgttactggtggtcaataccctcaagaactcacgtgagtttgctaagttgaggacctgcaactgacttccaatttaaacagaagttaaggtaggcaggcgcaccttgcaattcgcagcagcaagtcaggtgaggatgcaccatattgtttgcctcacctgtactcgtatctgcaaaatataatttacctcttttaatgttcatctggaaaattactctttaattcagatgcttcacaaggactcaggaggttctcacgcaaaacgtgtgtcatggtgtttgtgtgtcaatcattatttgtttttaattgcaagcatttcaagtggcttgtttggcagcaaagtgttacaatttattagagtacaattaattatgtcctgaattaatgatcaaagtacgagacacgcactgaaaaaggctagagagttcttggccgtcttctgttctgtgattgtggcatcttgcatgcagctggtatactttgatggctcctagctgcaattctttaagttgtagtacagtgtaatatgccattacttgttccggatgtactgaaagatgtaaagttgctagatctgcattgctacgaataatttgttcaggttgcacgcatttgacaagttcccttttcagaagaagcattatatggtgcacctggtgttttcagatgagcaagtgagaaacctccgttgaagccaactgcaagcaaagaatatatggaacatgtcctttgtctcattagtttgtattaaaccgatggtgatgcattccttttaattccataaaaatatatgatgtgtttgttattgaactgtgtaataatacagacaaatgtctgttcaaataaagagtcactcttttattctctcacttgtggataatactgcatatcaaagttttaggcaggtctgatagcccacccggattgggccatcaggcctaatggtagcgcaactgggctgttcattgctttagtttttaccttttaggaaaaagtacattgaaaggcctcttgtcaccgcattacaaaatcgtccttacgacgcatgtgggcccccacataagcctcatcatttttttagttactatttagtgaaactgacgtgtgggtctaacttttttttttattttttttcggatcaaatcgctacttaagcgccacatcggatggagactagtcaattgagccacataggcgccacgttagttaaaaccagggataataccaccaaggaacctaattcgcactggttctgtaagttgatggatgcgttatattcggttttgcggtttaaggacgattttgtaattcggtgacaagataagggacctccggtgtactttttgctactttttactgctgaaattatcctgtcgatatcgattggattgaaaattcagaattaggccctgaatacatcatattccagcattctaattgttctcaaatgaatgtttttttctatgttttttatgtggcatcttccaattctttggcgacgtgtatccttctagatacttccaaaaacatactacctacatccctcaatgtttgcgaaggttcatctcgttctgacatagtggtgaaatctgaaactctgtcatcaggtttgaagttttgaactcaccgagtgatttcagaggctttttcttagaggaagtttgtaaagcatggtcttcgttggttagatcgcctccaaaatttcccagtcataatctttagactattaatagaaaaaaaatatttgtgtttctacagaatattttcgcctcgtgaagcacatgagaaagagggccaataatgttccatttctgaagaatggcaagtttcttcaaacaaaaaaaaaaaacttctttccggttaagtgatgatgatctagttgacgcattggttcagagaaaataccgtgtgttgtttgatgtgctctgcattgggtatcaacatcatgaaacggaatcatccacagaagcagagcagagaatcagagagtacaaacggatcatcaggcgacgcagacactttcaggtttccactcaaggcaagcaacatgtactacaatgttctccatttccgcataaaaaagtccaaaaacgatttcaaggacagcagaggccggccatccatcctgtcctggcaagattctgcaagaaagaatcaatgaagccaagccaagccactgcttttatcagcttatggggctcgtggattctccacgccaaggtgttcgagcaaatgccccaacgaacgaggctctggggccatgcccatgccaggcgggcgcgcgacagcagctcgaccggcgaccggctggccttcccccccggggaccagcggcgacggcgacggcgagacgacgacccaccctgcaatcgatgcctccccctgtacgccgctgccgcgaccagctcaacgaacactggcagtcagccactgctgctgctgctgctgctgtcgctgtagtgaatgtttatgctgcatttgcagtgcatgggcatgagagatggagccatggctgacgacgacgatgatcctgagcactggaacaaaagcgtaccagacgctgcctctgcctgcattgatgctgcgagatcgatgatgcagtgatccagtatgctctgccaccaccactgcatgattgtgtgtgggctgatcagctgatgcttggttgcattacatgctagttaagttgcatacttttgccgggccggccaagaaaggccaaccaaatttacctaagattgaaaaatatatacaaatatacaaagttataacttcaacgagaagctgtcgaactaatggaagttgtcaccggagcaacttcccaaaagcaaaagattacactaaaagactactctcctatatttatgaaaatcccagcttctttccaaatcgccacttcctttttgattgaaccaaataggaaaccggctgagcgccgctggttctgaaacacacgcgcattcaaatgatcgtcatcattcaaatgatcgtatcaaagagcaatactttccgtttatccaaagcaaattaaaacgtgagaaatgctcaagggtcttccagttagtttcataaggtgatgggctagccgacctgagttagaagtctcatcatttctatttatttgatattacagtagatcattccctaatattcacgtttttagcaaattaaaacgtgatatggcatttgacaagtaaacgcagccaaatggcaagcaaagctaagctacttcctactacgtatctactactaggctgagatgccaacaacgagcagcaactggaccaaactcgtgctgagatgatctgctgcgtgtagctttcgtcgccacactcacaatgacaggttatactcgcccatttttgagcagttgcttctgtttcctagtccttatctctcgtcatgtcggtcatttgatgatggctgcgttggatatagcccaagaacatgtctagtgtaggctgtgacacttggcatctctcacctatagctagccattagattaatgatgattagtaattgccttaatttcagtgttagttttgggcttttggcacctttggtacactattatatctctcactactgaagttctactttgagatttgtactccctccatactcataaaaaaagtcgtttatgacaatatttaagtcaaaccttaaaaatataaatcattaataactctcaagttgttgagtttgaaaatgtaaaaattatatgtatagatttgtcttgaaaaatactttcataaaagtatacatatatcacttttcaataaatatttttatataaacaagaagtcaaagttgtgttttggagaccgtgttgctgttctaaacgactttctttacgagtatggagggagtaagttgttagtagtaagtagtaagtttacgatgaagatggctagctactgacaatgcaggttagttgcagtactgctcatctgtaacagagtagttccattgaaaattaatcagaagtttttgagtttctccatgctccgatcttgtgtagtaactcagtaactcactgtacatagtgcatgacttggattagctcagaatataatacatgccctctcattaatttcttgtcaagacacagcatgtgttctttagggacagattagcaagaatctatagcaactgaaggcactagctagcctaccaagctagggtagtaataaacaacttagttagcatacagatgtgcatttaatcaattaagcaaggttagtactagctttctaattgtgcatgtgccctattaactgcatcttgtatcacaagtcctagttgcatgtgctgcattagttaagacttgaaagtaaaactttatccatgaggaatcaaataatggtactcagggcttattcagtttgttgcctaatcaacctattaaaatttggcacatttggtttccttaccaagtttgagtagtgttttttaagagagaacttttggaactaccaaattttagtatggtagtaagagtatgtttcatttgttaccctactaaaatttggtagagttgaaaatggcaacaaactaaacatgcccttacatgtagtttatacaagagttactgtgtcacactctccttcaatgctcaagaaagtgcatggtacaacactccatgaggtctcggattcatccgtatcatccacaattgtaggcatgtgcatatgatggtgtatatgcatacatgtctaccttacaatacaattaaaaagaatataaaagctacgatcgatcttagttttgtcggttaatccatgccagctagcttgatctaagcacattttagtattttggcgccaatatttactagttctagtctcattatattttggagatgcattcatgtcatgtgctgatcatgcagcagagtgtcagttaagtagtgctaaccaaattgtccttggtcttcatgtgctaattaagcttagcttaacctctccagccatcatctatttcatcattaactatagcttccctagtggataattgaggtgacacctgtctattacatccctaatgattgcatcattggtttgtttcactgatgattgcgttggaattcagcagtcagaagcaagcgatgatgcgtaagacaaccaactccttaattgcacatgatgctgtgccacatttttctcataagagtcatactcatgatgctgcaggatgatgatgatcagcaggcacaagggcatggagaacgatgcttgagaagcactagtttagtacaagatttttgtcttgtcttcagttatagctcaatccagcttcaaagatgtgtgagtgcaacatcatactgtgatacaattcaaggggttctgcatgctgttttttttttgttgttgttttttcattcagtctagttttcagagttgtgcagtactactgctgtttattcatgagagttaggtctaccactgttcctgctttatgttcttgtcgtgttcaatgcaaacctaaaaagaaattaggagcggaattgtgaccagcgaacaagaatttcaatcatgcaacgttagcatcaatcatattaactccactctgctgccttaggctgatctctcaaacaaacaaacaaacaaacaagatgtgtccctagcataacattgcttgttggctggtgatgatgcagatattgcttgagacatcaggatcagatggtgagcactgaacaaagaggataagtgctgctggtgcctgcctgcaaggagccaaagggacctcttgcttcctacctgccaatcacttcttccctagctctctctcaatactttggatctgaagcatcaaaacaatctagctcattgtctgaacagcagcacatcaaaactgcacctgctactacactactactccatttgttactacttcacacctgtctctacaaaggtaaacatgccatgttttggccataaatttgctgttccttaaagcaaaggtgagaagtagtaggctaccaatcctaggaaaatgagatgaacactttcagactactgttcagatcaaaccaaggttcatggacctaaaacccattgatctactacatgatgcttattaattaattaatactcgaggaattgagaacaaaataatgcactgcagaaattgagccacatgggctcctctcccccctctattttatgcataggaacaactgtttgcagagacttgcagcaattactgcacacatgtaggaaacaacaaagaatatatcccgttttctactgtaccacatgcctctccagggggaccagaattaaaatcacacatgacaaagaacacaattgcccatctcatgcatcccatcttcatcctcatctcatgacacaccttggctagctgctgcactggaacgaaacggcttctgaagttctcttgctgtgctgcctgcatttgcagcaagtcacattccattgcagaggatgcttttgcatgggctttgtcagatgatcaagaagaggttttcaaggctgcaatgctcctgcccatcaattgttgatgctctgatggaccagtgattttttttcccctcaactctgaagactggaccagtaaggatgtctgcacttgtttacatatggatgtaactgagtggcttctatacttcaccggctgggtgtagataatgacggccactgctatcttgggaccgttcatcttttagcaacctacgtatcgacggaaaagtagccatcctgttgctagatgcagctatcttcctaggttaaggtcccttaatagtaattaaataatgcacatacaccctgtgttttcaattattaacagtgtgtaattccctgtattccatttatagtgtgcttttagaagtacatgccaagcatctataaatcatatacttcctccgtttcacaatgtaagactttctagcattgcccatattcatataaatgttaatgaatccagacatatatatgcgtttagattcattaacatctatatgaaaatatgggtaatgctagaaagtcttatattatgaaacggagagagtactgcacatccaatttacaaatacttgtcatttttaacacgaacgatatcaaacttttaaattttttaactataaataaattttgaaatatttaatttagccaaatgtagtactataatgaaattatacatttgttgatattttctaaatatatatagcaatagaaatagtggtcaaagttattttttacattgtctaaaacgataagtatttataaaattaacaacaagtttttctttaaccatgtatatatatatatatatatatatatatattcactataactaagaattggtcaggagcttcaatttgatatccatagaaaccgagagagataatcttgcttcactttaagatttaaaccctcatggatagagaattaaatttgaaaatatattggtcattcatttttctctcagaaatatctgagatgcaatttagttggtagaaacataccaccgatatcgttgaactgttgcacgaaaatgatgagggcgtgacaatgtgggtggtctcgcgtggcgacagagcgagggtagaatactagatgcctgggaccacgttactattgtttatttctcctccttcatattgacatttttttttgtttctaccaataaatgatgagctacaaaagaattttttttatcacaagtgattactctttttttttccattttaaagagtggcattcgatgtccaatgtcttaatcgaagtatggatgtcagaataaatagaataatgataaatggaaaaaagagaaaaatcctttaattgtataaggggcggatgtagccaagtggattgtgaatccaccatgtgcgggttcacttcccatcgttcgctcatcccaatattgcaaatcctaaaatgcagttttccatattcctagttacgtatttaaaccagcgagaccgatcagcatgccaattcaaatggactaattagttaattgctaatcactaattaatcaatttccaaaacgctgtcgcttttggtctcgcacctcgccacgcgagatcgaccacgtcgtcacgctctcgtcatttttacataacggttcagcgatatctgactatatttctatcaactaaatcgcatctagatatttctgagaaaaaaaaatgaatgagcagtttcaaatttaattccatggatgtgtaatctccccatacggggaagcaacctgtctaaaagataggtaatctccccctttccacctttccagaagcggtgagtggtagttcttgtttggtgtagaccacgtcctttgacaagtgcagcttaaactaaagccagagatgttaccctcacgcactcaccatcaaagagaacacacttgcaagatctttgcgcctaaaaacatggacacacatacacacatatcataatcaaccttgcaatattacggcgcctaaacatcaacggtttgtcacaccaaaacgcatgagatattccatcgcgcgtgcactagattatttctgcgtggtgcagcaccataaaaactgatcaattctttttccctttctctgatcgtgtccagtttcatctttctgaaacgtactttgaccgcaccagctgctgggacagtgactcacgagtggcacgactcgagagtagctgacagagccaagcaatattgatttcgataccgttgacgtcgttgcatatgcaaatagtacgtcttcttgacatgtcttttgacgtcctgtttcattggttttgctgtcgcgtgttagtaaacagaaacctccaaacgtgtgtaaaaatttctcgcccccgataacacggtaaagcttccatccatgtaaaaaatcaaccaaggaaagagtaaatttttgttctctctgcatggcaggaataattgttactactggtaactgtatattgtgcaatggtgggtccataattttttttttaaagcctggacaacggtcactataaccattgtcgggaagtacctatacatctttcgaaaaatttttatgacacagatttttaatctttgaattaaaatccgatagatataataaaaagcaaaaagcaattaagaaacaccataatggacactaaattaccatatcctcaagaaaaagaccaaatccaatacaaaatttaaaatttacatgcgaagattcaaaaattatagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgctattgtcgatattgatagatactggtgacacgatatgtctggccttttaatccgcacaggtaattaagcccagacggctaccgtctctatttttaaataaaccaaaacgatttatttgaaaatataaattaatttttaggtaaaattttatatgtgttcatatcgacttaaatgccaatactaaaagaaaactatattgaaaatatcttaaaattaactttaaaattaagattgaaaatttaaattttaacttttgctttgatttattagtgcaaccaataggctcttattgtccaccctgttgaagagagcagaaggtactactacaaaattccatggcaccatgtaacagaacattttttagatcaaacaccatccaaaaacattgggaagtgcatatgtgaaattgttaaagaacatgctaatgcttttcttttgataaagttcctaaaaactgtgatatgcaccacctttcttcccctttggtgatcgataataattaataagctgctaaataaggttaagatgtggtttaggtaagcagccatgctggacttttagggtttggaggagaggaccttgcggctggcggttgagaacttgagatcgatggtagtgatcagctcgtggttagcagttgaggtggtagtgcgagaaaaaaaatagtaggagagacaactacggggaaggagaagaaaggtgaggaaacatatcatatgcttcgttaatgttgaagtaggcaattgccgggtgcaaaggaaacaacatgtacattaacatgtagaagtgtagtgtcgatccaaaaatatataggattgaatgtacgtatctttggacacaacgttggtatttcattaatatagaattaggtgattatagccattggaactatgataataccaaattattttcccaaaaaagtatgatatatccattctcatctgtcggtgtacatctagctgaggtttttcattgcccactacgtatatgtacacatgccgacacgtcaccgtgctgatggaacccaactgtttgacgaaaaaattgaacacaccggcctgggagatctgcttagctccagtgcaggtccaaatatgatgagatgcgggcgtgccagtcaatttgatcctgcaactgacgagatatgcaaatattagatcaaaatagccaatcggctgacaagccgatggagtagttccagccgatacccgatgccgatactagccgatagcgatagggtttaagcaatcggctatatgtcaaatgtagataatgatataaaggcaatcggctgatgatgatgtaatatagtaatataatccagtagaaaccaatcggctaacaatatgatatagtagaacaagtattgatccgaaggttaaagcacccatcagctggaggtccgatgtcatgaaatccacaagattagattaaacaatgaaacatttgttgtcatcggctaaatccaacttatatgtatatgcaatccttatgagccgatgcaacgtccagataactcaccggctgaaaccccgatgaaacccttattggcaatcaataagcaggttagagattatggttctaagcatgact

SEQ ID NO: 67570 - DNA, 1040 bp, Oryza sativa
tgtagatgatacaattgcctgggccgacggaacattggacttaccctttcactggagatcgaacaccgatgcagccccgcgtcaggtgccaagtcccgccggacgataaaataaagtagaaaaggtaaaaggtggcgatgcgccgaattgtattgattgtgaggatagattacaatgaccccaggtgtacatatttatacccatgggttgatacaagttcttgtcggacaagaaagaaaccttcctaaagataaaaggaaaatataaagttcttataggacacgaaacacactttcctagagataaaaggaaactaacaaactattcctatttaatagataacttgacatgccgcattctctttaaactcggtcacttatggataagcttctattagtagattgatttccttagccgaatataacaggaatccgactattggcgacttgataactcccatcggctgatcccgagatgctgcagccgataatgactctaagccgatgacgtctttgccgattaccaaatttcatcgttcgaatgttttttcttattttattagtagtcttatagtagtcttagattttacattttgatgagcctcgttttaaagaattcagattataagacttttctactattgcccacattcatatagatgttaataaatctaggcacacatatatgtctagactcattagcatatatatgaatgcaggcagtgctagaaagccttataatatactccctccgtcccaatatattaaaacataggacatgatgggacattttctagtactacaaatctggacagactgtctgtccatccagattcgtagtacttaaaaaatgtctcatactatcctaggttttaatatattgggacggaggaagtataagtatgtcaaacgttgggctggtgtctttggaaaccgaggatctcaaattctcaatccgcgcgcggtcccgcgggtagagacaagcaaaggaggagaaccagcgccacgccaacgacgaccggtcgatgcatgcccggatgc

SEQ ID NO: 67571 - DNA, 8098 bp, Oryza sativa
gcccgatttggcggtgtcgtccgtcgcgctacgctagcttgcgtgcggcgcgcgcgcggccacccaccacacgtcgcgtcgaccggtcgatctacgcctgcgcgcgcgtcgtctcgtctcccgtcgcgtcgcgtcgcgtccgcgctgagctgagctgggggggccgcgcgctgctgtctcgttacgccatcattcatatgcgtcgtcgtctggcgcgcgcctgatctgaccggaaaggctgccgttttgcctgacgtgccggccggccggtccgcgcggtccgtgacttcctccgatcccttgatcacagcccgtggattttgcccgtcacggcagggggaacgtacgtgtcatcatcggcctcctcgtcgatcgatcatccaaaccacaactccacgacggcctacgtaacatcgatcctctcgtttcgttacctgcgctctccttttccgaccgagatataactttccacgaaaagaaaacgagctttctctacatggagttcaactaccctactactactactactactagactagtatgattacatgctgaattgctagtgcttctagtagcaacataattaatccaagctaaggaaccatttgaatagaagaatagaaaaacactggtttattacaaagtattgtaaaatacagaaaaacacagaaataatcatttgattaatttaacctttttttcgcgaacgcgtaaaagattgcacgtcaatatatttgaagaaaaagagtttaagttacatgagccaatcagccagaccagcctattctaggggaagggagaaaaagcaaatgaaaaaaaaaactgaagcttagggagactacggcggctaaaaacagactccaagcagggggaaggggccaagccacgctagactcccaacaaatccccaaaagcggcgacgccagctaaagaccacagatggcccttagagtggatggactccagaaccactgagaccgaagagagagcggagtcgaaaaccctagagttccgctccttccacagatgcaaagagaccagacgcaccagggagtcgaagttgtcgcggaggtgctcaggtaagcaggccctggaggacggccaccagtcctagaaccagctgccacggtggggagagagggcagcccagctaggaggcgacaacacccgaaaccagacctgccgagcgaacacgcagtcgaggaggatgtggttcgccgtctcaagatcctgagcgcaaaaggggcaggccgagtgactatcgatgccacgcttctggaggagatcagccgtccagcagagctgctggaaagcaaaccaaagaaatgacctgaatttggcaggaccctttgcattccagagaagatcagcatatgcaaaggaatgctggccatagaagaatgcatggtatgccgaatgcgctgagtagcgctggtcagccgtccaacgttaaatgagatgatccttgacacccggcgagagctgtacatgaagcaccgcatcccaaataaggagaaattgggagatgaccgggatagtgagggcaccgcggatatcagagacccaagagttgttgctaggccagaagcaactgtgcgcgaacctcggagacactggggaacgacgaagaggagatctagagccaaggacgccaccgagcggccgtcgatccgttggtcagaccagaagagcatagactcaccatttcccagcaaaaagaaggtggatgccatgaacatgtcggagacggtttgctcgactggggccttcaggccatcccaataggggtgccctgagcactggagccagagccagcgaacatgcaggtcaaaccctgccaatctgaggttagggatccccaacccaccacaagttttggggcgacaacgttcgtctaggacacccgacactgcccaccatgagccgagtccgtacctgtccacaggaaggcgcgacacttcttgtaaaaggccttaataacccagactggaaggccgatcgccatagatacatggaccggaatggaggagagaactgtctggaccagcacagaatggccagccagagtgtaagtcgtcccttccaaggcaggagtcgatgggagactttatccacaagcggttgcaagctggccgccttcggcaacttgcgaacggacaacggaatgctgaagtaggtgcaagggaaatcagaaaccgcgtagggaaagcaggactgaaccaactccaggtcctcagccgagcaacggatcggggtgatcgaacatttggcaaagttggtgcgtagcctggacgcggcaccaaaaacataaagaataccctggatgaactcgagatcctgatgaatcggggagaagaagaggaccagatcatcagcatagagggaggcgcggtgttgcaaggcccgatcattaagcggaaggaaaccaccggagtcggaggcgtggcggagcatcgcattgagtacatccataaccagaatgaagagcatgggagagagaggatccccttatctcggaaagtcaaaaatctaacgagagtccctaaagcacaaacatttccctaaatgtttgggctttctagctattgatgaaatcaaaacctcattggtcaataagatatgctgcagctgctgctgctactagtaccagtaccatgtgaagaggagctactccagcaggcttcggttacagattctactcgatcgatgaatgaatagattgtcaacacaacaaccacaccgaccagacgctagaaaggagaggagcacaaggctggaataccgtgtacaaccaattaatcaaatctcgatctctcccttcctctctctctctatgttttcttttttgtatgttttttccaaatggaattctcctttgctgtgaagtgccgggtgtcccgaatcaaaataatcacacccctgtacacaacacacacatacaggtacatgcattgatcgatacatacaccagaatccacgcgaaggagaagagaacaaatggaagcaaccgagcagtggatgtgtggggctactgctactaccctactactgtctctcttcttctcttctgagagtttctgacccatcaaatccctaaaagttgtgctctgatcgtaccactagtctgttagcgagggcattttcggaatccggccctgcccctgccacgggcagagccttttgttagttgtctcttggccttttcctgtgtcactatgcacacaacggacaggggctttcctgtcttttcctagctagcaatactagtactcctacctagtaatagtagctaattggacggctgagattggcgcggccggaagatcaacggcgcgccgtactgcgggtggagcagcatcagcacggtgggggcgtgcacgtaggtgggcgagagcgcgaggtcgaagcgctggaggaggacggccatggtgagcttggcctcgaggatggcgaggctctggccgatgcacatgcgggagcccagcccgaacgggatgaaggcgagcgggtgcttcgccgcgcgcgccgcgccgctggcgaacctcgccgggttgaactgggccgcgtcgggcccccacaaccgggcgtcgtggtggatcgccatgatcgggacgagcagctccgtgtcgcgcgggatatggatgcctccggcgtcgccgtcgccaccgccgccgagggtgacgtcgaacttggcgcggcggatggtggccaccgccggcgggtacaggcgcagcgtctcgttgaggatcatcccgagctggaagaagatgacagcgagaaccaacaaggtgagacttttgtcggcgtggaattacgggaatacccccactgggccatggatatggtttggtgtgcgtaccgtcttgagcttggggaggtggtccttggtggggagctcgccggcggcatcgccgcagacggcgaggacctcgcggcgggcgcggtcctgccagtccgggtgcatggcgagcagcacggtggcccaggtgagcaggttggtggtcgtctgcttgccggcgaagaagaaggtcttgcactcctccaccatgtcctccaccggcatcgtcctgtccacgccggcattgatcatgagccccagcaagtcgttgaagccgctgtcctgcttgtctttgagctcggtggtggtctcgtcttcctcgccgccgtcgccgccactgcgccggccgatgagccggaccaggccgcgcctgatctccctgtccaggccccacgacatcctgttcttcttggtcggcaggaacctgttcgatcgaattccggcgccaaccgtgagcccaatttcggcgagaatggcgaatcgtttgggagttttttgggttgttcgtggcgtgtaccgtacctgtatcccgggacgagcaccttgcggaaggcctcggaggcgaacgccatgaggcgggcctgcaagcggaacacgacgcggccggagtcgtagctgcggccgaacgtggcgcgcgtgatggcctcctccgccaccgcctggaaccactccgccacgtccacctccacctcgccgccgccggcgcacgccatggcgcgccacctctccgccagcgccgccaccgacctgccgacgtgcggcaccagccgctgcaagagagagacagagacagagcacgtgtcagccatcgtcgtcgtcgtcatcgcgggtgcgccccgatcgatcggaggatgaagaaacagaggagagactcacgttgaggttgtcggggtagaagccgggggtgaggacgcggcggtggtgagcccacttgtcgccgtggaggctgacgagcccgtcgccctccagctgccggaccacggggtgcgcctcgtagcggtcgaacgcctcggcgcgcgtgaggaagatctcccgcaccatctccggctccgccaccgtgagccgcggtgtcggcccgaaccaaatcaagaacgtcggccctgcaaccgcgacgaccgccattaatccatctgatcagacacgagcaagcacacaaaatccatccgtcctcaacataccgtagatcttcctccagtagtggtagaacgcgagcaccctggggagcgcgttgtgcggcgcggcgggcggcatgggcttcgcggtggcctccgccatgagcgccaccatctccctcacgcacccgacgaggaaccggtacggcgggccgcgcaccccctgccccgcgaagtgcgcctccagccgcctcggccgccaccacaccgcgtccgccaccctcgccgccacgtgcagcagcagcagcaccgccgccgccacggccaccgcctccatcatctcctcccctgtttcttgaaacagagcacacaaacgcagagagatcaggtcgccgccggtggttgcgccggtgagtggtggcggcggttgggttgggggtttggattcgaaatgggaaggcgaggatggcgggaggaggcgggggttatatagcgaagcggggcggcggaggtggggcccaccggcccagcacgatgatctgttggtggtggctgcttggtaaattcagatgggatggagagagaaaggggggaggcgtcaacgaggtaggtgaagtgtgagaaaaccgccttcagttcagctgaccgagcttgggggtgctgacgtggcattttcattctcttttttgtagaacaacattttcattcgttgcagttgggaaaaatgagaggaggggagtgaaggcaaggcttttgcttgcgtgtgctgcttactcttgagtgatcgaaagtttgtgatgtactctctcagccccaaataaacccaaataaacgcaggcataagtttttttttcaactttgatcatctgttttatttaatttttttataataatattttttattgctattagattataaaatataaataacattttatatgtgattatattttttagtgttttcaaaagaaaaatttaaataagacgaacgattaaagttggataaaaaactcatggctgcacttattttgggacggagggagtacttattatatgtgtctactatgtacttatgtcagctttatagtatttagtgcaaaaaaaattatattctaaaatttaaactggtttatctggtttttaatgtttaacattgtttattgactattcattatattgaaaaaattacgtgattattatttatttttgttgtgatttattttaataagatctatacttttgcatattacataattttttaataagataaatagatattttttaatgccaacagtcaacatcttcaaatattaaaaaccggatgaggttttttttttattatgtgaaagaatacatacatcgctattcgcacacacccgcggatacatcttctatcatctgctaaataaatgaaggtcagcacctctcgtctctcaatttctattgaaaaagcagctgcttccttagtaagtaaaaaataaaactactgcaccagagctatacaaagagagactaatcagctacaattaggaatggtgttaatacggttttcactgtaaccatgagaaacacgttccactgtttagtgcttgaatatatatatattggaaattgttttggatgttaatgtggtagggtagttcagaccagaccacaaaacttagtatgacccagcttgtccctgcctgtttacgcaggtcagaacacggtttgagcaggccgcttaatttgggatgtcttcctcctacctacatgtcctgatatgatgtggtttcttcaagatgcccaatgattgattcttcacctgctaataataattattaactctttgaagttgtgtgttgattgaaaacacccgatcgaataaatcttttgcttatttaaattatggatagcgctgtaccgagtccagtgattaggcatcacacttccattattagaaaaaaatctcaggtgctaattaaattctaaacattgtcccagtttggtcaacatctatggtaaattgattcatatgagctcatataactgagcgtatgcgcagatttggtagagtcgtatgtgtatgatttcactcgacaggttctaaaaatattaaagacaacaaattggttgtgttcattcctaattagcgcaaagacacaaagtttatacttgtattaaattatctgaaaaaaaacaaggtttcaaaattcaaatgataagtaggaactgtctgatactactagtatgcattttcttttcgcttgtgcatttaatcaactaattgttgtgctagtactttgcaaagtgacctgcatgcaaggacaaggagctctcaacaaagagtgacccaatataaatgtgacgtgcagcactcatttaatttttgtgcgagtacgtccagctttatttttatcgatcaaaattaaatctacgtcaaaaaatagctttcaaacttttttgtaggaaagaagctaggcattattattttctgcagaagacaaacagatcttcaccatcaaaaaggtcagagatgtcgacaagcaatccttacatacgagcccacatttttccacttcaccataccgtccaagtcacgctaagatcgagcattggagattttggtttcttacgcccccaaaaaccggacgagcaaacgtaagcatcaacaaacctcttaaaattaattacttctcgatgaaaacttatcgcccactactcacttttgctgtgaattaaatgtgcatctgttcatgtgtccaaagcaacatgtttttgagggagttcgttgaatcgatcgatcgattatatgtgggcaggttttaagaaaggattaaatgtgaaggccagtacagagaatgattcgattttcagtttggacaggtaatggccgttgcaggtagaagctgactagccatcgacgaggcaggcagagccacatgcagctcgagctggcgaggcaaccgtcgcatgcatgttcgttctaatagcttccatccgcttcgtatacaaattttgacaatttgaccctttgtaaaaactatttttataaataaatcgtcgccaaaacttattttaaaactgacccttttgttcagcgtcaaatcgtgtggcgctgaacttgcgttggcacgctgacttaacctcccatccgtggtggcacggc

SEQ ID NO: 67572 - DNA, 3609 bp, Oryza sativa
cgagatctttaactatcgataacttagaaaatatactaattagatcaacatagatttgtcttacaaaatactataataaaaataaaaatatttctatttagttatatattataataaaaaacatagttaaagtatactccatccgtcccaaaataaaccaactcgtactagaatgtgcaacaaatcgatatagagtatgtttaaatttgttgtactactagattgatttattttaaaataattgtaatactccctccgggctgggtttattagtcgttttggctcggttagctgtggatgagaaaatttgtcgttggagcatttttcccacgcatgagacgagattgcccttgtgcattgatggcgttattgttcccagataaccttcttgttactccttttaacgcttcgtttccatctcatttaattttcgcatgccctcgcgcgctatctgtactgaagctgcatgggctacactcatgcatggtgccatgcaaaattgccaagacaaaaaaaaaggtatgtatctagagcagaaatcgaactcaggtcccaagacaccaatatgaatgcactaaaccaactgagagagtagttgttggttgtttgcatgctacacctaaccgtttttaatagggataaaataggaaataagaaccatacttaatgacttcttggtttttgaaatcctgtccgaaacgactaataaacccagcccggagggagtatttttgtagatcatgtccgaagaaactagcttctcatactcatagaactacacaggtccgaacaaacctctctgaactgttgacgaccgaccaagtacacgcaatgacaccaaaaaaaaaatttatcaatggcctgtttcgtttggcccagaagtacacaaccgcgcgcgatgattgaccggccggctgcatatcgctgccgacgtcaacgtcgcgagctaagctaataagctagtagccaccacacgcactatcacaaaatatgtgatgcattgtgtacatttgcagactaaaattgcctacgtctctaaaataacaccagaaactcgtggaatatataacaacatagtccatatatctgtgataactagctttcttggttgaggccgaattaatcctctcttgaccaatcatcacggacgcgtacatatatagaagaatcatacttgtacacgatatatattggacacagacgcatgcctgtaaccaccgttctgatggacgctgctagctaacctatacccgtgtctgtgtgatgaacgttaaccccgtatgtaatcaacgattctggctgtgttctttgctcagtgttatcaactcatcttcctcatgttacacgcgtacgcttttcaacatgctaaacagtatgttgttttaaaaaatatttctatacaaaagttgtttaaaaaatcatattaattttttttaaaaaatagttaatagtacttaattaatcaaatgctattaatgaatcttttcgttttctatgcgcaggagaaacgaacccagccactgtgtgtggtggagccgtacgtggatcggtggatggatcgggctgaggcggtgtgtgtgggcgtgcgtacgttgcgtcgcgcgatccggcgtacgtttctgcggggggccgtggaaagaggcgcgcaccgcgggacggtgccgggagggcgcggcgcgcgggcgggcacggagcaccacggttgggctccgcgccgtccgcgcgcggggaagtatattaaccaggcatacggcggttgttgcttgcggctgccgcgagctaacttgggcgaagttgcatgggtgggctgaacgagacagagatagatagggagagagctagctaggaacattcctgtgcatgcacgtctctctctctctctctctggttgagacctggccggcctcgatcctagtagtagacaaaccagcaacgagttgtacatgcatgcatgtgtgtactttgtatatagacgacatgatcaatacatgggggtatgaaacgatcgagtaacatgcaggataccatgtattgtcgtactaggtcatagtaatgccataaattaagttatgtgtctttgctactttgagatagatttcgttgcagcgacattttttttccgggggtgaggatatgccacaattgtccacatcttctttctcttctcccccctttaacatcggacatctctccattactagctttcactacgattgtcggcatccatatcctttcgtgtccccttccttttccacacctgcacccagtggcgaagccagaatttagggatagggggtgctggcacgagacgtaagaactcaccaacgtctcggtagacaatggtatggatcttggtgctcagatcctgcagagtggcagattggcctcacccagttgccttttgttcgctctaatatgcgtagtcacccctcgtataattatatttagaattttgtggttatttgtcgtttgcactaatatatacataaaatgattgttgatatgattttggatatatttcagcacattcttctagatttatatataaaattgaacttattatagaatggagcatgtatgttccgagtccgaatttactttaatatagcataacaagaaccatttttaaactatgtcactaaatagcaccaactttactcaatacttgaatgacacgatcgacatcatttctatttattctttttagttttggagacttgcaaccatatcgcttagttacgttaattaactcaggtgaacagctagatatatgctcaacttgcaactaattaatgagctaattgtatagattagatggctaatcacccggggtttgcatgtagcgcatggggatgggggtggcttcgccactgcttgcaccaccaaactcaccgctagccgctccttcacccttgcacggtgaacatgcgtggttttgcatacactatccctcaagttactgactccacgtctctcgcctcctgataatcggtgatgtgcttcccaggtgtggccgtttatgggctatactccttccatatatatagccattcgttgtgcgcctctcgggtctttcctacctcttgcatgaggaggagctccacacttgcattgcctcgagggatgatgttaggtgtgcgagtgtgacataggcgacagaagtcgtcgtgtttcagtggtgaattcgggcgctgtgctggtcaaagttgggcgagatggtggcaggagttggacgttgaggcaaggtgagaggaggaatattagtaagaaaagaaaacatgagtgattttggtacatggcattcagagtaaaagagagttatccccctaaagtttgtggtatttcttcacaaaatgaacaaacttcatggcaaatgagcaattttccattgtttaaaatatgcgaaaattccaacaaattaaaattaaagtagatgcaacaaacacttcaaaaaggagaagacaacacaaatataactgtgtgcatgtttgattgttactacggtatatctacttgattataggaaaaaaatacttttataaataaacataacaaaaaatttaaacaagtgaatctaagatatataatagaaatcaatacaatataaga

SEQ ID NO: 67573 - DNA, 2706 bp, Oryza sativa
ctgcatcaacaaattactaaattagatgcaaaatcatctctaattaaagggacttactatgtttcagttgattggttatatatgagttggtttagagactagagatgtctataacaagggtaattttaatatctctgagaaggtactaagaggtaccatatttctatggtaaatttaatacttctaggtattaagtaaggtactaaaattttgatatctcaactgtaaaattccccctatataacaattaaaaaagaaaaaaaaatatccaaatactcctctaaactttagatagaaatacttctacaccctaaactttaaaatcagatctttgcaaaaccattcatattactccctaaggtggttttgtatagttatttttatctaatttttatataaattggatgagtttgatcacatggcatacatattggacacacatgtgtgtgtatgtgtatgtatgtaggtacaatggtacatacgtatgtagacagctctattaaatggagaggcaagtaacattagaatttagaaattaccagtcaagcgaaagtgatttaccgttttgtagttaagcccagcgggaatggtacaccttgagaggtcagccggagtgaggccgtcgttgttggcaagatccaagcaaaccctgcgattccgcagcaggtagcagaacacgttgaggacaccgctcgcgaccgccaggtgcagcgcggtgttgccgtcgtcgtcctgcgcgttgaggatgggcgtcgccagctgagagccgtcccgcctccgcctgtcgtcggtggcgaatcccacgatctcctccctcccccggtcgacggcgacgtggaggaaggtcctcccgcgggcgtcgcggaggccggcgcactccgggcacctgtggaggaggagggccacgagcttgaggtttcccatggacgcggcgacgtgtatggggtactcgccgttgctgtccggccggcaggctaaggacgggtcggctttcaggagaacttgagtcgatgtccggcggcggcggcggccattgcgcgagcacggccatcgcaaggcgagccgccggaggagtgagctcttctcgagctcgatctctggtccctccgctgaggctgcgaaatggagcgctgtgctgccggatgcgtcggcttcgccggagagaccatcgttccattgcagcatcttttctgtcatttctttataatttacaaagcaaagcttaagataaaccaatatacaacacggtagctatcaaactattgctcagcactgttttttttttaaaaaaaggcataattttaaactgtgatgttttaagaataatttttaagtgtgatcttagcaatcgtaaaggagtgtttattcatcagttgattgaattttcataaactgccattaggaatgaaaacgtacggctcggatactgtgaaagctacctctactatatttgctttcatctttttatttaaaaaccgaaacgaatactctaaaatccagatatgaaaacgaaaccaatcggaatgcatatggtcaccaatatttatcggatcaccataaaagcttcatatgatgggcctccgaaatcaacggagaaatattacttcttgcatatcaaagaatggatcaatttttttaaaaagtactcgattttgctatagatttgtcatgtgattttttttctctcagatttgtcgtttttaggccgttccatatgtgccaagatccgtgcgtatatgttgggctgggaacccgcatagggttcagttgggtcgcgtgtaacagcgtcggatggttagagtcactattttatttttattttttgctctgaaaaatcgacatgcatgatgctctctctcctctctcatttgaaattaaaataaaaataaaatacaaaattacagtactatataactaaaattacatttgtaaattcagttgatatgacatgtaagtgcactacaattttgataacaatgttgtgtaagtgaatatctatttgttattttctttaaaatataagattacagttctatataattaaaattacatttgtaaattcagttgatatatatgtaagtgcattgtaattttgataacaatgttgtgtaagtaaatatctatttgttattttctttaaaatataaaattacaatactatataactacaattacatttgtaaattcagttaatatgacatgttagtgcattgtaattttgataaaattgttgtgtaagtaaatactccctccgtcccaaaatataaggaattttcagtttttgcttgaaacgtttgaccactcgtcttattcaaatttcttttgcaaatataaaaaacgaaaagctgtgcttaaagtattatagataataaagtaagtcacaaataaaataattaataaattcaaaattttttgaataagacgggtggtcaaacgttgccatcaaaaactcaaaatcccttatattatgggatggagggagtatgtattttttttttatttttctttgtagtccgttggatgtaaatctaagggtagaaaaatctggatgatttttttagaaatcacccgacaaatggataggcaatcccaatagtactatctccattccaaattgatttacattagagatggcaatttccccgacggggacccgcccctacaaggacggggtcggggctatatttggccccacaggtgcatcgg

SEQ ID NO: 67574 - DNA, 4453 bp, Oryza sativa
cttggtcggtacgttgcagatcagatccatttcaagttgggagtgaagtgcttcaacgttgctgacctaggtgtatttcagtcaaaaagagatgcaaagatgataaaatgaatttaaaatgaaagaaataatgaaaatggcaaagtggtgaagtgtactcaattgagaatagtattctagcgaaacccatttgaatgatgatatttttgcgaaaccagttttataccatggtacatatgcaattttctccttttccttatctcgtcttatctaccccagccatacatagtcacggagccacccatccagatcgagtcaatgacctttcaaaagaaaataaaaagaaagatagagtcaattagtagcgactgcatcggcgctaccgcagtcgttgcaagcgatagtgactccgcacggctgctgcgcctcgtcagctccctgcaaggctgcgcctcgtcagcccaggccggctgctgcaccttcgtctcggccgcgggtcaccggccgctgcactttcgctgcatctccggctgctgcaactccgccgcgtgtcgccggctgttgtgccttcgtcgcatgtcgtcggctgcttcgcctttgtcttcgtcgcgcgtagccggcttctgcacctccgccaaatctccgcgacactggcctcctcgataagccaccgcatcttggctgctacagttctggtttgtcctctttctctacagcttgcggggccccggtcggggtcggtggcggggaagcttttcacacgaagatggtaccggggccagggacgggggataaagtcgggggttaggggcaggaccgttcctgtccaacccagtcccaccccgccccattgccatccctaatctacatatagttttttttttgttattcctaaatgatctatatatttgtgtttattcattaagtctatttgttatttgtgcattggaataaatagacattgatgtatgcatctatgcacgcaagtatttataatccacatgcaatatcttgatttgctattggctagaaaatagcgagaatggtgcatgcatcgagtttgttgctagagtaaatatagtatgagagagatattagctttttttggtcttggtatacctatgaaatatgtagatcaatttgatagagggagtagcaacttgctatagttttttcgcaattcacttccttaattattcacatgtatattctttattggaaaaaagaggttaaaaataaataaactatattttcccttctttcttatgcacagcctccccattttatcttcctagtgttggtgtaccactctctagacatggctcagggaaaagctggtcaatagtttagaaactcctcaattttgtattagtattcttactacgagtaaacaaagctgatgcatctttttggtgttaatcactaatgtcggtatcctaaagttacttactccctccgtcttataattataatatagcaatctagtactggatgtgacacttcataatataacgaatttaaagtacagtaaacatgtctggattcgttatactatgaagtgtctcgtccggtattatgttacaatattatgggacagggggagtacttccatggcgatattaaataagcacgcagcttgttaagttaagcatacctatttttgtgattaaattaagcatataatcagtttgctagctgagagattgctttgtttttttttttctaaattgaatgcttacatccagttagatacattaattagattataactaattaaattattgttcttagtgacattttaaaagattatgaactatttctttctataatctataaattaactataaaaataggagagaaacaaactttgcatccaattattggttgtttgttgaatcagtaatgattattaaagttatagtcatagtttcaactacaactcaccctgatttgtgctttacatagaaagaaagggaatccagagtaattttgtcatttttcaaaaaaaaagctaacactactcttgagtgacgtggatggcatagatgaacgaaaattctgtttgatggcatatacatgaactgctaatttacgatggcatataagaaaacctgtgaactttaggtggcatatgaggaattttctaaaaaaaaaagtgtaggagtacgtacctgcaccgcgtaggacagcagcgtgcagggcagtttggccggccggtcctgcatacgagagctcgtccccttgctgatgcagagcctctgcgatgtggtcgtggcccagtgagaccgccaggtacaacggcgacatcccgtcgccgccgggaagacgggcaagccggggatgcaccgaaatcagatggtcgacgagctgcttgtcgccgagcctgaccgcgtcgtgcagggccgtctcccgccggccgttctgcctctccatcacttcggccaccctgcccgcgctgccggcgagctcctcctccctggccatgtcgaggaggcacctgaccatcgccgcgttgcccgccctggcggcgcagtgcagcgtcgtgtcgcccctcgcgttggggcggtccaggaggcgcgcggcgtggctgtagatggtgcgcgcgcagcgcagggacccttcgccgtcgccggaggccgcccccacgtgtagcgcggagtctccctgtggtgtcgtcgccgcgtccaggaggagcggcgattgttgcccggaaccgacgtcgatggcaacttgcttgtttggcgttccggcggcggcggcggcggcgcccaaaagtaaagccttaagccccgggcagttgccgcggcctggggctttgaacagcttgggatccatcatatcatcactaccgggcctgatgaatcaaacttgggatttaaacccgtttgggattttgcaactacttacaattaacatttcagatggttagtcagatgctgccatcgacgtgctgaagcggttagcactagttgactaattaaacatggttatgcacagcactatgcactcatgcgtgtgcaaaaaaccatggacgtacgaacccgcgcgcgatcaccacctgtcttgcattgcatcccgtgtgccgagtgcgaccggaaactctttatgcggcactacctctaattttaaatgtacaatgttgctaccgctttaacgtacctagtatggtttactattcattattcaaaaaagattatataaatataagtgctacaatgataagcagtctctaaatatcttgtacaattaaaatatgtcacgtcaacatcaacatagatggtactttcatgatcgtttaatatgatagataatataatgtacgtctaggagtcaaagtggcatatacaaatagattaaaggataaacacgaattacccattagacaatagcagtcaaccggattatcccctaaccggaaggccagacatcattcgcccctaactatataaatcggacaaataacccctcaccccctcctcccgacggttaatccgcgatgattttggttctaaatactattagaacaatcgttggggtccactgttagatctctcccctccacctctctgcaccaccagcgcaaccaccaccaccacacgccgcggctgtcgatgatgccgccccgtctcccaccatcccctcctcctcatcctcacccaccaccggagattaccccactggagaagccgacaccgcggatgacgagggccgcccctacatctcttcacgagacgaccttccatgccgagctgagctcctcctcagcctccggcgccagcgcatacatgaggagagtcgtagtctccgcggtgccaacgagggaggcgaaggtcgctcgggcggccagcgacggaggcggaggtgcgtggcacattgcttgggcagctggcggcagaagaggtcgctcgggcggccagcggtggaagcggaggtcgcgcgggtgccgatggggggaggcggaggttgcttgggcattgacgacggagataggggcgcgtcgccatccctggcttcggcacccccagttggctccgcccttgcctgccgccatcctcggctcccccttcgttgcctagacccaactgcattcgctcaccgtcattctctgatggaggtgaggggagggagaagagagagaggggaccggggaaagggatagagtagagagatagagacgaatgagaaactgataggtggggccctccaatttttttaaagaaattctgattggactatcacacatatgccacgtaggactaaaaccaccgcggattgagctagggttatttgtcaggtttgcatagttggggggtgaaggatgtctggttttcgagttaaatagagtaattcatactgtcgcgatgttcaggcgggtaattcgtactttttccaaaatgaaaagggtaagttttactccctccatcctaaaatagccgcttagcgctagtgattt

SEQ ID NO: 67575 - DNA, 1429 bp, Oryza sativa
ggcaagagtacaaaggcactgaggaaggatctgtttccttcctttcgccattattccccttgtcttcgccgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccacactacccggggcggtccgtcttctttctcccctttgcaatggcagggctggttccaccattttcttctttcttcatggatgttctggagttctacgatctccagatggcgcacctcacccccaacgcggtgatgaccttggccatcttcgcgcatctgtgcgagatgttcattggggtgcgcccatctcttcggctgttccggtggttcttcactgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggtgccggtagatctgggggatggctatgacgccgtcctcgaccgcctggcgggcctgcgatcccaggggctcacaggggccatggtgtacggcgactacctccgtcgtcggattgcaccgctccagcgacgcgctcggggcgcctgggagtacaccgggtccgaagacttcacgaggacccaccagggagtgagatgggactgggctcctgaggacttcaagatattggttcaatgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggggtcgtgcttcttggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccat

SEQ ID NO: 67576 - DNA, 551 bp, Oryza sativa
ccagagcttgaggtattctcggattgcctgaactccaagtgccccgctgatgtctctgatccatgctttattgagcagggcttccgcgggcgtcctgcgtttgcggattcgaacaggaacatgttcgaagatggaaggcgcaatggctggtatacctccctcctgcatccagcaatcctcccagaagaggatacttcttccatcccccagttggcacatgtttgaaagatagcctacttattgctcagtgatcctgagtactagctagcatgcaccttacttgtaaaatgaatagcacatacagaattgtgctcaaagacaatgacttgataattaccttattctgtgttctgtgatagccttgatttatctttatcattcatattatgtagcctcaaacacttggacccctataggctgtacaatgcgtttgaaaattcctttgcatttcattcagtgcatcaataccaggtgggatcgcataatagaagcctgtaaggcaggcgattagctatggcatgttcttccttatttagtactacaatcctaaa

SEQ ID NO: 67577 - DNA, 10342 bp, Oryza sativa
  unsure (1)..(10342): unsure at all n locations
tttggtgtggatgatcacatctctgagatggatgattgctgcaattcttcatcaaagtcaagtgcaatctcagaggatgactgaagcaaactaggatagcgacttgacattcctgcccacgtatatattcagttcgtgccctgctttttgcctcatctttttgcgggttatttgtttcgctttttttcatctatccctgtatatatcttgctataattttctcctgctctattaatatatacaaggcaaagcttttgccttcctttaaaaaaaatatatattcagttcgtgcttatacaacaggggatgtttcttgactcttgtagaggtaagaggttaatatgaagattagtaggactaagaagaattcctcgttgatattttcaggttgctagatttttcatcagtacacgaccctgattgtactgcataaaaaggaagtaataatataggagttttgattgatggactttgacctgaccagaaatttggtctagtttgaggacatctttgttacaacacatgtgcttccatggaatttgagttctggagactggtggcatgttttgtgtagatttagatgcttttttttagcaggtggatgctactttttagggtgaccagtgaaaacctcaggacgtttaactccttgccacttttaagatgtggcaaatagttaattattccaaaaacgtctgccataattttctacagccacgtaatcccattctgggccacaagcgagtgagaaccccttccggtccaaccaaagcccgtaaagcacaattcatcaggcccataattaaacctgcactatctggggaatgctgggccgttgtgcagttttcatgggcctcaacaatctcccttttcaattcttttcggcccaaagtaatgtgcaggcaccacacgcagcccaccaaaagctcgccatggtactgtggcaggtaaaaactgggcctaagggtttgggccttcatcaggaccgtgcaaacggaattttttttatttatacttttttttattaaaatatttacaaaaataattttttgtttcgaaaatttacaaatctaattgcctgccgcccttaagaagggcgatttttaaaaatcgccctctcaaagggcggcaagggacctaaatacaaaatttttatttgtgttcaaacccttcccaccggttttaattacttaaaaactaataatgcttattcgatactccaaatgattttaaatggaaaagtgataaactacaaagttatagatctcatcaagatctacaacttttatataaagtttatctccatccaatatcgtttgaaatatagatctgagattttttaaaatgtgttttatattttgtaacgaatatttggatatctaaaacatcttaaatgaaaaagttactaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgcccttcttgagggcggcaggcgattagatttgtaaattttcgaaacaaaaaattatttttgtaaatattttaataaaaaaaagtataaataaaaaaaattcgtgcaaacgttggccgagcggcacagtgagcgagtcgctgtcaaactgaaccgccggccatcttctcgcgtgccggcctccgtcgctcgccggagtataaccacagcatctacaaccataatcctccacatgaatagaaaagcagtatctaaggcacgtttttaattctgcctgcccttattgtagccttgaataccattctttggttcgtagcaatctcgctcatcaaacttaagtgcgagcaatactgctcactgacatgtgggccccacagaccctcggggcccacatgtcagtgagcagcagaggatctggattgcttgacgatactagaaaacatccatgttgctccaagaccttgagaaatgatcgacatcacaaaatttggacgtcccaatcacaacgtcgcggcgaaggagacattttggctcccattgtgggcgacatgtcaagcgtccgtgcctcgactacgaaattaattaagaaattcttgatgaccaaaattactggcacatgaaaacgagagtaaattaagaagcaaaacagtcactactcgtaacatggtataggtggttgaccgtaggccgtcgagcttgttcaacatgtagaccatggatacggtcatggcctcttcttatccatcgttcaactcaagcagcaggtagctttggcactatatatacgacgtgaggctttggttttaattattattaagtgaaaacagcatgcggtcagtggttttggcaccatatatagaacatagtgaccactatacatcgggaaaacaaaacaaagttttggtgaatggagagcagcatactactagaacatattgaccattatatatactatgctcaaatttgtactaattggtttgacatagtttttcaattataggtggtgagctttgtaatttaaaggttataattccatgtgtctaaacatggtatgctttcattatttcaacttgaagtgtagcatctactccttctgtcccattttaagtacaaccatggttttccacgcccaactttgatcgtctgtcttatttaaaaatttttgaaaaaaaaaataaaaatataagccacgagtaaagtactattcatattttatcatctcgtaacaacaaaaatactaattataaaaaaaaaattaaataagacggacgataaaaattgagcgtggnnnnnatgattgcacttaaaatgggacggatggaaatagtaaatactaaacaaaaatactaagtagaagactgagaccgagacagtgcatttagagatgctgatgagctgagaaacctgatcagttggacgaggtaaacaagtggtggatatgaggtgaggctgaaatcatgctatgactttagtggctagagtcagccggatcaacctgttaattctgtcaaaaaaaaagaagaagagagagacgtgttaattacagctaaaaaactttctaatccaaaggcaaccgaaccatgaatccatgacacaaatggcggcagtgtctacttgttgcactcaccatctcctacctctactcctcctcgctgccatagtcgccaccaccaccaccaaccacgccgccgccgccgccacgttgaacatcaccaacctatgccccttcaccgtgtggccggccgccgtgccggtgggcggcggcaggcggctcgacccgggcacgtcgtgggcgctcgacgtgcccgccggcgccgccccgggccgcgtgtgggcgcgcacgggctgcaccttcgacgccaccggcgccaacgggacgtgcctgacgggcgactgcggcggcgcgctgtcgtgcacgggctacggcgagccgccgcagacgctcgccgagttctcgctcggccaggccgacggccaggacctcttcgacatctccctcgtcgacggcttcaacgtgcccatggacttcctcccggcgccgccgccggatcagtcaccgccgtgcagcaaggggccacggtgtccggccaacgtcacggcacagtgccccggcgagctcagagctcatggaggctgcaacagcgcgtgcagagtgttcaagcaggacaaatactgctgcactggcaacgggacgaacacctgcgaacccaccacctactcgctgccatttgtgaggatgtgcccggacgcctatagctactccaggaacgatgcatccagcccagggttcacttgcccgtcaggtacaaattaccagatcatcttctgccccccaattgatctcacatcttcatctcctgcatcaattgctgttgctgcaaataacagacaaggaaaaaaggttattgccgggatcatcatagcttctgtaatcggctccacttcagtactcaccatggttatggcttacaccagcatcaagcgaagaacacgacggcgccgggagatacgtgaagaggagcaggagcttgaggagataacccttcaaggaatgccaaggaggttcacatttcagcagctacaggaagcaaccgatcagttcagagataagctcggtgaaggaggatttgggtcggttttcttgggacagattggagacgaaagagttgcggtgaaacgcctggatcgaaatggtcaggggatgagagaattcttggcagaggttcagacgatcggcagcatccaccatatcaatctggtgaggctgattggattctgtgcagagaaatcacagaggctcttggtttatgagcatatgcccaaaggttccttggacaggtggatctatcaccagcaaggtgctgctatttttcctagtgttcctcctctagattggcaaacacgatacaaaattattacccaagtagccaaaggtctctcataccttcatgaggagtgcacaaagagaattgctcacttggatgtaaaaccacaaaatatcctcctggatgacaaattcaatgctaaactctctgattttggactatgcaagctcattgatcgagataagagccaagtgattacaagaatgagaggcacacctggatatttagctcctgaatggctgacatcgcagatcacagaaaaggcagatgtctatagctttggcatagtagtcatggaaatcatcagcggaagaaagaatgttgacacttcccggtctgaacagagcatccatctaattaccttattgcaagaaaaggtgaagagtgatcaagttggtagatttgattgacaaagataataatgacatgcaagtacacgagcaagaagtaatagagatgatgaaatttgcaatgtggtgtttgcagatcgattgcaaaaggaggcctcaaatgtctgaggttgtaaaagcattggaaggcaccataagtatcgaaactaacatagttcatgattttgtcgcagtaaatccagtaagctttggttttactgcagttgtgggctcagctccacctcttgcctcagatctatccggacccaggtgactgacgcaattttgatggtatactagaacatgtgcgcttttgggtcagaaaaaggcatagcatatacgctgttgcattctcagaaaactataatgtgatagcatcataccttcaaatcatttacattttttaatattgcaattttcgttcaagaagaacatctcaatattgtttgattgtttctgttgaacttgccctattagcaaatctgatcctggttcatacatgtgaaaccaatagctcttcttacatatcaaaatggtcatagctctcatggcactttcaaccataattcagtagtactttctcatggcacaaatacaacttttatcgtatgcaaatgaatagcgtaccacaagatcacatttttctcgttccagctttatactctgttattccctaaaaaaaatcactttcaaattacaacaatgcgatgaaacatctgtttacaacaatatgtagcctcagttttacaacctacctaccaccttatctgagaaaaaacaacaaccaacttagtaccttgactttttggcatcaaagcacatgcataagcttcagccatcctcctctgagatttcagttagctcagaggagaaacggtaagaatccaccaacaggggcaggggttcatcatcgcagaagaatggcctggaaggcagctgcagaccatcaacatcaccttcaagcatttctatgacctcactcatcgttggacgatcaggaggcttcacctgaatgcaatgtagaccaacaacacacaacttcctttccagctcatgcatattcaaggtattggtgatctcacccatctcttgttgaatgagttgattatacaccaatgatggataatacacctgggttgagcttgacatgttctgcttagagttctttcgccctccagccatctctaacaaaagcattccaaagctgtaaacatcagatttgctagatatgacaccgaagcttcgagatatcatctcaggagcaatataacctactgttcctcgtgcagcgctaactggcacataattgttgtcccgtgggcatagtttggcgaggccaaaatcggcaacttttgggacgaaattgctatcaagaaggatgttgtgtggcttgatatcaaaatgtagaatctgcatatcacacccttgatgcaagtagtttattcctctagcaatgcccagtgcaatctcattgagcttgtcccaggagaagctcttttcaggtgcgaagatgaacttgtcgagagatccatggggcatgtactcgtacactagtgccctcctcatttcctctgcacaaaaccccaccagacgcacaacattgacatgatggatactaccgatggtggagacctcactgatgaactcttctccgttgcaattgtagttgtctagcatcttgatggcaacgtaaacatcacccgggagtatgacacccttgaatacagaaccgtaaccaccctgacctagcttgtctctgaaatggcttgtcattgcaatgatatctgtgtaggtgtacctcgtcgggccaagcatcaactgcattcgcagaaacttctcaactgcatcgattgtgatccttgttttccagtatctttgtgcaagaaaagtcaatagtgccagtggcgccaacacaaacctgcatatgactgcataaaaacatgtttagatacatgggaatgatgtgcttagagtgatgcagcggcatcaatcacatgtagcataacaacaagtttataaaaagcatgtgtattgtagagtaccatatatccactttactgtccacatgacaaattgtaggacaaatcctgaataaaatattcttttcccatgaagcatctccaccatatagagtggtgtctcaaaataatctgatgtttggctcgttttgccaattatgcatgcccaaaagatcaagtccataaaaacaatgtccgcaatccgatttttgacatgtgcagtagtggagaatggttcttcacgaaaaccactgcaaggccaatgacatggtagaaaaaaagtcttaacaacggtaccaagtatttacttaaaaaacgattatttatgggcaaaattaaactaagataccgaaactcaccgaattgaccggtttaggcactgcttgattagctcaaatgcagtcggatgatctaagacaaaaggaaagcgaacagagaatcccttcctcatcaactcagcaaaatattggtattttttaccactggcaggagtccaactaactggaatcatggccaagtatccgcaagaaggctcaagattttccataagagcgtaatatggtgcgacattcagcacatagacaaatgaagagctcgtgttctggcaatccacatgtatgtacttgttattgttcttcactgcctgcgaacaattgacaaaggtcgcccaccatattccctgaagagtcaattccctggtgtagcttggccctggaatcccccaaatgaaaggacgatgattggagcgaggaaaaaggcagttgctgtttgcattcctgcaggttggcgtccacgacccagaaggacgaatcgttgtagttgatgctagtgacatagtatgttcctgtattgatctggatggtggccttgccactgctacactctagctcatatgatgaaacaccgcacctgtgagggtcgcctctccgccagaaaggatgacttatgtttgagagatggccgcaggagaaaggctggcaccactgctgtccctggacaactcctgcgagaactgcaagtatagcaaagatgagtaaggcttgcattgtaatggtagtagagggggaagctggcagagttgctcagtccacaggctggttatagtagactagcagcttgctgcacctacatatataagaatagtttttttttggctgatacagtttggtcctatgcataagattcatagtaagggaccgaagtcagttcgtcaaagaaaaccttaaattgttatgttgacatggactgcatatcagcataagattcatataaagggacagggtaacaacacagaaggatgttgcacttacgtagcaacacctagttagactaagcctagtcaaatttggacttttacgtggtggcctgctatatatatcaccctggacccccttcattaacgatgagatactttaaccagcccccttgtaaataagcttttttttttggaacgaagcttataaataagctagggttgattattagatacacacacttgcagtatattgattgattaattgcatatgtttccaccttaattccctgtccatctctggccgtttcagtgcacaaagatgagtaaagtcattgcaacaacactcctcctctccgtcatcagccatggcgcctacccggccatgggttcagcttgggaggaggaagacttcgccagaaattgtccaccgtcctggtgcagtgacagtggaccagagatccggttccctcaccagcttgaatccagcaactcatcttcatcatcatcatgcagtgcttcatgcgcgaggctagcatgctctggtccagacaccatcctgcatcacccatttctggggccatgcaaggtaactgccatagattacaagaaagctgttttccagatcatcccgctcgtagactcattgtcttcatacccgcttcagaagctcatcatcgacaatctaccggaaccagattatcattccagtcgctgttcattatacaatgcccagcctgggaaaatagtatgctgttcaaaagtgctcacaccaagtatgtctccgaccaatgactatgatgggaatattgctgatcatgctgtcgtgggcccaatctcctgcctcagtgacccaagccacttctcatatttggggatgcttatgaaacattattcactccattggactgcaaggctgtctctaaaggcattgttccgatatccggtgcagtcaccgctgatggtccaacgttcaagcaactggcagaaagaatcctcaactttgctgagacaactgtaagttggtccgagggaggcattcctgacaattgtgtgcagtgtgaacagcaaggacaacgctgcgcattcagctcacaaaggaatcaaacattctgcatgggccacaaacctcatggtaccatcctaatcagataccaaaacattatatgacagcataagtgcataactcatgttttatttcctcatcatactttccttttaagttcgtgcacttaatttactaatgataatatgatatactactcctttagttcacagacacttccatgagatagctataaataggtattttgcaactcgcactacaaaccatttggctaggtagcttcaccttacaaagagtcatccctagaacttcagaacaagaagtgcattgatgaagcacctttgctgttgttataagtgcatgattacacccaccaataattaaatcttagtgcccacatcctagttagtatatgataaaacgggaactgcagttagatgtttggttgctttgatgaataatcagttcacactgcgagtgatttgtgaaaaaaaatcatgagccataacccttgatccactttattcaccttaaccaacctcaatctggcataacactcaatccccagagatgctttggagaaacagcttctaatgcattgatgaaaggaacaactgtctgttacatatatgttcacataatcacattaacattacatttattcccctaaaacgaaaacttctatcatatctattgctatattgaatcttactatgttttcataagtatatttctgtttcatctgttaaactattaacaatcttactatattgtttggtatttgcaggttcacgtgtcaaagtcattgcaggtactgcagtaattcaaagttcaaacctccgtttttttatcaaaagagaagaaaagaaacagagttatctgccacacgtatttttttcttgttggctgctctaactctacattcttctgtcaaaaagacactacattctcttatacccatcacaatcatttgctcaataggggatagctttctgtcctgatgcaatgtgctaattttctattctgtatctattcagcaacatcatcggtagctgcatttgttgttatttcattggtggtggccactgcaatctatctctccctgaagctaagttataatgaagaggtgcacttgaaggttgaaatgtttctaa

SEQ ID NO: 67578 - DNA, 2774 bp, Oryza sativa
atggcttagtaattttttgggacttatactttatccacatgatgcatagtaatgtaacgcctagatattgcataatatgtactttgatcattccactgtattagccatctgaggtgagttcaccatgtaacacagttaagcagaaaagcatcgcattgaactcaacctgcaacatagtggttcagtcgtggtgattaccttgttcagtcgttgctgtggtgtatctcctactgtactgtactcctagctgcactagtcagtcagatactcccattggccttttcatgggtcagtattctgatggatattttgcaagacaatgctgcaaggaaattgtaaatctagtgttatcaaatggatgcattaaattgggtttgagcacgctttatgtttaaaacaaatgaatagcaaagcaaagggatcaccattaccattgtctatttgtcaatgacaaatgccagtaagaagtttccttttgttgcatattcctcctatccatgcgccattgaaagagccagggcctgaatatgtgagggaaacgtgagaagacaacgctgtagggcagaaaatcaaccatgccatgatactaaagcatgtcgcaaaataaatacctccatcatcaaatgtcagggagggggaagcaatctgccgtggaaaccatcgccgggcgtcgtggtggcgtttctagagatccgcggcggagcgcggggtcggggcagggcgagctcaaccgctggatgcgctcagagccagggcagccacgcgcagtggcgctgggagcctggaagtcgggttgattttggcgccggcaccggcggcgccgccgccgtctgctggagcgccgccgcagcccgcaggtcgatggggaggggggaactgtggggactgggttcaagcccaacacactatcccgttcgggcccaagctcattcaatgttattccgtcctggcccatcacagaggcaaccttgctgaatccggcccacagctagacgtaggccgggcttaagttgacgcagatgagcagtagataaaatgcatacaaagatcgaaagtgagatgaactcaaggcattacgcaaatgggcgcgctgagttcctgtttcaaacccttcaaacataatcagcatgttttctggaagtggccccgacaaaaagaaattgctgagagcgacacatctatcagatatattggagagcaaattgttgcaagatatccaaatcaccacagaattactacaaaaaagttttaacacatcatgccggatagtccacaggtcgccgccggtcagggatcaacaacatcaactaggagatcgtcaccgacctgcactgcaccaggattgcaccatcgtcacctgcaacttttgggcagacaggtatgaaaatcatccataggtagtagaacaagtacggtatctcgtcaaactctcgtatataatttgttgtgacataattggatgatagaaatatacacgaccttaagagagagattccaacaccacacggtaacagttaaggtgaaagaaagagacattttgggcgccacactgttgacggcaggcatggttggcaagtcaaaaagggcgtcatagaacgctgaaaaagatgaggaaagcacgcaaccacgtagtaatcacaggatctatgatatgcttgcaggcaaatcaaaacaattgctaggtcgttgaccgaagaccgttgaacaattcaacacgcagaccatgtgaacttacacaacatactgatcgatctgctgtctccttcttccgctctacaaacggagtcaggcaatcgaatcacaacacaaatggcagcggggagtaccatcagtactagtcgccgcactcaccaccttgtgactctgctgctcctcgttgccgccagcaccaactacgccgccggagccacgctgaacatcaccaaccgatgctccttcaccgtgtggccggccgccgtgccggtgggtggcggcatgcggctcgacccaggcgagtcgtgggcgctcgacgtgcccgccaacagcggcgcagggcgtgtgtgggcgcgcacaggctgctcattcgatgccaatggcaacggatcgtgccagacgggagactgcggcggcgtgctcaagtgcaagaacagcggcaagccacctcagacgctcgctgagttcacggtggaccagaccagcgtacaggatttcttcgacatctccctcaccgacggcttcaacgtgcccatggacttcctccccgtgccggctccggagcagaggcacggagcaccaccgtgcagcaaggggccacgctgcccggccaacatcacgtcgcagtgccccagcgagctcaaggcgcctggaggctgcaacagcgcctgcaatgtgttcaagcaagacaaatactgctgcactggcaccactggcaccaaaacctgcgaacccaccaccttctcactgccattcgtcaggatgtgccctgacgcatatagctacagtttggatgacagctccagcactacattcacttgcccgtcagggacaaactaccagatcatcttctgccctccaactgatctcacgtcttcatctccggttcctcctcctgcacctattgctattgggccttcaggcttggattcctcatccaaaagaggaggaaggcttgttgccactatcgtggtctctgtgatcggctctacttcagtactcaccattatcatcgcttccatcattatcatcaaacgaagaatacgaagacaccaggagatgcaagaagaggaacaagagtt

SEQ ID NO: 67579 - DNA, 1747 bp, Oryza sativa
ctaggaattttcttgaaatattagaaccatttgagaatatatatttatcaaacgattcattgggcatgaattcatatattaaagcccgtcgtgttccttcagagcaaaatcctaggagacggacgatgtttgcatggtgaattctcccaatggtcgcaacttcattgatgaactcttctccctctcctaaggagttctctagcatcttgactgccacaggaactccatttggtagctcacctttgtagacacttccaaatccaccatggcctaatttattcttgaaccgtcttgttattttcttaacatcggagaaagtgtacctcatgggcttggatgtgccatatgtcttgagaaacatttcaactttcaaatgtatctctttgttgtaccttgactttaaggagatgtagaatgcagtggccacaactaatgaaagaattacaaatgtggctacagatgatgtagctgattgaaaaataagaaagttagttagctgcatttggagatgacataattctgtaatttattttccagatgtgcctttattgtcaagataatcatggcatttcttatttggattagaaaatatatacactctctttgttgaaagttcataaattgggtggcatttaattgaaatttcatgcagaatggacaaaagattgagttatttccttacctgcaacaagagtgacccgcggtcctgcatgtagaaagaaagagaattagtattcccttgatttgtatataaaaaggatgtttttttaaaataaaagtaaaactgattccagatttttatatggcttgctgtatagaattttaaaacttgcatgggtatctatactcctttaaaaagattccaatggtggtggcagtgaattttccacccacctactcctattacaagttttacatattaccctttgaactttttaatattacataacaactaaatctaaatggatagccacatataaaattaatgtggatagcccacattttcctataggggaaatgtggataacatatttcatggaaaatatgatttatttatgttataaaatattgttatatttttccttttatccgcagcaaagcacgggcatttagctagtagtcataaaagggaataggatgggagggaggattcttatcttaaccaaccataaaaagagaaatgctttagtttaaattatttagaaggatggaatatctaatataatgatctcacagatcactgcagtctgcaaagcatgttctggattctactctgttagcacccaaaaaaaaaaggagatttggagggagagacgtccctccaaaaaatttttaagaagaaattgtgagcatactggggattgaacacgggacctcggggttgaaaccacataccccttatcactgcattatcaagtgagatctctactctgttggcaccatataatctctctgctcatagagtcatagtctatatgatactggtacattattgtttcctactgtagtaatattaactttcaacttgtcttataagttattggagttgtcacataaattcaggtccatcaaatggattgtacatatgtttttcttttcttttttttgtttttgctgaaatacagagaacagtgttatatcatactagcataatgtccgtgcattgcaacgggttttttctaattgtctagtatattattattgtgctaattttgctgccatttcgcaaagatgaaaaattccataa

SEQ ID NO: 67580 - DNA, 3541 bp, Oryza sativa
caccactaccatcttttatattagtatagataaacatttatgaatgttaatacttctatgtaacgttgtacagtttgtgaattttcattagtgcaccgtaatctgtgtacaacaaagcactattttgaacagttactttggtttgaagcgaaagaaaaagggaaaattattatttaattattttagacactgtcatctctttgcaggggcttctgttagaacattacggatgtgaacctagagttaaaatgttcatccaagctagcaatcaagtgattcacagtacaccttcacttttgttaaactgtttgattgcaaggtgaaaatattgcatcgagcttgaaatcactgtattagaatatagaagattggataactaacgtactgagaattggaaaaaaaatattgaatgctatttgaaaatgaaacaagtcaccataatgatatggggtttgtgcttcaaaaagagagagaaaaaataccatgacgccgacagaatgcttgaccactttgtgaactgaaaccacagggtcggccttcatattcacatcgttggcaaatactagtaatgttactagagtaccacatgaatactgtctcaccatcgttgatgactctatttgctgtttccttgaagtttgaggtgtcccagtttattctcccttttttatcataactatagggcattgggatgcctttagaaataactgtgcagtccaagggaagaacagacatgtatgtatagggatctgccaaataccagaactggttattatggccgaggcaagatattgggccaactatgtcgtattgatttgcaggtatgggatctcttgaacaaactacaagggtagctccctgcgattgaggaccttgaggtttgtacacagaagttgattggtttttcgacatgagcttctgaagtgggcagtgaggtgaggaatctacaggtgggatgacgttcatggtagcataactgtaacttatctcggttactttgcagggaccaagaactgggtgattgaggatggtgtcctgtccagagcatgacaagtgcatgccgggtgcgccgcatgatggaggttgtgtcgagagccggaaagggaacctgatctctggtccatgcttgctgcacctgtgtgatgagcaagtcttgaagaaatcttcatcatcccatgctgtggcggaagaggattcgtagttgagaagagagagtatgagtactgtgaagagaagttttggcaagtccatggagtgtaatggcgaggaaggcagatgaagagaaggccgtggctatagaaaaaggatcacctattgctatgatctccagtgaggatttatcctgtgtttgtcacgattgctgcgtctgtgagcaggaattccaactgccactgaaacttctgccgtgttgtattgcttagaaaggtatgtgagtatgtgaccttcggagaccgttcgtagattctacaacgtgtatatatttctgctagacgtgtaactacatgtaaaccagtagacgtgtactgcatatccaataaaccagtagacgtgtaactacatgaaactcatttatcttttgttgtcattggaactctcttttgttgtaactggaatcaactcgtgaagctaacttggtagagtaccatatgtatgatgtatccatacaaattgctctgttatacgatagtcgataaggcttgcctggggtagctgagtgactggtgatggtctggatgtaacctgtctacgttaataagtgcctccaagtcaacagcatcacagtcgtgtaggcccacggtgaatattttgtcgggatgactgaaggaggtcatccaatataattaagatggagagaaaaaagtttacaagaaagttgttcatcgacggttaactatcgaggagcccacagtgaatatattgctttagtattactcctacctcactctgtccaaataagttcatctctagcctctctcatgtcgtcttaaaataagttcatctctagccactctcattcatctccttctgcctccagcatggcgatcattattcctggttcgttccatcgctcaaccgccctgcgagtcatctctgtattgtttgtgcttgcagttgtcgtcccagatgcaggtgggcggcatcagcatcatcggcatgactgccttccgttcacctgcggccgtcttagcaacgtgtcgtctcctttccgccggcgaggtgacccatctggatgcggttttacatcctacgagctgacttgcaccgatgacaaggctacgattcagatctacgagggaacgtactctgtgacgggcatcaactacagtgattctaccttctgggttgtcgatgccaacatctcggattcacctaacacacttcctcagaggattgttccaccttatccaactacaaccctgaatactggttgccacaccatccatatcgagctggagcctgcttcaagtaggtggtcagcctttgtgaattgttcgcaggaaataaacaacaatgagaagtacaggcctgtcgcttgcctgaataataccagccgttccttcgtttacgtgctaattggcagcatatactcttgttatattgataatcttgagccttagtgtgggcacctggccattactcctttgcacggcaacgacacaagagtgctagaagagaatccaagctgcgaggatgtcgtcaaaataatgagaggtggattcgctgttcggtttccttacacgattgatgctgcgtactctttcaaggagtgcagggcagagacatttcggtgagcttgcgatatatcctgtggtttcattgattttcttgcattgatcccactagtgacctcgatcgtcttaaattcgttttgcatggtctttgtagacatttccgagaagaaccagcgtctagtgcaggcatcaagtacactatggcagacactgcgacgttcgacattcgttacatggcatgcgtaatccgtgtagctagattacctgcagctgtcaaattgttcgttctactaacaataatcgccatgtggcttctcaagtggattgctggtaaagaaatcgtgtatatatgtacttaaacagatgatccttattgctacattctagttttagattgcctagctttttatcctcaagtttcctgcactgtgagaattgtcttattggtatttccttggagtttggaagatgctcttctctgcacgctgtgctaaactttacatctttttgtgtatattagttgactccaacgcctagttggcaattcatattaaaatgtcatctttttgtttgtcattgccataataatttcgttactcagctttactttttttttagatgaatgaatttcgaaactcagcttcacatggtttaaagtcattattctcttctttaaactgttacagctagcggcattcacaaatgagatttgctccggtccaacaaaaagtaactcgaggtaccggtacttcacggtaccaaaacgttttagatcgttggatctagctgggcatgacgggcattgttag

SEQ ID NO: 67581 - DNA, 2815 bp, Oryza sativa
ttgagaaccaaaatgagttctactttcctgagtggatatatgagagagtaatcaatgggcaggaactggtgcttaacatggagacaacacaaggggagaaagaaacggttagacagctagccattgtagcgttatggtgcattcagtggaacccaacaaaccggccctcgatgacaaaggtagtaaacatgttaacggggaggttgcagaaactacaggtgccgcctaagcccttcatttcgtctgaaaatcatcttgcgacttagatcatggaaacacaattccatggtttagagatatgtttgatcgatccgtagcttgtatgtatggtgtaagattattcaactatattgtgctatcagacatatggtatatgtattcatgcaattctaatatcccgtggatttgatttgcagtgtgatagttaaaagatgataacttgattaccttattctgtcattgctaccagtgcactaatcctcctcgctgagcacacatttttcgtacccatctcatccccacactgccaatctactaactgtccttgttcttacccatcccatccccacaaaggatcctgcagcgcaggcaactgattatctcatctcatgttcactcctggtattgcataatttagaacagaaaaagaaaaaaaaaaagcagcacgacaaagggaaaaggggttaccatttagcaaggcacgagcatccgcaggaggtctcggagagtgtagaatgcgggaggggattagagaatatgattaaacgtggtatcgggcttgttagagattccaccggtcgctagctgccgcctgcggcgccattgaggaataaccgaagcaatttccatctgcggaatgagcggaggcgactcgcaaaatggcagactgccgcagcaagattaaccgaaactcggcgcgcggggcgtgggaatgtgggatggccggaggacggcggccggatgggtggggctgggcggcggcggaaggcgtagggagaactagtgtgctttatcacaggttgggcccgtccgtctaattcccgtggcccatgaagacgagcttcctgggccgcatccttcatgatcttccgagcccaacaggctcctcacaatctcgttagaaataagttcactggagatccctcaacttaacagcgagattttttgaggtcccttaaccggaaaaccagaaatcttcacccctaaactatacaaaaccgtctaatttgggtcccaagacagtatagatggctggttttgatgacgtggcatcctagtcagcaaaaataataaaataaatatgtgggggcccacatgtcagggggagaaaatgatgtgagccccacatctcttttttcttttcctttctcttctcttctcatggcttgtttggcaacttgagggaaggggattgggagtttacacgagggaattgatggtgagattaagatgtgaatttgatttttcatcccagtctcttgtttggtagaggtggtggaaattgataaggagtttagttggagattaaatcattaatgaaaacggatggctgagatttgtttaggcgaagtaaaggaggaattccctcccaattacctacccctacccaggtattgaaaaggagggagttcattcctcaatcccccatctccatcctaccaaatttctcatgtccctcaaccaaacaaaacagttaatagcctcatccctctaaactcccggtccctcctaaaaactgcctcaaaaccaaacagaccgtcagttctcacgcgcatgcgggcagatggcggccgacggcagagcggcggggaagaagcgggagatggggagaggaggtggacggcgcgaccgcccgcgacggcgggagcagtggccggcgcccgcctctccccatccggagccgcggcaggtgagcgggcaagcggcaacctcgctgtcgccagccaagccgcctccacggcgcggcgcacctcctcggtgcgacaccggcggaggatgcggaggagagcggccggggtggatgcgtgcgccgatgggagcgccgggagagggctcgacggcgagcatgaggattagtagggaagggtcgagcgggatggacgacgacgacgtggggctgtcggcggcaagcagccggagcggcggcggcggagagcggagtcggcggatgaatgaacaacacagctagattgatagaattgttgtcgctttttgtaatttcaagcaatcaataacttcgtgcgtgatggcaaatcataagaacgcaaccatgacagccacatcgatgtatatcatccgcaattcaattcatgaaatactacagagcgtggatgatgcccttacgcggatgaggagagggaagttgcggccagcccagcagttgagcacgtagacggcgccggcctaggcgcgcggcggcctccgacaacttccagtcccgctgccaccggttcccctccacgcgcaggcggtggcgcgcggggagcgccggggcgcccatgccctccacctcggcgcgggcctcgcgccggccgcctctctccccttctctggtgccggccgcctcctctccccctctcccgcttcttccccgtgcaccgcagagcccgcagcgccggcggccgcgcccgcacacccgcctgcgcgtgagaagttgagaagagaagagaaaaagaaaagaaaaaagagatgtagggcccacattattttctctcactgacatatgggccccacatatttattttattatttttgctgactaggatgccacgtcagcgaaactagccatctatactgcttgggacctaaattagac

SEQ ID NO: 67582 - DNA, 2103 bp, Oryza sativa
tttgacagtgtgcatgcctcgctgacgggtctggagtcgttcctcgctccaacccatattggagaccatcttctctattagatcaacggctccttaaaccgttttagagaagaacgctcctccagctgccgcgtccaggtgatcacgggacatcggggtgagtcaattttaaaagttctgcaggatcagccagtcgtccatcccatgatgaggacaagcggccacgtactcttgcagaccctcccatgcttcaggaatagactcatctcttgtctgctggaaacttgaaatccttccacgaagggcattggttttgcccatcgggaagaatttcgagaggaatgtcgtagagcatttgtcccaggtgttgacagcagcacggttggcatagaaccactcttcgctctcccgagaagggagaacggaaacagtcacagcctgacggcgtcgggactgacgcccttaatggtgtacgtgctacagatctccaggaactgttgcagatgagcattggcatccttattaggcttgctatagaacgggctagcctgcgccatcgtgatgaggctagacttcaagtcgaaatccacgtctcccatgttgatctgcggcccaatggccacattgtcagcagagggagtagcgaactcgcggagagtcttgttagccataatcttgaaggtcggtggtgctggtacggctggtttctctgttggtagagtttttttgcggagcaacgactcgcggcctgacgctccggaagaaagcttctggattttctttgaagttttccggcaagttgaaactagtcatgcactaccctgttttcacaacaaaagtgaaaacaaccaaggttagcctgcaaaggaaaatgattacacacaggtaaatataaagtattagttcaggtaatctctattatgaatcttccccggcaatggcgccagaaatgcttgttggtatttcttaacgtcattactagaaatataattcccagcaatggcgcagaaatacctctggtatattatggttacagagttcatccgcaagcgcacggatataccattgtagcatttcacccgagagtattccaagggtatcgtatttattttatcccgtggaaagatcatgtagagagaacttgattaatattttatatattacttgtgataattatattctaagcagggttaagataatccaagggtagagtgacacacaagcattagctactcattctcataatatattatctaagctaagtgggaagaagagagaaagaaaatctattcctatacttctaatatacatagtatacatgcattctagttaaccgatatactagctaataccctctatccgatgccctcctggtacttcgagaagccacccctgactgccgagttccttacgacagcccgtcatgaccatacaatcggggctaaatacggaggaataccctcctcaggaattaacttaggattatatacaggcgcggaggaatacccgtactgagctgtcatcatcagcggcccacctctcatctgtagcatataaccccaaataatgatatcccgtaatctagacaccatgtctaaactaccagatactactctaatatcatcgtcatgacatagagtaattgcataagcaaatattatacccgcaccaaagcatctcccagataagctagccatatattcaatataacatgaacataatgtaaagtaggtactcatatactcagaaagtatttcaataccataaatgtatatagaagagtattctaataaaagtacaaagcttacaaaagaggaaaggaaagctactagagccatacccgaactcttccgaaggcttccggactcctgatttctactctatttctattccaccagctagatactactaaactaaacttgagagaaatgagagagctcttgcttgaggtgtgtgtgtgaagtgagaagaggagctccttttataggcaggtaatgacggttgtgacggttggaatggttggtaataccctccaaccgtcattggggatcaatcccagctatccatccaaaccctgcatccatcggtgccacgggaggttcg

SEQ ID NO: 67583 - DNA, 4095 bp, Oryza sativa
cgaaccatgggctggcccaacccagcccatcttcggctggtggcctcctttgttgttctcctccatagacttgtaaattttggcccagtgtgtcgtgtcatttctgatttcttggcctattcatacataagtctggttctcaacatcgtccgattgatttatcgtctgtgttgatgtcgagtctcctccactttattgtcattctctgcaaaaggttagtataccctatactagtggaatattattattctaacagatatatgcattgcaagcatcacttgttctcctctattttggtaatattgacggtcgaaactgatcgataacgaccgtcaacaattatttacatgtgtgatgcgagcaagatttcttttatgtatactatgtacttagtatactcttcaaccaatggagaaacaaatattttctatcttaatttaagagaacattgtaccaaaaaagatatataaaactacaatattttccctatgacattggaaaaatattgtggtgacttgtacgctaaagcacaatatcatcttggatacctttccaacactatctcgtcttccatgttgtattgcctacttactgcttccgtagggtcccctctacttgacatgcaaggccttgcgatttgagatacattacacatacttggttttgtattatctgaagcaagtttcatcttcacttgcaagttttcaagtgtcatttacacttctctcattggctggtcttgacggttaaaacagcaggagaggctcctactgcgcaaatatattaaaaagagaacggcaaaatacaagggaaactgtacagagggaatacaacaggggggaagaaagaaagaagaaaagaccgcctgaaacgcaagctagttaataaatgctattaatccatgattgccacaatggtttttctgtctcctttactctatgcaaatgcagagtaaactcatccttgaaatcagccttccatttgccaaattttgcttggataccattgaagatcaggtcatttcgcctactccagagatgccagcaacaaattgccaaaacttccataaagaagggatgagggaagttcctatatgctgcaatgatcatgttcatgaaattcagatttagatcccagattatgccgaggaaatgccaacattgttgggcaaaggggcaggcaaagaagagatgaagaaagtcttctgtggtcgagttgttgcatgtaacacatgaagctcccccttgggtattgaaatgtcttcgttgcatcagctctttagtgtttaatctgtccaataaaagtagccaaagaaacactttcaacttgagtgtgcatttgcttttccagatgagagtcaagggaatttcaggttgaatatgggtgaaaaacaggtcatagactcttttcggttgataatggggagagttccaaatgtatgtccattggtcttccatatgatttgagtttaaagtttgaagagtgatagaaagaaggtggcattcctgaattgcttggatggggagaggagtataaaagatctcatctaagtgattccgagatttgaaacctttgatagatatgtccttatttttggcaaatgagaatagggtgctcagataatcctctaaaaaacgccctgaccaattatccttccaaaaaggtgttgtgtcaccatgttaacgactaaatttggtaatatatggactaggtttaacattggaatcaaggcggattcggcaaggagatggattcaaagaacagagtatgcatcggctgcgacgacatcggctggagtttgcattggctgagatggatcggacagaggacagccgatagaggtgatgcagccgatttcagtggcgatggcttcggagctgttcgtcgagttatcatatacacgttgcaatctttgttagttacatcatatagcttgttatcggctgattctcattgtcgggaagtgaccgatagtgttatgtttcgttattaagttagattatatcgtgtatctaccatcttttagagattttcatcatcttgcttagatcttatacttatttttatgcttaatgttgcatcggttaagttcgatctattgagttctatctataattgtgatatctagcctgttttatgattatcaagagagatagtatcggggtttcagccgatcttacctgatttagccattttatatcccctgtgcttgattgttatgctaagtctgccctttatattaagatctcatttcattacggtatattaggctttttgtttaatatattctgcttgtcttgatatcttagtatagagtggtatcagagtattagccgatacatgctagatctatctgatcggctatgctataaacatttatataatctttgctttaatatatatttcgacttaagtgatttatactgtctcagcatggcgaccgatctaccccaatcacttggtttaaatatgtatcgaagtaaagattatatattgttaatatctacggccgatcgagtagatttagttttatcttatttactcatgacagccgatcgattccaatgtgacatcggctcaaagataaatgatatgtcatcggcaaccagccgatcggctatcgtttatggatttaactatggttttcttgtttctttttcttgttgattgcataatcaaatcaactggcacgctcacgaacttaaaggcaagattttggacctgcacagaagttaagcagatctttcaggccagtgtgtgtttttcgcatcaacacaccaagaccaactttaaccaaagaaatggctcgaaaaattggagtcaatctgagtacatccttccaccaaaaggatcccttttccacatggcatgcgggggcagaacagagtttgagtaatacttgtcccaaatcaggttaacccatggcagatcctttttattgtagaacttatctagatgcttgagtagaagagctatgttttgtagctccaggttgatgactccaagacctcccttctttttaggctgacacaccaagtcccaagcagccaaggaatgaactttagcattaggatcccttgatttcctccaaagacagtgcattcttgccctgtcaatatgttgaataaccttctttggaagtttaagcgaacatatatagtatgtcggcagggaggaaagtactgagtttaccattgttaagcgctgaccatgattcaggaaggccgctgtggaagggagccttctctcaattctgtctactagaggggcaaaatcaattattctaggtttggttgaacccattggaagaccgagataagtgaaaggcatagagcctatgaaacagccaaaggtgcccgcaagaatttccatattttgctcatccacattgattgggatcatacaagatttatgaaagttaattttcagaccagtggagagggagaagatttgaaggagacctttaagacagaaaatctctttttgatcagctggcaagataatgagggtatcatccgcatactgtataatggggaatttcgcaccaggttgtgggatgggctgagacagaatgccagagtcatgagcagaattgattatagactgcagcagaccagctgccatgacaaaaaggaaaggagagagagggtgaccctgtctgactcctcttttgcatttgaaatcttttcctgggaccccattgagcaggatagaggtggaagctgaggataaaatgtttttagtccagtttacccaaatctcattgaaaccctttgctctcaaaatttgtaggattattacgtggtccaccatatcaaaagatttttcaaagtcgattttaaggatcacaatctcttttttgctttggtggcattgatgaatatactcgaaacaccatgccaaacaatattggatggtcctccctttcatgaaaccatattgatttgggtgaatgacgtacatgatgactgattggaacctatttgtcgtaatcttacatatgaacttaagggaggagttctgtaaagcaattggtctgaagtcatttggtgattcagggttagacttctttgggattaaggtgatgaaagagtt

SEQ ID NO: 67584 - DNA, 10166 bp, Oryza sativa
  unsure (1)..(10166): unsure at all n locations
accctccattccaccaattcttagtagtagtgactttagcctaccttgcatagtatattaagcaaggagttgtgtaataacgctgtgtaaggtaagaacagcttgcttgtacctaccttcgggtttcccgaaagggaaaaccatatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcatctggagaatcggtatccgtagagaagtgttcccttcgggtggaactgcctggggagacgataaactcttagctagaacaagtgtgacttggaatatctttttaagttgcttctaaaaagacagataggtgaggcatacggtgagtaccgagtaggactttacatcatctgaaacaagcttctgaggctgtctaaataggattcgccaccctgcaaagatcctaaagttaaaatatctctcaaagtgaacagtgttttttgatcagtaatttaaacagtaaactgaatagtgtttttgaatagtattcagccgaataaacagtaaactgaatagtattcagccgaataaatattgtacatatatgtatatgtatgtatatatatgtatatatatatatatatgtatgtatatatatatatgtgtatatatatatatgtatatatatatatgtatatatatatacatatatatgtatatatatacatacatatgtatatacatacatacatgtatatatatatatatacatacatatatatacatatatacatacatacatatatatatatatatacatacatacatatatatacatacatacatacatatatacatacatacatatatatatatatatatatatatacatacatacatatatatatacatacatacatatatatatatacatacatacatatatatatatacatacatacatatatatatatacatacatatatatatatatatatatatatatggcgacctctgattcatctttcatctcccgctctgngcctgcaaacggagcctgtttnncacgccctgggggttgttctatcgctcacccggcttaggtcattatgtcttgtgcctgcttgcggttcttgtcccagatgcangtgggcggcggcatcatcagattcagcttcagcctgagtgtgctacgttcacctgtggcgcccatctcacgaacccgttctaccccttccgcctgccacgtgacccgcccgagtgcggcgttgcgtcgtacgagctgacttgcaccgatgacaaggctattattcaggtcgacaacggaacgtaccttgtgaggggaatcaactacaccgatgctaccttcagtgtcgtggacgccaacatgttggattcaagtaacagttgccctcttcctcgctggaatcgcactccttaccgaaggtacggggttgtcgaagactcaagccgcaacatcgtccaagagctgatgccatcttattcgaccataaccgctgcttttgtgacttgttcgcgggaagtaacgaacaatgggatgtacagtcctgtcgcttgcctaagcaacagcagctcattcgtttacgtgctaactggctggttcgctaattatatcaagagtctcgagccttcttgtgggtacctggccatgactcctgtggcgagtgcctggctacatccgaatgcaagctatgcggatgtcgtcaaactaatgagaggtggattcgccattcagtttcctgacacaattaatctgtactccagtttcaaagagtgcatggcagagttacttcagtaagttttcaacatcgatcatttgtgaaatcattacagtactatttctcaatttaactaacatatatatggccttctcttataactgctggatgcatgcatcttaaattcatattgtgtgtactctgcagagacatccgtgacggtgaccaacccaagtctagtgaacgcaaccagtataggattgagctagtttcgttaattgaatatggtatcttgcaatgtgcaactcaaggctctagaccaactagagctgtgatggctatccaattgttcattcgcagaacaccaattgccgtttggactttgaagtgtattgctggtaaattaagaaccccccccccccccaccccaatatgcttaaacaaatgatcctcctataaggcgtcacatcaccaaattaaatcactcctagccaccactggattgtacatgtccaatctcagattatataacttctttgtatccttagctttgctgtacttggtgtcaatggccattgttttggagcttgcaaagacacacttatctgaacgttgtgttgttgtgctttaattttacgactcatactgctcgatattgctcttcccgttaaaatgtccttttgtgtgtgtattgttgccgtagcaatattttccatactctgttttacattattttaagctatatttcccttgttaaaatttttacaaaagcggcaattacttggatataacatgttgctcaaatgctaactggtagctaattaggctagtgtcacagtaacaattaatgtgtgactgaggaattatatatttacaaaatatgcatcactacaactaggtagatgctgcatcaaggcaccaaccatttaaagtttaagcacattcttgttataccaatgaactatctgtaaacttcccttttatgcagtatcctgcaggttcattttgccgcccttagtagtattgacctttctggtgcacaagtattggaagaggaggatgataatcgatgcagtcgagaagtttctccggatgcaactgatgattggtccgacgaggtatgcctacactgaacagggcattttcagggagaagatcggccaaggaggctatggctctgtatataaaggtgttctactcccaggtgatgtccatgtggctgtcaaggtgctgggaaactacaattgtaatggagaagagttcatcagtgaagtctccaccattggcaggattcaccatgtcaatgtggttcgtttagtagggttttgtgcagaggaagtgaggagggcactggtgtacgagcacatgcctaatggatccctcgacaagttcatcttttcacatgacatgagattctcctgggacaagctcaacgagattgcattgggcattgccagaggaataaactatttgcatcaggggtgtgagatgcagattctacattttgatatcaagccgcacaacatccttcttgacagcaatttcgtcccaaaagttgccgattttggcctcgtcaaactgtacccatgccacgggataatagttttgtgcctgttagcgctgcaaggggaacaataggttatattgctcctgagatgatatctcggagctttggtgccatatctagcaaatctgacatgtatagctttggaatgcttctgttggagatggttggagggcgaaggaactctaagcaggatatgtcgagctcaagccaagcgtattatccatcatgggtgtataattagctggttcaacaagagttgggtgaggtggtcactgcctttaatatgcatgagttggaaaagaagttgtgcattgttgggctacattgcattcagatgaagtctcatgatcggccaacaatgagtgaggtcattgagatgcttgaaggtggtgttgatagtctgcaattgccttctaggccattcttctgtgatgacgagcctgtgccacatgtggtgggttcttaccatttatcctcttggctaactgaaatctcggaggaggatgagtgataaagcttgtgtctgcttggaagcaaactcagctaactatttgcttgtaaaacgcagaagctagaaatgattgtaaacagtgaaatggttattgtacactatttatctaaaaaaaatatttacagacgatagaagttgtaggatcgaatcacaagaactaagccaaccagaggggggtgaatggttggtatacccaaaaaccgaaaacttttagcggaaataaaaattaccctcgaaatcgatgaagatcggtctgaccgaagttgccttgccggtctgaccgctaggatgccgccggtctgaccgcctgtacgccgccggtctgaccgccgcttgccgccggtctgaccgccggtagatcgccggttagaccgccgaaacccgataaacacaaatcgaagaactcttaaagtagatgacgactttattacttctctctgtatttacaaagtgcaccaacagcactccttacaaaaatttcgactaaactcgaaaccctaactcaaaactcaactcaattggtctctaaagcgatatcggaaagcctcacgccccccctctatttatacatgaggtaggcagcctaaagccacgaaccaaactcatactaggagtcctaaacaccttaggaaacccactagtacaagaaagaaactttacataaccaatcgtaccaaatttggactccttccaaattcgactccgcatcccatacgcacacaataactccatcgtatgccatatggaaactccatcaactctagcctaagtatcccgcatgatctctgaccaccacggacgtcgtcttatccccaagccgactcccggtccatcaccgcaaatactctcccgagatatcgagtcacctacacatggaacaaacaaagaaaccatattccgaaaccaagctatcttcaacttgactcattagcagcaaacaatagtattacatacgtataatatccatctagaagtcataatcatggaataaactcggatatctaaataaacaacccgaaaccgaaaccgacacagtgtcggctggtcagaccgcgggcagcgccggtctgaccgcgcaatacacgccggtctgaccggctaccaaagcccggtctgaccggacccaaatccagcagtacctgtatattcacctgtgaaaaccaatcatctccaaaaccacttcgtgaataaattccaaataacaaaaccaataatctccaatgcccaatagttcatcacagaataataatcaaaaacacctttgattttacagttgtatcttagaaagtgctacagaatcatttctgaagaaaatgctacttaatccatttctaattttctctgtcatttgctggggcatccggatcactgcaagcctggagtgtggactctggaggtcagtgtggatagcggcaggaggcagtggattgcctttgactgaccggataatttctttgccgtgaactagagggagtatttcgtttatcataatgttgtgactgggatgccatggttaattatgacacatatatgtgtggcccattggccaaatgtgttgttggccggcgcatttctgtggtgtgtgtgctgcatgagcactccagagctcattccgatagtgatggtcaagtctccgagacacggacatatgcttttgctgaaaggaaatgcaacgatttcgatttggacagcctagtgcctgtgtttaccgctgggcatggtaatccgatatatcaatgatgcatggtaatctgatatatcaacttaacatctcatgcatcaatgcatttgcttaaaaaaaaaaaacttcacgcggagctcttgttttgtgtcacagttcgctgtgccgaaagttagacgtgaaacattttgtttctgactcactagcccacattttcatacacttaatttttaagcttaacttcaccatgcttacgggttacaaattgttagtcctactttatataacttgccacatctttaacaaattggagtgaggtaaagttaaccaacaaccaaacagcaaatcacctgaacagagtcgtcagattaggcgcaccactgccgcactgcgttctgtctctacagccttttctgttggtcatctccgggcctaagcctaatattttgggccgagtaaggcccacctaaactgcatcgcagcccactacgggagaactcccccgcacttcccatctgccatggcaacctccgccggtgctccggtagcggccggcggcggcaggatcgctctgaatcgattctccgtccttgaccttatggcgtgccgctgcccgctgcccgacggcgatgccccaccggccaccgcaccacatctcaaaccggtgacggtgagggtcgtcatctcatctgcgcagcggtggccatccgtattcgagatccgcctccgcctccatggagttggattattcgaatcgatggataatccgcaaacacacgccgtccgatcaatgatttggtgggccatttgcatgcctaagatcagctgcagcccggcccactactcgtctctttctcggccacttccttcgatgggccgaaatggaattgagatcaaaggtattgttgggccagaacaggaacgtgttgggcttgtccccactccccatcgttctccccaccatggactccggcaatctgctgctgctgctgcggcggcggcggcgccaaaaatggcctgaatcgacccgacttgcagtgcagcatcattcccatggccttgcgccaccgcgtgtcgcttcccgctgagcgcatccaccggtcgagttcacctcgcctcgaccccacgcttcgccgcaggggatctgtgtctactaaggcctccacctcctcgctcttgttggaccacgccgtccggcgatggaagcggcggcggatctctatcccctccctgacattgctggaggtatttattttcattttattttggcgctttactaaattttgtaacttcacgagctgaactcagtactatatcgatccttgtagattttcagcagtagcatggcagtatggcacggttgattgcctgccctacagatttctcttctcgcatttccttctaatatccaggtcctggctctttcaatggcatggattggaatatgcaagcaacaatcgactacttcttactaactagtgagatctaattaacttttcagtggcaaacagacgatggtaactttgcttttctattcagttttttctaaagataaagtgtgctcaaacccatttcaatgcattcactcgataacacaaagtttacaattaccttgcaggattctcttatgaaatttccaccaggtactgacccatgaaaaggacaataagagtatctgactaactagtggagctaggagtacaatacatcaggagatacatcacagcaactgatgaacagaggtaacagccacaactgaaccacaatgttgtatttctacttaactgcaatacatgttgaagagtgatcccctcagatggctaatccagcggaatcatcaaaataaacacaacgcaatttctaggccttactatatgaaaacatgtggattaactcccaaaaatttattcagtcatggtgttgtgctctccatgatttatggcataggatggctttcatacgaaacaaatggcttagggggcacctgtatgttctgcaaccttccagttatcatgtttacgacctttgtcatcgagggccgatttcttgggttccactgaatacaccatagtgccacaagggccagctgtctcaccatttgtttctcttcttctgtcatttccctactaagtacgaactcctgcccagtaattactttctcatagatccattctgggaagtatacctcattttggttcttaatacttgggtcccagctcctccttccactcaccatttctaacacaagcatgccaaaactataaacatctgacttgtatgatatctccccaaagttcctagaatatagctctggtgcaatgtatcccatcgtgcctcttgctttggtcatggtaacaatgctttggtctctcgggcacagctttgcaagaccaaagtccgaaatctttggactgaagttatagtccagcaagatattatgaggcttgatatcaaagtggaggatgcgctggttgcatccttgatgcaggtactccattcctcgggcaatgcctaaagcaatatctagcatcttgtttggtgacaggagctcttgaggagtattatgatcatgcaagaatatatatttctctagtgactcattaggcataaattcataaataagagcacgccttgttccttcggagcagaagcccaggagatggataatgtttgcatggtggattcttccaatggttgcaacttcagtaataaaatcttctccgtctcctgtagggttctctaacatcttgactgccacaggcactccatttagagcttgcctttgtagacagttccaaatccaccttggcctactttttccttgaagcgtcttgttatcttctttacttgagagaaagtataccttgtgggttttgatgtgccatatgtcctgagaaacatttcaaccttcaagtgtacctcttcattatacctttgcttcagggagagatagagcacagtagccaccaccaatgaaacagcaacaaatgcagctactgatgttgctgagtaaatagaataagaacagcatattgcatcaggacagaaaattatcccatagtgagtggcttatcttgatgggtataaaagaacgcagtgtctttttatcagaagaatgtagttagagcagccatcaacaactattttatctgctacagataactttgtttatttcatttttttcttgtgaataaaaagataggtttgcttaatcctgccttcctccagttggcttatttagccatgtaataacgactattgctcgaacactttgcttctccttcttaatatatccagcagaactcctgctgtcacacacacacacacacacacacacacacacacacacacagaggtttggattgcaatagtacctgcaatgactttgacgcgtgaacctgcaaataccaaagcagacaataagatctatttgatggtttacaggtaaaatggaaatttactcttgaaaaaatgtaaacccagcatagacctacgacattgcagaaaaatatggaccctgtgggatatcatagagttttagttttggggttacaattgtactttgattatgcaaatatatatgtgatagataacttctcctagtgtgtgtatatctgattgtgcaaaagctcagcacagtatcatcaactgcagtcttctgtactcaagacagcagaatcatgattatcatcagaacatgtaagattagttgtgttgtatgcttacttaacttttagattttctaattgtaggagtcttttgttacttaagttacttttgctttcgggtccttttcattagcagtacaatggtgttgtttgtagctgcatatctatgttaagatgtaaatttataatcattgtgtctgattgttgctagttgagcaaacattattctccattggccacttcttttttgagatatctatgagaattgtaaagaatgattaaatagttacagtcacatattcaaatggtttgtactactagtttgcaaaataattttgcaactcatctcctagaagtttcaaaaggtagtactgtatgggtggatcaaatgcaagagcttaactattgtaggaaataaagctatatgtttgtgggtggttattgttagaatggtaccgtgatgcatgcagaatgtttgattcctttgtgagctgaacgcgcagcgttgcccttgctgttcacaccgcgtgcaattgtagggaatacttccgagaagcaaatcaagggtgatctcagcagagttgattatcctttctgccatttgcttgaacgttaaaccagccgtgtatggattggggattggaatgttgccttttgagacgaccatgcagtccaatggaagcgcatacaggtagagccgagtagacaccaaatatgagaagtggcttgtagtgtcccttaggcaggggatcaagcggacaactttatcggcaataacagtgttgtagccgtcgatcatagaagctctacttgttgtgaactcttttgaacaacgcactattctcccaggttcagtgaggtataattgattctgatcgttgacatcagctgatagatttgtggaattgaacttgtgaagcagcatggagaagatgaacccccatcgggatgatctt

SEQ ID NO: 67585 - DNA, 4913 bp, Oryza sativa
  unsure (1)..(4913): unsure at all n locations
aggtgggaaattttattccttctgtacctgtcagtagcagaggcttgaaaaaaggagggattttcatcaccaaatttaacccacctagcagtatatcgtttcctccaaaactcatttttgtatttcagaagaaccaagatatgattctttagaattgatctaaagttccattcatgaataagaagaggcctttgttcctcgatactgtccaaaaacaccagaacttcattgcaatttgtgattagagtgtgcaaattggatagccttttactccaaaatttcagctttcttttgagattttttagttttccattcaggattactgtctgattagagcttctgacattagtattccatgactgttgaacaagatcttgaaaacctggcatatctacccaaaaattttcaaacctgaagaggttggctctaggaactgaggtttctatgctgattagacatggagcatggtcagatatgtattttgatagagcagtagctgaagtgtttgggaaggctaggttccaggcagtggaggtgaacacccagtctagttgctgtaaaagaggttgatcttgcatattactccaagtgtaagccatacctgtgagggggatttcagtcagacccacattgctaatgatctcattaaaaagcataatatcatttacatctccaccaggaaggtttctatttttaactgatcggatgaagttaaagtctcccatgaaaatccagttctgattcaaatccacttcgaggttatataaccaggaaacaaaattatttcgtaactcacccgcacatgggccatatatatttgtgaggttccaggtttcatgtcgggatgaggttgaaaaaactgcatggttatagcaaaggggagacaagaaattagagtgctagtaaggacactactattccagattatgattaggctacctgaagcaccagaggatggctgaaaaacaaacttgtcaaagcgtctagggcaaaatttttgcaggtaggaatggtcgaacacttcttttttagtctcttggaggcaaataactgaacaagaggattctgcaattttttcagataaagccagccacttgtgggaggagtttattcctctgatattctaacaaaggatgttgcaggatctgttgatattgttattcatgggggtagaactgaaaagagagatttaccgacgcagataactatgaccccgcaccacaaactccactgaacattcagagaaaaccctttcatcaaaccgagtaaaacatcagaagcacaacaggagttatcagtagacaaatagcagcaacaagagttccaaagccatttcacatagcagtagttccataaccacaaataataagggctccagcaaaagagaatagctaccctattacatagcagagtagcaaagctccacagagcttgattattacaaccatttggaaaattcattttttgggctgagagagtttgtcttcagctacttcctcaggaagcagcccacaataatccaccccaatcttctgcagctgttagaacaggaatgggaggggggagccccttgccggcttcaaacttgaatttcttgatgggctgcactttggatttctttttgggcacatcaaaggccaggtccatcttgtcttggcccaggaatcttgggcttctcctaaggtttgcagaggtgattggcacctttggtctggattttcttggcttgggtgtgattggagctggttgagaagcctcatcaataactgaaaactgaagtgctctgacaacagggttatcaatccttgaagtcttttgtctcttggctgggctaggactgtcaccaagagcctggaacaatgaaaggttgactgagatattccagcgagtagagacaagggaccatctttgaaacatggctacagagcggcatagggggctgacatgacagcagaaggggcttaaaatctccatttgctactgccaaacaaaagacctcaggtagcttaatgataggcaaagtaggaattgggagagcatagggaatgatctgctagcccaagtgctgctgctggtccaacagaaatgttgagattgtgccctcagaggaaaaatcatgcactgtgatggagtcttgctgttccccagggataggttccactaacatatcattttcatcctgttgctccctcatatgatcaatctcatgttccagcccattatggttatgcttgatatcatgatttgcattattcccccagttgccttgatgcttatgctcgttgagatgagggtttgggggaatcatttcccagatagttggaaggtcctcatctccaggcagcagatcagtgggctccccctagagaacaaaaacatggaaggtccaggactgaccttggcccccataagccatggcgtcactcataaccagtttacgaggcatatcactgacaatcttatacctggctttcaccaaaaccctcccgagaaccctgtcttgataatgccagtctatgaattccccaaaaggttagtggcttgaacaatgatttgtcgagttttcatatgaagcggaatcccaagaaacattagccaaccttctctagtgaaagggaaattatgccagtttgctaactgatcatgttttacgaaccaagcatggaaccaattacccaagagaacaggctcactagcaactagaacatccctagccagggcggaggagagttgcacaatgcagagagctagtgggtacctttggatcctaacaacatgcatacgatgctaatgctcaataatatttgcaacttcatggatcaactgaccgagaaaatgcacagggggctagggatcagtgactacggcagcaaaattttcatgtgtcctgtgcacagtaccttgaaaggtgaagtcggcccgaggcgagcggccattccaggggatttcgatgttggtgccgtggggaagaaacagctccggccggaactcggcatcagggaggttcgccatgggagatggagaaggaagcaggagatggttttctgtggcggagggagggagatgacactgtttggcaggggaggtagtgggagagagaacggaaggcgaagcgactgaataaggaatgaggtcctttgatttctccgtgaaagtttccgaggcctttttcctccaaaccttcctaacccgcgaaaggcaagagtgggccaaatgtccataattgtggcaggccttacagcggaaggtggatcgacaattggtgctagagagacctgaggaagagcaatctttcatacgatcaaacgaagcaccattagcaagaagcagtctcttgaacactgagggtttgcccacatgannnnnnnnnnnnnnnnnnnnnnnngaggcataagattgctgaaacccagaaggacgcttgtgcttggaaaccaaggtccattgatttgcttcttctaattgccaagataagaattccttgcgccaattcggaccaccattgctccataagaaaaatctgacatgaaaatccttgccaataaaattacgaagagaatagatatgaagccccacccttttgttgcaaaccaggaaggataaactgttacccttgagatgatgaacctcaaaactgtgaggagtgccaccaaggcaggattaaagagcaatggccaccaatttagtggtgagacgaaaattgaacctcacaaaatcaaccaccaacttgaaaggggtagagcctaagtggggagagaaatgaataggagaactgaaaaaatccagaatttgggattcgagagccttgccatagtcaattccaaccttccgggggagagggagtaaccagagcatcatcgtcccctcccctcccatcaagtttatctcttaaaaaaatagtaagtctagcatcatgttatattttaaaaaccttatccatcggctggtcttgtccattcaacttagtacacattgccgctagttttgctacttctttgatacttatcttcaccttccataacttgaagatctattatttcaaacaactttctttctcggagtagcgacagaaaatgtaaaacaagactatcaccattcatcagttctatatgtgggctagttttttctagtaagcggttctataagaagaacaccaaaactaaaacatcacttttatctgtgttagacaacgtgtataatagtacatgggatctaagtagccaattgttccttgaatgactgtagtcacctcagtttgattaatcgggatgtaccttgaagctccaaagtcaaatatctttactattaaattgtcgtagaaaagtatgttggatgtcttgatatctcttatggaatattggtattgcagtagctgagtgtagatagaccaaagctcaagcgacttcaagaccaatccttactcggtcatcccatgatagagaaactggcccatcagcatgaagatgatgatcaagagatccatttgaaataaactcataattaaccaataatggaacttctatacctcaaggcaaaaacctagaagctttacggtatttcaatgattaacttgagaataaattgcaacttcatttatgaaatcatctatttctctcagcactataatccttggtttcttaatggaaacaacatgcaagtcatgagttttatcaaagtagcaaccaatgatttttcttaaaatatctctctttcatcttctttaccttatgcaactttattttgtatcttatgaaggggacaacaagtgccagaattaattttgtatgtttgcaacataatgtagcacatgtgttttgtttacaaaataatgattgtttcaaataaataaatatataacaactagaggccgattttctagtgtactatactaagtgggggcattggccctcgcactt

SEQ ID NO: 67586 - DNA, 26546 bp, Oryza sativa
  unsure (1)..(26546): unsure at all n locations
ccacttagtatagcacttttctcccttttgtttacgaagaaaataaatagttagtagcaatatatgccttcactagacaatattatgttcgatgccttgatatctctatgaaattttagtgattgtagggtctgaatgtagatagatcaaggctctactgacattaagtgcaatccttatcgggtcatcccatgatatagatattagtccctaataatgtgaagatgatagatccatttaaaacgaattcataaactaacgttgtaacttctgtctcaaggcagcatcccaaaaacttcaccacatttctatgattgacttgagaaaggattacaacttcatttataaaatcatatatttttctctacactacgatccttgattaatttcttaatggcaacaacatctatgtctaatattcctttgtatacaatgtcatgtcctccaccgccaacttcacgagttttatcaaaattacccgatgatttctatagctcctataacgtcaagatcatttttttcaccaatctatatttcatttttttcaacttatgtagttttatatgtgttatgaaaggtgcggcaagtgtcataataaaaatatttacgtcacctctaactcctaatctgatggtgaaaccaaaaaaaaatcataaaataccaaattcaggaatttctataaataaacatgcataaattagcagtatatacaatattgttactcctttcatcatctcataatataaaatgatttcgtgataccacctaccaacttttgcaatagtttatattgaaagtgaatgaaatcgattggagcgagagagaattgagcgatagaaattgtagagtgaatgagcgagaggtctctttattgatcaatgcggtacaatatatatagaaggggaaggggtggcaaccgtagacatgatggttgggaaccatcgcgtccgttgccaaggtgcgccgattgggaaagaaggcgcgattgccttcggttgctatcccatccttttacatggatgaaatcaccaactagttatttcataacactcccccttgatcgaattcactttgatcattgctcatcaagtgttctagatatctgtagagataatcttagaaataattatagttagtatattaaatacatcacgtaaaactcctcaaaaacccagcgggaaaaataaggagaggactgtgatatataattgactacttttagatgtttatgagtaaagctcatagtatgatccaaaaatagtataatgtctacaattatcttgttgagcaaccgggttttgggttttgggccttgtaattgtgttgttcaaaagccagatcgagttgtgtcgcgactccgcccaaatcgactgtttatccatacctatcagaagatcaagacctatcttcttcatcagttggtatcagagtacagttacccattaggtaatttatcgtccctattgacgaaaaaatcgaacacaccggcctaggatatctgcttagctcctgtgcaagtccaaatcttagtgagatgcaggcatgccagtcagtttggtcctgcaactaacaagatatgcaaatagtagatcaaaacagccgatcggctgacaagccgatggagtagttccagccgatagccgataatagccaatgccgataccagccgatagcgatagggttttgtgctatcagctatatgtccaatgtagataatgatataaaggcaaccggctgatgatgatgtaataaaataacaatataatccagtataaaccaatcggcaaataatgatatgataaataagcatcgatccgaaggttaaagcacacatcggctggaggtccgatttcatgaaatccacaagattagattaaacagtgaaacctttgttgtcatcggctaaatccaacttatatgtatatgcaatccttatgagccgatgcaacgtccagataactcgccggctgaaaccccgatgaaaccctaattggcaatcaagaagcaggctaaagattatggttctaggcacgacttagtagatcaaacttaactgatacagcactaagtatgaaaagaaacataatatctagacaatcaagccgttgactgagttttcagggtggtagatgtctaagctaatctaatctagcaacgcgatttagccgataccggcagaaactctaaaacgagaagcagccgatagagctaaattgatatgctaagactagattaacagagacatatgataaataggtaggcaaatatatcatccaaaccagagcaatccaagaggtcgaatgtactgatgcagccttaaacgacgccgacgtagacgatacaattgcctagaccggcgctacattggacttatcccttcgccggaacgtaaaaacaaaagtagaaataaaaagggtagcgatgcgccgaattgtattgatcgtagcgatagattacatagactctgggtgtacatatttatacccatgggttgatacaagtccttgccggacaagaaagaaactttcctaaagataaaaggaaaggataaagtccttataggacactaaacacactttcctaaagataaaaggaaactaataaactattcctaattaatagataacttgccattccgcattctctttgaacttggtctcttctggataagcttcctttagtagatcaatttccttaaccgaatatagcaagaatccgacaactgacgacttgacaactctcatcggctaatctcaggacttcgaagccgatgctgactctaagccgatgactactccgggcttaccaaatttcactgttaacagtcccataaccaaaaaattgccataaaaaatatttattatttacctagacaatttgagccgttgcattgttctattagattttgctatgttgaattctagattgcatcgtcatgtcaatgctagtttagttttagttttagattttgctttgtcgagccaaggagacatagaggagtgattgggaaaggaatcgctgggagggagatgagtgggggcggcagagcgagatgccggagagggagccgatgcgggtgcactcgcacgagagaggtgcaatgcggtggggccggcagagcgagatgcgggggaaggaagatggacgcggatgcagaatggggtgtggatcaattagattagatcgaacggttaggaaaaaaatgatgacgtggaagcaccaggaagcagagaatttctagtagtgggatgatttgtgtagctatataggattaaactcccaaccttattcacagatgcatgcgctgatgccgtcatgcgcagctcagctaactagcttaggctctagctcctttactttccaacgaaaattgctaggaaaggattttcatttcctctcactgtttgaaaccccacacctcagcagaagcatatgttttacgtgggtggcactgagtatatggcctcattgtttggcttttttattttatttttttcatctagtttatattacatcatttgcttttgagtcattgaggacatgtatacaaaatgtttactcacaaatgatctttttttgagattgaaaagaaactaagtagttggaaaggtaaatatatgccagttggggggagactaatgttgattaattatatgtttatgatttctttttttaagatttcaaaatgagttcttcaaaaaaaatgattattatagatcatgcttctttttggcaaggagatgagcacaagaagaagtataggcttactagatgggaaattatttgtcaacccaaacatcaaggtggtcttggagttcataatcttgaaattcaaaatcaatgtcttttgagcaagtggttgtttaggctcataaatgagtagggcatgtggcaggtctattgaaaaggaaatatctttataatcgatccttaagtcatgttgagaagaaacaaggggatttccatttttggtctggtcttatgaaagttaagagcaagtttctaaatatggggtcctgaattgtgaataatggtgtaaaagtgagattttgggaagataaatgggtagtgaattattcttttaaagataggtatccatcgttatatgctatagttcgtaggaggaatgcttcaattgcaaatgttatgtcttctgtcccactgaatgtttcttttaggagaactttagtaggaccgaatttaaacaattggcataatttatgtgtgcttcaattgttcatattcatttttcagaggagaattatatttttagatggaatttccatcaaaatggtgtattctcggttcggtctatgtacttagctttaattaataatggcaacattgagagaaataagattatatggagacttaagatgcctctcaaaattaagatttttatgtggtacctacttgaaagttgcttttctccccctagtgggttttggtgattaatgatgaataaggttaagggactaatgagtttattgagatattcaggtgattagtcccaagaacttaggtgatcaagagatgcttggagaccccctacaacattcattcaagcggatttgaagcccgaaagtcaataggatagtttcatatttgaaatcgagttttaggaaaaaccgtactattaagaggggttccaagtgtggttctgggatataaaaagtaggggtgggcaaaataagaccgaaccgaagaaccgaaccgaaaagaccgagaacgagaccgagaaattcagttagtagttcgatctcagccctcaaaagaccgaatttttttcgggcaattcggttattagcttcggttaaccgaattaaccgaaaaaaccgaatttgtggcccaataggcctaggaggcccaataagcccagtaaattgctaaccatagaaatcacacgcggcgccctcaacccatccatcgcgccgcatcgcatcgcctccgcctccacctcagatccccatccatcgcaccgcctccgcacatcgcgccgcgccgcctctgccggcatccatcgcgccgcgccgcctccagcttgccctcctccgccgcggccccgacgagcactgcctccagccgagctccgccgcggccctgacgggcgccacctccagccgggctccgccgtggccccaaccggcgccgtcgtccgcctccagccaggctcgcctcggcgccgtctccagcttgcccacctccgccgcggccctgacgagcgctgcctccagccgggctccaccgcggccccgacgagcgccgccgcggccacgccaccaacccttgccgccgagccaccgaacgtctccagcaaactcggtctgaccaagaccgaaaccgaaaaaaccgagaccggatttgtcggtcctgagtttttctagatgaaattcggtcctgagttttcaaaaaccgaaatgaccgaatgaccgaagaccgagaccgaatttttcggtcagaccgaacgcccacccctaataaaaagtgctcttagtgggttccaagtggtagaatattttttaggagctatttttggaaatggctctagcccggatagagaaggctggccggaagttccggtccctggacccggaacttccggaccttgcgagttgaaaattttcctaagtgttgtccggaagttccgagtgtcaggaagttccggactccttccagttcaaaaatgtgagtaacggctagatgacgtcacctagccgttatatatatctagatcgcacccagctcaccttttggccatttcacttcatttctttcatgccctaggttcttctagcctctcccaagatccctttgcttcctccactcaaatctagagccattcttgtgagattctgagaatagatgagagtgtaggagtgatttggagaaggtttgaagattaggtttgtttgagcactttggatatcttgtgggctgtcacttgggcttattactcttggagatcttctcctagacggttaggtgtcgcctgcgagcttccaaagatcttgtgaatgtcccgggaaagtttgtgaaggttttcctcacctccgcaaggaaacgaggtaagtgattaaagattcttgtgctgagtttttagaggttctcctaggtagagcaacttgcacttgtggtcttttctagaaggatttgtgagttggatcttggtggtcactcaattctagaaaatgacctaggggtgttgagttgaaggcattggacttcttctgagatctttgcacaagtgaggcaaggggttaatcgagacccggctctttggagcacctcaacggagagtatgattgcaagatccgaacttcaggaaaaaatcgcctttgtcctctctgtgatgattctgtgcatgttgttgtgattgtgtatctgctctgtcttcctgtagtttaattcgtgcaatttagttcaagtcactgttagatcttcaggtttttctgttgctcggaagttccggtggttagaacaccgaaagttccggacagtctgagcagaccggaagttccagtgttctacaccaggaggttccgggcctgctgaattttaccgttgcgatttgtttgtgatttttcggaaagcctattcaccccccccccccctctaggctacatctttgtgcgttaactacttaaaggggttgctctaacaaaggacaacttagttaggagaaattggcatggcagtttgaaatgttgtttttgcatgagaaataagactattcagcatttgtttgtggagtgtcactatgcaaaatttctttggagagctctacaatttactactggtttatatactgctcatagtatacctcatatttttgagaattggctcatgggagttgataaaaaaatctaccaaacttattcttgttggagcatccgctatatgttgggctatatggttgtgtagaaatgatatggtttttgataaatcaccatttatgtcctatatgcaggttcttttcagggcaacatactagctccaatcttgggctcaactactaaagtgtgatgaagaaatcaagtcagtgaaagctgcatgtcgtaatcttgagtcatggttatgcagctattcgctaactttggatggagatccacaaataggattcaataatttttgtgatttttttatgttgtgtgagtttttattagtttgtgtgtgcttttatttattcaggtgtgagtttttattgagttggtgtaatatttgactgtatctctttgagcaaaggccgggattatattccattatctaaaaaatgatctttttttttgttaataagcgattcggataaacatatgaataagcgaaacaatgggacttggttgtacttacatggattgacttcttttataaaagagaagctaataaattatggagcaaatttaagaacccaatgttttatggttgaaattgcacaaacccaatgtattataatgggtggcatatatataacctaagctgttatggtttatggttttaaagttttataaaaccctacccaaccctaaatatttacttcaaattttacaatttgaaacttttagttgtcaacttcttatcaaggttgttggtctaactaaaagaaatttcaataaagatgggttttgtgaaacatttcagatatgccttaaaatatagttttctgtaactccaactataacatacggagttttatgaaatttactatttttttacggggatgaaatttactgattaaccataaaaaaataattataagttaaacgagagtgattatacatgtcttgctcgaaaagatttcgagagttgttcggagccattgtttcgcttattatatttgcaaatgaaaagtaatttataaataaaactttcacatatgtgttcttagcgatctaaaagaaaatgctgaaaaataaacttcagtgagaaaaccttaaaatcatctccaaatttaaggttagaaattcaaattttgactgataggcataatcataagcgaaaagacgagtcccgtttatgacgcaatacaattgaagcagtataacacttgttacgaaacagtaagtgcagcgatttgtataccatgaaccagcatttgaatgtcttcgtatcataatcttatacggcattctatcaatcggtatgaacacttcgtgacatgaaacgctaaggacataaggacatgtttgacagggcttcaactccacctcttttagagctgaaacattaaaaaaaatagagcagggttaaggttgcgtcgcaactctactttggagaaataacacaggcctaaaaatatcctaataggattttctcctgtgggtgaacatgtaatcggacacagctaccattccaaaagtgtatatataacttcccaatgaaattatggccttgtgttgaattccaattggaacaagtttactttaggtccctcaatttgtcgctgagtttgaattgaaccataataccaggtatagcccatctccaaactcgcaaaatcgtgtcaaatttcatcccaaggcagtatagctcccggttccatccgacgtagcattttgactccggttagctgtgttgagtcagcgtgggacccaaacaagctccacatatcattagccaactctttcttcctcatctctctccttctctttgccatcctcaccaggtcaggagtcaggctgcgggcaccatagataggggcagtggtcggcatccggcgatcagtagggagaagggcggttggccgctggtggcatggacagggaggcggtggggtccaccttgagccagcggtaggtgatccaagagaacagtggcgccgccaagcaggcaccccacttccggttgggacgatgttagcgatgtcgtcgccgagggggctagggtttctgacgggaatacatgttacatttcaggagccagaggtttagtagaggaggtggtgtttgtgttgctgctacaggcagaggtcgattctgtgcttgtttgtccgacgtccgtgtcgggccatctcgatcacctcacgccgccttgtgagttgaaattttctctctgtcggccattcatgttttgttttggaatttttgctcgatagttttttgtgatttctgatttccctgtgttagcgatactaattgctttgaccatataactgaatggtgccatcaacatctagttcgtatatgacatttttgtttttgcgctcatgtggtcgcttcaattaagtgaaagcagggatgtgtccttaacaattgtctttcatggcatttctttcctccgaaagcactgcataagaaaaaaaaccaaacttttgtcccatgtgatgtgttagtatattgctgatatggtttgatcgatgtatggcaactcttggcagtgacactaataaatgaataatcaatgtttgaataagatgcacacgcgggtaaggaacggtactgtagttgtatgcagtacttatctcttgtactttggacttgaactaggctggcttcttctggtatcatcacttagtttcatgtccactactattagtcacatggtgcattccgatgtttgttattttcgcaatgtagttttctgagcattgacctagaaattaaacaatccattatcatgtagcgagccctggattttttttacgggtaaaacagcaggagaggctcctactgcacttatattaaaaggaggaaattcacatagagaaactataaggggaaaatataaggggggaaaagaaagaggagactaaggtcccattctttttcctaacaagagttgaattgaagattaagattttcgtggcactcttttcaaactgctaaacggtgcggttcatgtgaaaactttctatatgaaagttactctaaaatatcatattaatctatttttaagtttataataattaaaactcaatcaatcatacgttaatatcacctcgttttgtataaaaaaacttaatctccatcttcatcttcattttcagtaaaaaagaacaccacccatgaatccatgattgccaagatggtttatctgcttcctttactctatgcatatgcagagtaaaattaccctagtttggttctgtaaatgtaaacaaaggagaacccactgctttgagatatgatcatggttgttcttgtcttccctaatgaatctactacacttgtatttgttaggtcggaaagatgaggaagggactacatcctcagatgcagtatatctcatatgtgacttagagtggcaggctgatgaacatcatgatgaccaagatcagccacaccggcaaagtgcaccacatgagagcgaagcatcggatggctcagagcctagggcagattgccaagttcaagcgccgatatgagctggaagcagaggaaaacaatggcaggtagggagaattgcgtgtggaaaataatagtagatgttgttggtggtaggcgtgtagcatgtttccgtgctatcaacataatgtgtgatccccacgtttactttgttatgctttacaccatttcgggttgaagcttgaaatttctgaatttcagttcgccgccttctgctgtaaacaaaattaagaatgtagacattttcctacaatgaaatccatttctactgatacatgatggaatgactattgtactggtgtttggaacccacattttccattcagtgttttggagtatttacaacgctgtggctttagcttgtggcttcaatccccagttatgctcgaatgcttggagtagctcttcaaatgtttatcaatgtgtcttccacaagacacaggtgtgggtgtcataagagagaggtgatccaaaggagagcaaaaatggaagtgagcgctgccatggatctggttcgccctgctgatccaagatgaaagggaattgaggaggatagggctccgttggcggaggttggcaatggagaaaaagagtgccggttgcattttggtatgggaaggagacgtagccggttgtgatgagagcaaaggtctcgctcatgaggtgagaagaggaggggataacgaagaaataagggagaggttttctatgcaaggtttgctttataatttctgtgctaaaacttttagtcagaagtcaaataaaaatatataagaatttgatggaaagtagaagagctgaattacaaaattatgtagggcctatctagagttatccaacattgtaagagttatatctctctacatgattttacctaagtagcgcgcctttttctcgtgagggctacaccacgaaaccactttaattgtaaatattgtatactcttcaatctcaaggcgtatggtccataggcaataaaaatatctacatcaacatccattgaacatattctatctccttgatccatatttctcatgttagtgttaatatactctatctcttttgcaagaagagttaatctatttaatattgtcacttcttttcctagcaatctagcagtgaatatcgtattcttctctttcttcccatgatataagcagggaatgtgaaaacgagctccaccagcaatgttgactcaagcttcgtaccagtaacaacaagccagaccatgaatatatcatctctagtggagtcacgacacgctctttctcaacgagatgtaggaatgaagatgttgctatgcttattgtctcccatgcctatgtcatccatacaacgttacttcacaaggacacatttatgtaatgattgtgacgtatatgttgattctacagttggaagagtggaaccaagctccgtatggtacctacttttttatattagcgtgtggtgttggtactagtgtgttcgttcctcctagtaaaattgacacactagatagatagggtaaggttaatttttatgactccgtcagcatacaagagtggtaccaactatatgaagcaatagttatgtcaatatctacaacaattaattttttttaaagaccataagatgagtccagttgggtcctaccgatgaattgcttcctacaatggtaaagcttaaagctctttttgactgtatgtatacaatgattaaagtatttactgttacaatatttaatgcttagggtttattttatcaatatatattgtggatacctttctgtaaagtctctttcaaaacatttaaattttacaatagtttataattggcttgttcgatgcaactgtttgagctgcattgcatagcccagtcgttcggctgcaacgatctggactattttgaatgcagtcagctgttttatgctggttgcagctcctacagccgttgttggttggctgttgtagccaccatagatgctgcagcagtactagaacagctagctctttcgaacaggccgaataattttataagacgtagattaacctttttatggtaataaaataatacaacaataatttattttccttgattttttttgtgtgtttgggaattgggatatgcaaatctgctcgtggcggactggcggttgccctcgcacatgtcgtggtagtagctgtggccgtggaaaggggaggcaaccgcacaagacgacacgaacgccaccacctgtccccatttcccccaacattccgtcccaatccaatccccccccaacatggccgactccgccgccgccgccgctgggccccaccaccaccaccgcctcccctcctcctcctccgcctcgccgccgccgccgcagccggaccccggcggcaagcgccagcgccgccccagcgtccgcctctccggctccatccccctcccctcccacctcccccaccctcgccgcattcccatcacccccgcctcccgctcccgcaaacccctccacctccaaccccaccaccccaagcccgagcacgaggaagacgacaacgaccacaacccctccaaccccgcctccgccgacgccgacgccgacgacctcgtcctcgccgccgccttcccccgcaagccgaggtccctggaggccgtgcagggagagagcgttgcggccgccgcggcggcggcggaggagaagaaagccgcggctaaagggaaggtggtggacgtggtcgagtggctgtgggggatcgggatgggaaggtacgcggcggcgttcgaggcgcacgaggtggacgggaaggtgctgccctgcctcaccatggacgacctccgcgacatgggcatcggcgccgtcggggcccgccgcaagctctactgcgccatccagaggctgccccctcctcccgctctgcctccgcctcccccgccgccgccacggaggtgaaaaccgttcttcctgtggtgttggtagtagcttagctcggccctaacttcgtcggaaacttaggatgcgtgggtgtcaccgtgccgaatagatttaggaggtgtaaaaagtgtaaaatagatggggaggaaggtttgatctgtgcttccctgtggaaatggtagtgttggcccaatgcccatggtagtgtcactagtgttgtgtacaaatgcaaagaggtgaaatggaaatgctaactgccctgttttaatgttgtcgaattctctccgtggagtggtagtatttgtgaatgtggaaagatgagatcgaaatggtaactgcaatgcttttgcaagtgtttggagatgcatcttaattggattaggtgaagtagccacatgctttgttattagtggaataacatgatgttgcttggtagtgtgacaaatatgtttagctgtgctgggtgtttatctaatgttttgttgtttgcgattgatcggattagctcctgcaactgcaataatcttgcatgttagtccatatcataatatgccctccaagtagattttgtcattttgctatgcagtttggttcctctcgtaggtgataaacacataaaaaatatgtacaaatgttacatgcaacattgtttctcacaagttgatttgtctttatggcagcaattactatagtgtgtagttgtgtactttcaggtttgctggttccaattttagattgaactagagtatgttgatgtgttttttctgggtaaaattgcttagtgcgctcagattcctcttggttttggaaagtactgttgtgaaggaggtcggtgcccatctgtcactatgcttaccagttcaagctttcttaatcattgaatggcagaagtcaagtttctgtcatattgagatgccaatgcctgaaatcatgtgactttggaatcgaacttacagatgttcagagacattttgaagtaagccacatttgtgcatgtctagttagttaaatattgaattcttcctcatttccttaacccttgttgataaggttttacgtccttgtccatggctcatgtagcgtagatagtaacagctcactggattgctttctttctggtcagtcattatctcatttttcttgcaagttttgctggttcgaaggtcacgttttacaatgctagtgttttgggcttttgggccttttctgtgttttttgctatttccagtaaggagatgccgtcccagttagagattcaaggctatatcctcccacattattgctgcatctgctttatatgcttctgttcttaacatgtcttaaattgttgatgacaaagaacaaatcttcaggactctcagtagttaatttgtttcttttcatgctgtaaatgaagccatatatgctctagtttttttttcacagcaagaacatgagaccagttgcttaagcaatttgagaggtgatccatctgccataaatgaaatcaaagtaattgaattctccagaacaaactcttgcatattcttagttcacttttttgaaatgttcaagtataaggaagaacttaaagcatgtcgttatgattttgaaaactcaagatctctatgctttagtacactcagcaacttcattgatccacctcaagtacattctgcacttttgggttaatcgccttcctgtgtaatgctctttaactcttatttggtattgattggtgtatctgatctttctttgcatgcttttcttgttatctggttttggctgactcgtgaatcataccatttggcttcaatggattattaacccattgtaaccatgtccttatccaaaacaacaagtattatcaacccagagggagtatttctagttcttcaatgtgtttcatagtgacaactagttctattcatgttaaatttacaacaaaatatcctgatgtcaaatgaaagaactaaaatcagtgtttctttactagtctttcattttgttcctagcatgttgtgccttctagcataacatcaggtatgagatcaagaagttctaaatcagttactgctgttaatcttctactaggaacttgaattcgcagccaataggaaaatggaagtttttactacatactttgacgtcaagattggctctcttccatctatgttaattaccaagtttttctgacccctcttattttgattatcacggactaattgtttttatgttgccagacagatgtcagggagccaagccaatgaaatgtaccttcccagtctttgtataagctgcagtttattcaggaaagcatcgtaatgtacagggctagagatagtgttcaacttcaatctagcggagtatacagactacagagcagaagggactgatagtctaaactaattatctcaatttgtagctagtattgccgtatggtccaaaatgtcttaggtttgcctggttgttgcatgaattaccacactcacattagccccagttatgctctctttttcgctttccgtagaagggtttatttaatggacaatttctttcacaccctggcctatatattggtcagtgtgcgcactaactagcaagttggtaccaattcacaccctcaacacatttgtccctcctcatgggctttaatgagatcatctaatctgggctgggatgtcacgtggatggatgcaagggtgtataggtgaaatggaaaatgatagagatggaagtttctgccaattctgtttcctagggtaatatggtgggaactttagatagcaccagttactcaggggacattatagggatgctcagaaggggatcctaaatgtctgtgctatatatggcaatatagaggcctgcttggctgtactttacaacgctatctgcggctgcgacacagccgtgccaaggagcagttggttgcgacgtaggggctgtaaagtgcagccagataggcgattttatgatgaatctcaagtgattctgggaccaaatatagcatacccttgtacaaaactgtaaaaataatggtatttctctaggttctcattttttttggttgggaatgggatcaatggcagcatcctggatggtatcaatattttgttagaagatattttcttgtacaagattgagggttgctccctgaaggccattcactgttcttagtcatttttgaaggcctacagaaaccaggactgtttgatgctcaatattccaatgtttgtttgaacgtgcagtctactttagatgcagtttgtgcaccatatgaaggtccaatcgaataacaacagataaaggcatgaatatttgatgaaacagaaatatttgcatgcagaaaagaaaaacattttctttgagatatgacatgtagaattttggatgggccttctcctgatatgatgaagggagctatgcacttcaactttctcttgacttgtgtaaagggggagtgcatgcaaatgttgatttatgaactattttactacttagatgtcgtcacatgcccctagcattatatagacattttaatatactattattaattcaattagcttctgacttatttattttgttcatggcactagttgtggcttatatgaaaagacagtggcaaaagtggattgatagtttaaccttatggggccaccttattttagtatgttaatgaatcatttgaagtcagttcaacgtgtgatgcttgaggaagttttctagtatattaatgggaacaccatattattactgaagggcatatcattgtgcctatattgtgctatacttgtgtaagtggattcaggtggtgggcttaaagtgctatgaaatcattagttcatcacagccccttataaaatcattttcttctctgagtacacatgaacatattctttctgggatactgggtgtgcactagtgtcagacccaccacttttatgttatcttaatttacctgggaagttctctttagtttttattatcatcataattgtgagtataataaccaagcaatcaacataaactagccatttcatccttcttttcagatctgaagttgcatagtatatacttgcataactgaattggctctgtcatttccttcactttcaagatggcacgagccatgcagatatgctgtcaaatcaatctgctttttggttctatgatattcttacggtattaatgtttttttattcctgtagtgaaagccacttggatggaagtatcttgctggtactaccaagttacttttagctggtactagccaatcaattaaaatttcatttttttatccgttatttcatccttttcttttcatcaactgtcggtgaggactatagcaggtgcttctcactagtattggtgctttgtcttctgttaaatgggacctacccccacctgcctcaactttgtcttactcattcctagcatgctacatcaaaggttcttaactatgtttactagagtcagtaagtaccatgtcatagtatatccttgcatcctctatcggtgagacctctgtattggagttgtgtctgctggctaacactactttatttcaaacgatgtttatgttccaacgtatgttggctgcaatttaatgctccatttacttgtttattggggaaaaaaaccttattacccccaaaatataagcacttaaccccttaaatattttttgattcattctaccctttgaatttctaaaaaagactcactttgctccctgatagatttttttaaaaaaaaaattatccttacagaaaatatgttttaattgaaaattttgattgtgccatatataataaacctgtaaaaagataaacagaaaaaaaaaagagaaatatcattagagggtagagtgagtccattttagtagtttatgggtagagtaaaccgaaaaatagtttgcaaggctaaatattcaggcaaaatattttaagggagtaattggggttcttccttatttattagaaaaggtttaattttgcgggtctccatccattaattaactttttcattgttacattttgtttattatattttgacctatctgtagctgtcatagatactctgatctatgcttggttatgcacttatgcttgcttgtattcctctcgtttgtatcttgacttgtgagtaatcgtttgcacttccttgtctttgatgctgacttcgtactgcccatttgcactctctttcattgatcctgacatgctacctgaacactaggatgctgcttcatggcacttccattgtgctacattgcgacatcattaggtcatcgtctgcatttctttttaaatcttttgtaccaaaagtttctttctgttacagatacaaaaagtcctgagcattgtagtaaggctgggtcttatacctttcttttctcccttctcaggtgcaaaaattctatcaacagattaataaatgaacatatgagattctggacttgctgcacttccatatatttggaaaaaggtaagaggaattgcatacggaagcaatgtgattgtaacaaaaataatatattggagttaaataaatatgaaagaattatttctcagggtttttgaagtacacttacatttgggtgttacctataatctagtatccttgggtgtaatgctattctttctcattgaattgtgtggtgaggattagatgttaggggagggaaaaaaaggggggagggggggatcagtgcctgcgtgggctgtgaaaactaattacaatgtgaaaatttgctgtgtctgtctgtcggtgtcctgttctctccaggtgctagctcctgccgtaattcaacgtcatgacctggttcgtgctcagcgagccgggggccggcaaaaccgctgcagcctctgccggcggggtgcgccagatggtgtcgcggacgtgttgcagtgtcatctccggaggaaggcgctgccctcgacaggtaatctctaactgcacataaatccacatatatatcaatgcacttgtactgtgaactctgttgccactgctaccactcttgactgtacaaccagtaataacatattatcaagaaaaagactgaaatgtgtactctgctaaatttctagtttgaaatagttttttgtttttccatgtcaagggaaaataaatgttgatggttcttggtgatatgggctatcaaatttttcattgaatgaattactggcaatgattattgaaataatttcacagctcaatatatgcgcagtttggaacaagtaattcactgttatatcatggtttgttccgctcagacatcagagcaataggaaaagtaagagcctaatttttatatgtatacatataatttgggaaccaggaatattttggcaacttatttccttcaagtttttcaaacatctcaatgtggacgatatcctttactgattcatggatatagccattagccagacagagagtcaagggcagaggagagggaaaagaggaaaaaaaatataggagctaatgagtggggcacacttgtattaagcttagtttgttttattcttagactatatatataatgtcttcgttttaccgttaatttaatagttttgtgtaaactattttgttggtgccgttcaatgcatctggacccagagcaatacagggttgattatccgaatccagtaaggaatccttcaggtcctgaattcctaacactccagttaattcattttattatactaataacaaagttcacacacgcaatgcacgaaagggcttctttgtttactttgaggttggaggattgaaaaggcccaaaagggaagtgcaaatatataacgcagaaatcaagagatgggttagtagtagtgcccaggaagggcactgtcgatctcgattgagatctttgttaggaggccggaacccatccacctaatcctagctgtttatactacaatatctttggcaaatgatgctgccttgtcgcctagtagacgtgtctcttacaaaagggcatgtagcctagtggttacagtgacctgagtggtaccctaaggtcctgagttcaaatcttctatggagcgaattttagattggttgtttctagggctaagttccctatttcaattgccgtatgtatccggttggatgtagaggccgggtaaaaaaaatacccttatctaaaaaaaataataaaaaaaagacgtgtcactcgccctgaaactggtttcaagctttcaatcaaacgttttaggagggaaccagtaaagatggcttagctgcacgcttaggagccatgaatttcacacaattcttgtgcctttctaaggccactttaattcttatgttaatacagtgaaggtgcccccaatttctagaagttattttacgattcttgaagagatcaataaacacacgcataataatcatcttacaaaaatactttggcgactaaaaaatatagtttaatttacaatgggagtatttcacagcaatgtattccgttttatttttagaacacttcaaataacaattaatttgctacaattatatatatgtagcctctcttaccttttcgaattgaattaggtaaagtgcattgcagcagtaccacacctacatgcacgtatatataaagtcatcgagagtgatcaccaggtataagaacgttagggcaccattcaaggtggaaccaataatagatactagtactatatatctcatcagctataataatgatgatgagctaaactaataaagtgaggttaatacacaattataaatgcatgcagagttggcatgcatgcagaaaggtatttgtagtggtggaccaatacatgtatatgtacatttaaacatgctatggttaaatggaagccgccacgcactaattaaaatcgttcatgatcgatcccaactcaactactggccttgtatattttacagacatacttttcagacatgcatgttcaatggcatggaatcaaagattttgaaagtttaccctccttgttaatcaattcaacgaacatgtaaaaaaaactatatctttagaggactgttctcacaattatatactgaattatacacacttttagtgtaaagccttcagatagctgaattgatatgtttgttttttttataaaaaaaaactgaaattatgcttgctaatatatataccacgaaaaaactaatcgctcttgggggaaaaaaaggaaaattgtagatgagctcgctacgtacaggattgtttagttactttaatttaaggccgataacatgacttcgaaacgagaaaatgaagtaggattctacagaaaagagatacatgaacgcgcacattatatgattaacgctatgtccgtttttaaatataaggatttttatagtttatttggagagattaagaatgaagggaagaaaacagtatatgatgccccgctatattaaaataaactcaatctattgtgtacaaattaagcttcagaaaaaaaaaatttggctagtttatgagacaacaatagtacatactccctctgtttcataatataaaactttctagtattgtccacattcatataaatgttaataaatctagacacacatatatattatattcattaaaatctatatgaatttaggcaacgctagaaagtattacgtattacttcctccgtttcataatgtaagttattctaacattttccacattcatattgatgttaacgaatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcctatatatatatatatatatgtgtgtgtgtgtgtgtgtggattcattaacatcaatatgaatgtggaaaatgctaaaaatgacttacattgtgaaacggagtaaggacattgcaaaacggaggaagtaaaacatacggttaatagttagggaccctaaaaaggtatattagggttagttaattatacagtcatatttggaaagggtgcttgtgagataatttgcaagcaatggggcaactaaagaattgagtggcactagaagctggccggtttgtgtgatgttctagctagcggctaacagcgtgcagggtgcacacaacctgtaattaagatattcaagtcctagacatatttatgcatgcttagaaagcaattgtgtatttgcaattttgcactcacatatatagctagatatttgatgtctccaataattttaattgcgtgagtgtgatgtatatcgagctagtacatgcatcatatattctcttaattaagagaagatatttaaaaaatagttaaagaattcctgacatttaattcataagaagctatataactaattattaattacaccatttacagctcataggactgtcaataaaaactcgcaaaatgacaagaaaccaaaaggcactacagattaattaagaaaataattagatgcatataaacttcattttactccaaaatatccaatagtataaatccttataaattacaggtgttaattagtactttttctaaacacaattgttagttgttcaatcatctctctatatatatatatctagcaagctaatacaatacccctacatatactccctccatactcataaaggaagtcgtttaggacaatgtttaagtcaaatcttaggaatatacatcattaataactcttaagtcgatgagtttgaaaatgtaaaaattatatgtatagatttgtcttgaaaatactttcataatagtatacatatatcacttttcaataaatatttttataaaaataagaagtcaaagttatgttttggagaccatgtcgctgtcctaaacgacttcctttataagtatggaggtagtaccagctaattgaattaattgattaatttcctacagggtcgctgccccatgcacagtgtcaccaatgagggaggctgctgtgtcggtggggaatatacaagtactacaacgatctctcatcccatcatttcgctccctacgtaattaaggcagaatgcgacacagcgacgctacttcttcgctaacacactcttaggcgatcgtatagtatcaaaataatactaatatatagggaccatatataattagttgtatatatatggtactaatttcttcgtcaagctataatatagctggctgcgattggtgaacagcgaatcgcggcgtactgtagcatgatgtgtgaggaggaccagctagctagctatatatagctagcacgtccaaggatatgtcaaatttgatggcaaataaatgatgatcacaaattatttgaaacgtagaaaaaaatgcataatattctgattccctaattaattaactgaaattgagttggttccatacgatactatgttatttttactaaacagtactaaataattaaagtaatacgacaagaaagaaaaaatgatccttaattttggaaattcataagacatttcaattttacagtaaaactaaaaataatcatgccacgagctagtcatatatagacaagaggcagccaagtaacatgcaagtatttataattaacaagggcagttagagaatactatcttttttttttattttccctcacttttaagcagcaggtattccatatacgtacgtacaagatacttaagataattttgaaacaaaataattaatacacaaattttgttatagagcattacagacacaatattttcagggaattagtgaaccctatatgtaacaattatatatattgtactccctccgtaaaaaaaaaaccaacctaggacttcgatgggacacaatttagtacaatgaatatggacagatcctaggttggggttttttttggacggagggagtagaggtttaattattgtagtcaatggcctgtactttgtggggcctttggatcttttatagtgaggaataaaatggtgggggaatttaataaggtaaaataccttaatctggcaacccattagcaggaatagcatgaacatccttgatactactaatattctctgtgaaaacccttattagttaatcaagtttgtaatgtgctcatctttggaatgtaggaatatttcacatganattttcaggaatacaacaaaatttggttcatttggaaacttgtgtcaacatgtttcaaaaaatcatgttgggctactacgtggatcgcttttgcatatacgcccacatcgagcttgagaagtcaatagatttgcgagcttataatttgtccaaggcttgacctttgtttaaatattattcagaagtcgagattttttttttgacagccctatagctaacanaaacactcagtagaatanaatgtcatggtggttggtatacttggtaaccattcatcacctgtcgattgctactgctgaggctttcgagcatggagaattcagtgtacgatcgacgaccaagtgtttttcaaactcaaagatcgacctaacctagctggatcaaggacaagttggtgaattagacgttaattagttgctctcaaatatatatggtcgatcgagatagtcacaataaattaaggacctcgatcccattggctacaccccgtttaccctatctagctacatctttaattgctactatgtactattctcctatacggttttaaaatggattgttttcaataatttttcagttgaattctcaaataaatgtattaattatgcaccaaattggattttttttacttgtagaaatccaattaggtctaatggaccaacaatttcctgacatgtcaaattaagtttgctgctctccgtcgtaaagaatccatttctggctatgcacctgatcgaacaattacttcgtctaagtgcatagctacaaatatggtcttttaatttagggactgagcagatatacgtacacatttctttacttaggtacctttaaattaagttaatccaaaatcaaaatcctcgtttaaattttgtgactacccatgggcgttggtgattagctagacatgcaagtaatagctcggagggagaaacatatatccatgaacatataacaattatattagtatatgctagtgcctgtgatagggacttctcatgctctagctaggactaactaattaaacagtgtttaaaaaatacctgttcaaattcgaaagaacaatatcaaacggctagctaggctagcttgcaaataatgcatctattttttgaaataattaaagggacatgcatgtgtcataaattaaccctttttccttaattgtgatctcgttcgatcttaattatttgtgcttaatttgtcgtatgtgtttgtgcgttttatattctttgaagtcaaaacaccttgaattaactaatatttaatcatctcgaccgggggagaaaactatatttagtggttactccttacatctagctaggtactgtacgagacttcctaatattatagtactagattaattaattaattgagaataagagaacatgtactccctccatactcgaaaggaaatcgtttagaacagcgacacggtcttcaaaacacaactttgacttcttatttctataaaaatatttattgaaaagtgatataggtatacttttatgaaagtatttttcaagataaatctatacgtataatttttatatttctaaactcaacaacttaagagttatttatgatttatattctcaaggtttgacttaaatattatcctaaacgacttcctttataagtatggagggagtatgatctggtgatgatcgatcatgcacgtactcgatcagtaagtaattaatcccactacaataatggagtagccaccaccgaatttcgggcattttgttcatctctttaaaggtgtgtttagttccaaagtttttttttcaaacattcaacttttcatcacatcaaacctttcatacacacaacatttcagttacatcgtcttcaatttcaaccaaattttaaactttgggccaatctaagggggtg

SEQ ID NO: 67587 - DNA, 10194 bp, Oryza sativa
tcagtaaacaagaaccatgtctagtgttagcacatggtacactgtataggctgtaccattggatagcaagaagatgaaaaaaagaacttcacaaaaggtaagatcaagtacaaagtgcttcgactttcctgtacaaaacaacaaaaaaatctgatacgtactcgcagtttggagaggttgtatttgatggttcggattagtataacaaccatcaaagatcccaaagaagtttgatgcataaggcgctcatggtaccaagggacgctcggaagcacctagaataatacataaaagcattaacactttttgaataatataaatatatagtaaatcaacttgcttaccaatttgtgtacactagcattgaaggttgaatcttgactgagtataagaagaactatcaatagcatgtatatctgattggaggtctttcttgatgcattgtagagcatttccaagataggcatcagctgttcacaaaatttacaaaataaattagtaagaggctgagttaaatgtggatttgggtatgctcaagtccataaaaaacatttttacatattagtacatttggggatgaattcaaatttcgtgagttgcagcttgatgatgaaattgtggaattttgaacaagacaattataagctgcctggttgtataaggatttcaacagcttagcgaaaaacgttctaatatttagcaagacagcaatttcagcaagtcaatatacgtaataacttttagcaaatgtaagccattcatagttcgaagctatataacacaatggaagttcccaagtgactattattttttccagcaatttcatgttctgttgtgtatttcaatatggaatctagtccccaaattgcaatgtttcaaacattaaataccaataccatctattcatcacattggaaagaaacagaacttaaaattggagcagttttatgaacccaaaacaaatatgtccagatatgtattgaatgccctcgtgctccaataaatatggttcagaaatattgttattaagctaacataccaaagtatccaggtctgttcgaaccagaacatattcctgaaagtcacagttcccatggaccaaagaatagagcagtagaaccgagctctcatcttttaagcatctgcatggatagcgaatagatggacattatgattgatcttcgttaataatgaaatatcctattctaaataatgaccccccacaaatatgtgaaaagttaagagcagaatgttggtttccatcaacagaagtgcattcttatttcttaaacatcaagccctcaaacataattccatctggagagaactgttaaactcttttcataatacacaaatcatcagtacatttttgtttgcaaggagagaaagagagagagaatttcattgttttaattagaatcacacttggcaaacttctatacatctaacaagtaacagtatgatcataccgctcagcatgatgaagtgtgttacttacgtgccaagagcgtcaaatagcgatgcaaaagacaacctgacaactagcccattttgagcatttccttcaacatcagcacgatcatctgcagcatagttcatttatgtttgttagtgatctatacgagtactgcagtttctttgtacgacaggtgcagttaattccttgcaaatgacaggagcatcttacattgactgtctttggcattgcttaaggccttgtaatatggattatcatgaaaagccggtgcatccttgacattggtatttaaatcgcttgtgtagacattactgcttggaaaggattcgctcatcgtaatgcacttccggtagtggatcagaataagcagaacaagtaaactgttgtctgccaattgacttgatgcgccttcagcgtttgagctcacaaggtagttgaaagtataatatggcagtagtacaaagtttgctgcagtaacaaataagtaaagttaaagattttccataattcaaacatcctctagttctatggtccatgtgtcatacaatatttgcctaactttgccacacttgtgtaaggttaggtatgaaaaaaataggcatggaccaattgttagaaggaaaatgatgggagagagtatccacattaccagcaactgaaccaactcgctgcaaaacaccaggtccaccatcatcagagaaagcagggtgtgaactgtttaaaggaatccgtggtcgttttacaaaatttagcagcaacttttgaactaccgaggacactatggaactgtcctgcagaagaatatgtggcaaggatgcgcattccaaatttagacataaaaagggtccgcaaaaagaccagcaaacataatgcacaagcagctatcagttttacctgaagcatagccgcatcaatgaaaggatgcacatcttttggttcaggagatggtccagaacacaattgagttgacataagtactagcatcaagtttagaagttcatggtgcaggtagcatgactccagacttcatataaaggataaaaacagtgagatgcaaatggcaaaatattaatatatcattgcaaaacacatacacaaaaaagaaatatggaagtcatcgattgatctaccttacatctacactaccaatgtagttcagaacacctctcatcagaaaatattccacgctttgttctgagagatcaggaaaccatgacaaatcaatcgatatatcacagtaattaaaaactgatttagggtattcacagtgttttggaatatatcaggcatgcaagaactagtgcgtttagataatcaattaccagaaggaaaattttccagccccttctcatccttgtcaatttcaagacttagctcttgccaattatcagtctttgcattttcaataatgaatttgagaaatatggatgatatatatgcagcattgatagccttcctatacgccgcgtgagaagactctgccatgcactcttgcaagcaccaaaccaaatggatcaaaatctttgcgagatgctttgtgtggtagttgttctgggctgcataaacacatagcacaggctagtaagcacgagacgattacaaatcaaaacatgatactacaagtaacaatttaccacctatgtcttgatattacagtaagctgaacttaaaaaagaattttactaacacgacagttcatattgttgactacagccatgtcagcaaagtcatatatcacaggtgagcaaccacaaatgcagctcgcaatccacataaatcaattatccaaatcctcccgactacaccaacacaggaaaaatgccgtgaaaaccatgtgaatctagccatatcgcctcgaagcaccgcattaaagtcttaaacccacacccgcgcgcgcacagaaaccacgtgattcacattgcccctcggatcaaagcccgcagagagggggcaaaaaaaaaaaccgccactaaccaagagccaaaaaaaaagaaaagaaaaaaaagaaagagaagaagaaaccgacgcgcgatcagagcaaccgcttagggcagcgcggatctcgagccggggcggaggggggcaacaactcaccgaacgcgtgacacgcctgcaggacgcggtcccgcggccactgctgcgtgaggggcagctcgagcagctgcctccagaactcggaggagatcgggtacgccttcccgccgaccagcgccgcgaacatctgctccgccgccccaggcgacgccgcggcccccgccaccgcgcccagcctcggcgtcgacggcgccgcccccatttggatctgaacgtcggctataccgccaccgcgcccctaggtttcgacgcgggccagcggattcagggattggacgcgagagtgaaaaaaaaagaaaaagaaaagaatgcctccccaactggagtcgagacgaaggaagcgaagaagaagaagaaggttttaaatgggacacgggagcgtggagacttcgggcggaaggaggaagaggatggatgagttcgggggagcgggtgcgagcgcgactaaccggttgggggacttggcgctgtgggtttggattgtggggttttcgtgcaatgacgaatctacccccgaggttcttcctgggcgcgggctggggaggaggggtggtgtggtcttttcgctgggggaatgcggtggtgtcgttgttgttgctgggtcgcctgccgtgccgtcggtggaggaggtggtggtttggtggaggagcattcggggaggggggagacggggtggggtgggcgactcgcgattggtggtgtttagatccagagacttaactttagtccgtgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggccaagtcagggggcgaggctgatgatgggtgtcgtttcggccgtgtcgcacttgattgtctctgcttgggagctccccaccggttttttttggccgtgtatcagcatttgggtttgacttcctcggcgttgttaggcgcttttgttttctttcattttaattgagtaagtgtatcgaaatggaaaaaaatgtgatttttgcaggaaacaaaaagtaaaaactgaataaagttggcattggtgaaaaaaaataaaaccattatctctcgagcatttttctatctttgtagcggtgtcagttttatactctttcgttgattttggaaaaataaactaaaattaaatgggtaaaattgaataaagttaatatcggtgaaaatatatagcactataaatatcaaacttttaagagtgtctacctcgaaatctgacttctatgatgttatatagctaatttcacaaagtaatgatgtcatgtagtaaaatttgtctaaaatgaagacattgcgttgttaattactttacaataatacaatataatataaatgcaaacaaaaaatttttattttgcaacgagtttcgcacagttccattacatgaatatcatttggaagggcctatggtacattttaaaaaataaacctataaacaaaatttatttgttgtatgaatagtccacttcaacaactatgaacttttgttcaccatccgtcctatgtgacatctatatcattttcatattcgatctttcatgttgatggtggcatgaaatatgttttgtccttttttggctctatgcagtcatctgttgacaaattggcttttttttaaaggtatatatattctatatccgcccttattttgtaaagttgttaggaaagtactctatttgcatatgtgatttaactgtcgcatatgcaaattcatggaaaaatcacatcagttcatgcacgattttctatattgtttgcaaacaaactttcctagtacatgttttcctaaatgacttatttgtccattttgtgtcttacgagttgtttccaatatatgtagcatggttgaagtatctacggagtatcacctattgacctgtccaaacattgcaatagtgcaaccgtggcatcgttctttaggtggtattggaatctacaagagataaagataaaaatgaagatgaagattaagattaagtgatttacgtaaaacgaggtaataataacgtgtgactaattgggttttaattattacaaacttaaaaaataaattaatctgatattttagaataacttttatatagaaaatttttccatgaaacatatcgtttagcattttaaaaagcgtgccacgactacctaaattttttcccacttgtgtttcataagaaacgaacgggacgttaatctaaagtaaagtgatattgcggcccagtagtttagcctatccaggcccaggaggcagaggctgccggtgaattcaatcgaggccgtcaatctcaaaccgacccacctccgcctccgagccaccgtcctcacgcacgcaccttcacacaccaccgtcgaacggcgcgcgccggagaagattttgccgccaccggcgccttcccctccccggcgaacgacgccgccgccgccaccgccaccgtcgccgccgcgcgtccgggcccctaccatccacccggcggccgtcggccattgtctcaccgtgcgccgcccgaatgcgaggccgccatctcctaagccctctcttatcccctctcgcctacccaaaacccccctcctctcgcctcgctccccgccgcgtcgccagccaccgcaccgtagccccgccgcccgccgcgcgccgcgccccactgtccgagcccgacgtcggcatctccctcttcgcctccgccctcccgggcttccgcggcgccctcaagcagcgctactccgacttcgtcgtccacgaggtcgccctcgacggctccctcgtccgcctcacctccttcgacctccccgacggcgaggtccctcctctcgggctcctgtttctgctctgctttgccattacagctctcctgctctggatttgggagctgtgaagctcgtgacaccggttaatttagcctagcgctgtttgtggatttgcagtgtgtagatgcgaaggaaggcggcatggacgaagcacaggcgctggaatcgttccggctgctctgcggcgacgcggactgtgaggcattgagggggtttctggagagggtttcagagggaggcgacagcgatgtctcaccgatcattctctctgctgatgccgacaagactcatcgctcggtgtgctatcttctctaactgttgttgttttgtaatgaatgagaagctggaagcttgtagtcattggtcctactttttgttaggaagttcatgatttcttcaagaggaacttcgaggccttgcttacagatacagttgagcacagcgatggaatccagaggtgcatcagggtgaggttgaagccggggcgacgcgaacggagggatgttgatgggagggggaggaataggaaaggcacgggaagttcgggctggagagatgacaagccatttgatagtagaggatctataatctggcctgaccatctagggaagttcataaggttatgtcatctgttcagtttcatgcctaactactattgtgcccgatcatctttattctgttcgtgtaagaatgcaaagcactgcaccgttgacttacagtatgtaattcacataccaggtttcatctttacaaggagaacaaggacacccaagaggcactaggaaagataggcaagatgctagggcttcaggtgcatgttgtttgctgtttcattgaagtatttgcagggtgtcctgtttttagtttataaattcattcagctgtttgctaattgattggtgactaaacttcccacagcctcgatcattcgggtttgcaggaacaaaggataaacgcgctgttacaactcaacaggtatccttgtgtagtaatttatgctgtgaagctcatgcatataatgactttctgactttcttttcatgggtttgatgggcaatctgggtgatatttaaaataacaaacttgttatataaagaacatgaggtaatgatttatatggaaagaaattaagagaggttgttggtattggctgttgtcatctcaaggaagaatgggtgctatggtttgaaaataaacagaaagggctatgttttcaacatttcttgcagtcatgatttttctggttctctaacttctgatcaggtcacggttttcaaggtgcaagctagtaggttggttgctcttaacagtaagctcattggcattaaagttggagacttcaggtaagaaagtgcatccctctttcagcatcaatgtaatgtcattgactaaaagcaattgactgcctcagtaatttatttaacctgttctagttatgtgaaggaaggtcttgctcttggtcaactgatggggaaccgatttacaattaccttgaggtgcatgttctccctgttactggtggcattctattataatggtagtatagcagaaatatttttggtgaacttttttgcattctgaaaaatgtatgctgaaaaagggctgtgacacacagacgcaagggtggaatcaaacccagagaatgggaattttgccagttcatagcccatgtagtgatagcgccgcagccttacttagtactaagtactaacccttctattatggctgggtcatggcaaaatcctagctccgcctctgacataatgcaatgtttctactatttgacgattatacaaattataggaatgacctggcatgcttttgttcttctttctttattcttcaactacagaggaaattgataattcatactttttccatttttattatctgccaggagtgttgttacagagtctgaagatgtgattaaggctgctcttgatggattaataacaaatggatttatcaattattatggtctacaagtacaataattcaactcttctctcttttctaaagcaggctcctggatactgcacttgttttgcatttgctgagacacaataaataaataccatgctgataggctatatgaaatcgtggtcatttgctggaacgcaccgaacctgttgcaactattgctctaaaagaaaaaagagggtgtcaaaagcccctgctcttttggaacatacagtgttatctcagcaaatgcaaaccaagtgtggtgtgaaaaggtcaacattgccctgttcactttcctgtggttcaaactattttttgttgtgttatggctagtaaaaaaatcttcgtttgtgtgcttagcgctttggtagtggttcagtgccgaatcaccaagttggtgttgctttgcttagaggagagtggagaaatgctgttcaattgattcttggtccaagggaaggagatatccttgttttctttttctaatatgtttaccagataatatatgtttaaatgtgtgaatttgttcgacttaactttgcggaaaacaatgtgataacataaataaagtgagggagcattttaaggaatatggtgacattggcacggcacttaggaacttccctcgatatctcataacagagagggctatcgtaagtatatttttttcttttactttttgctgtcgatgtaattttttaacattgtcactgccatttccccccctagcgtatttactagatatctgtgccacacctttccaatcttccatcaagtttttggtgaaaccagaaatcgagttgaggtgcctgggaggatctgattggtgccagtgctcttggagtctggatgtgttatacattagatacaagatgtacttatgatgttttgaggaacatacaagttatgtggcatcacagtttaatcatatttattatatgctccagaatgtgaattttagtagatgatgcatgataattacctacataatagaaaaaagttaccagcttatgctgaaagatattataaagaaggcatcgctacagtaatgaatttgtatgttgattttgagctttcacttttctcgctccaaatatattaactaatttatcatgaaggtagctatcctcccttttatcatctcatttaacatttcttattgtcaatcagatttaaagtacattgatgcataacccttaaacttatgttttgttttatttttagcttcagcgcttgaagaagtaccctggcaactatctacaagcactaatggctatacctagaacactgagactgatgtatgttatgttcaatatctgaaattttgtctagagattccaacacctgaaattaatgtaattttccttatttacgacaaatttaggctatacaattctacatattaagttgttctgattattctattcaggtatgtgcatagttaccagagttacttatggaaccatgctgcaagtaatagagttcaaaagtatggtcagtataccttttgctcaatagggaattagggatggcagtttcagactaggagtgattgttcttttctaaataattttttattatttgctttatcgatggtacctgcaatggatatgctcatcagata

SEQ ID NO: 67588 - DNA, 24611 bp, Oryza sativa
tctaaacacagcctaaaagtaagctagcttagctaggctgtactaccacgcacgcgtgcatgcacgattccaaaagcgttagttaacgtgtcatcaacccgtaaaaaaaggaacatatagctatagattaatgatagtaacaattaattaatatatataactggtactactgttaattagtacactggtactactgttaatagtactattagttagttgaccctacaaacacaaactatatatgtaccggccccatgatgattaattgtcagcgtgtgttaattaatctggcaagagcatgatataaagaattaccactgtaattgccttagcttaagtaccattatatatttttttttcaacagacatgcatggcgataactacgacatgcatcgtcatcgccatggcacgttgcacaacttgcttgcttgcatgcataaactatagctattgcatatgcaacgatggagagaggtaatatgcactgcttagagcaagttcaatagtatagccaactactatctccaaatcatttatagccactgtaatagtcaattcgtacaatagtcgcttactatacttttaatatctggtcctacctgtcatacatacattacgtcttggagtccatgctgcagctggctacaaatctgtagcccgctgctcttctctctctttctttatctttttaaaatatatttatagctggcttatagcctgctattgtacctgctcttattgctgctgctgctgtttttttttctaaggagggttaatttattttactcggtcggtctttacatccaaccggatatatagagcaggatttggcgctgctgctggtgtgtatatattgtgcgttaggtctgacgtccattcacccgtgaaagctccaacatatatggctgctcatgacttacgtacgcgggcgtcacgcagctcgatcgatctgtccctcgactcacgcacgcgtgcgcgcactcacttaattttaatctggttttatttagtttggtatagattcaggtctcaaatctacgttgggtttgaagtttgcaagtggtttcaaaaattatgtttcatctggaataggaacaaaatgattcatacctaaattatcaatgtaatcatatatccagatctagaattactcagctaaaaataaaatcttggatctagatatgtgccacataagccttaatttccatatatttatatacctatactccctttaaaacttatctagcatttggtgcttaattactattagtgtatataaatactgtacttggatatattgggattttttttgaaaactatattttgttagtaacatagtttttagagaaaatatatcatgaacaatttctatattacacaaggtggtcaaagtggcttatcgaaaacttgacattttgttgctagaaaaatcccttggcaataatggtctcccggctggttgcaatgtgtaattgaacctcccttcttttaatatattgacgtgtaatactttttgtgctttcgaaaaagaaaatgtatgttctaatcaggagaacgttaggctctagtcgtgatcgatctgggcagtggcatggtacgtagggagctagtgcagtgatagttgacagctcgaagtggctaataaagctaggacgtccacttcgtagtgtgtggcctgttgtgtgtggcttactggtttaacttacaacagcgtaccaacgtttgaccttgattacgccaagtgatcactaggtttgtgtcaagttaattcacaattattggatattccttcgatcgtcaaccgtgtattcaagatgaaattatcgatctcaataaaaacgtatgcatgaccttgtcttttcacttttcctcttgctgtttggggcccgatttcctcctagttagcccagtgtgttgtagttgtaaaaatcttttctttcgctaatatattaacgtgtaaaacttttacgtgtttgtacaagaaataatataatcttacttttcttttgcgaggacagttaaacttaatttacagctgataggttatacaccttcagtaaaataatatgattatataaaaaaaccataaacatagttattttagtttctggaataaataattatccgtttaatttttatgtcccacataatacgaatctttttatgtaaaattatgaactaatatatcctatttgtttttttgctaaaattttgtaagtttcatatttcataaaaaataataaactaaaggttttcgatggcaggtaattaagtttattgagtgcatgtgcttagaccaaagaaaatcaagttttgggtacaattacataaaattaaattggagatgaagggccttgagcttattgaggtgttgaataaagttataagcaaccttccaattttaatatacgccttgaacttttagattagggtcgaaatgtttttaataccgataactcacttaaagcgtacgtgatgagctagcggtattattaacatggctaattgcaccttttacaatgtctatcaatatataatataaatcatccaacgtcttcttttataattacacgaaagacgcatacatacaccgcccctagcacacatatcctccaatgtcccttaattttccatactttgctttctttgtagtttgaattttcctcctcttaaatattagagtacaccatctcattaactcgttaagttttgagaaaaaaaaaagagatatatactaccttcgtttttagtagatgacactgtagacttttaggcacacgtttgaccattcgttttattcaaaattttacgtaattacaatttattttattgtaagttgttttattactaaaagtactttaagtataatttatatcctatgcttttgcataaattttttttaataaaacaaatggtcaaacatgtattcaaaagtcaacggtgttatctattaaaaacggagggagtatatatgaatgtgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacacgcgcgcgctcgctcgcctcgcctcgcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagattgtgcgggcgccctgatcaagcgacctttctctatataaaccgacctgccgtcttcacgcaacacaagcgaaatcaatctagggtttgcctcctactctgtactgcgccgtcgctcgtagactactccatccctctcgccggcgtgcaccggcgatcgggagagcaggtctccggaacctctgccttcgacgtcctgcaccaggagaaggcagcaataaggtttttgggaagcgcttcgcgcgactgctccctgtttgttcacgacggctcgccttcctcttcgctcgcgtgtttcgtgccttcgtagacacctgcgaaaagtttcgaccaagcagccggtctttccgtcacctcggtacgtgttcaatatgatgcgcatatttgatctgttcatgttatactgtgtagtttacatgtatagatctaatgatgcgttcttgctagttttcatctgtaatgtcatgatttatttatggaatagattaaatcattatatgtctataatctcaacagaatgcgtgcttgttaactcgctacaaaaatgcctaagcttgtgtaaatgaatgtacagaatatgaataatccttcaaaagccaagggcagtgtgtctaactaaaggaaaacaggaaagaaggaaaggagacaagaaaaaaaaagatgagagatggcaaagatgaatgggccacctactagaagatgtccaaacataaaacaaagggtctctgtacatgcatggctcaactaccactctagatagatcaatatatgcatagagcattttgaaagtgtgtgtgattaattagcaacgcaggataacgactgaacaataaaacaatcaatacaatttagtagaaagtagtattttgacatttttatgatacatttttaatgtgtaagcatgcacagctaaaacaaaacaaaaatgacgtgtccctttcatgaaaaataatgatgttttgtgtagcctttattctagaggctaactagatagctagggaggagtgctgttaataaatcagaaaaaaatacgttattatattgaaaagatcgttacagaattcatttccttattatcccaagttccatatatcagcttagccaaaacctgaatttaatgcacaagggtatattggtagttaaggtgaacgcaagttaagaaatcaatgaggaagacctatcagggaaattttgacaagtttattttgaatctagataaaagtcgatatagctttaccggtggggactcagttttgtaaatactctaataaaaaaatcgaaaggttgattttattggaaaagtctatatatttaactcttatgtactatgactacgtgtcacatcttttgattccgctgtaaccgatagtatcttgtatgagagacctgttataagtacgtacatctagattttctataatttctatctagttaattaaattgaccggttaagatattgtttttaagagttctgtaagaaaattttagtatgtagcagtgctcgattttattttatgtacaattttttcggtgcaccacatgacagcctttatattgcaactgttattcatggttttcttccggtggtgatcacagatatatctgtaagttcttttttgtcatccactcattttgaagtttgtgtcagaaaagatccagctgttggaattgatgtataaaattttcaattaataggaataagcatataggtctactacaacatatttattaagattacaataagcatgtagtacgtgtgtggccagtgtgtattttgggctccacgactaaaagatgtactatgaattgatctgtgtgcgaaagaaaaaaaagtatatagcatttataattgtgtttaaatatttaataaattaatagatttcaggatttcagaagtattattgcactacatcctttttttgtcctatacactaattaaaaaacgcaattaatgtctgtacaataaaaggtgtatgtatcaagaagaaaaaggtagtagtacaatgtagggttaaggaatcattaactctatttggatttggaatcagatagcacttgctgtaaagattcgtcaagcgctatcataatggcccaattgaactatatttatataacttactgtagacaagtgagttaatttacacaaaatactcctatatataatggtttgtacgtcttgctattaattatccaattttaaatacttggccgagtactcgtaaagtcaagtcgacttatcattttattttctttttcaggagagtttcttgtgctatatattcaattttgtccatagtacaattgaaaaggtagttagttttctgttccagcaaaatacttcttttttttttgcgatcgaatcccatgtcttgtaagttgtatacgacatttaattagtttttgtccttttgcaattggcatccagttgttgtttttgttggagtgatatgcgtaggctgctttgcagtgtgttcgatccatccatctatctctcatgcagcaaccacccatttgcatatgcagcaccgacaatatttgatctactccagtatgcagtgaatagttttgcagcctttcagcacatgatttttaaactggcaggtctctctttttgaccaagtactgagtactatgttctatatgtacacacctaactggatacatcaattttggaaaaacatgtaaaatgcttatatatattttttggaatggagttagtatatgcgagaaacaatatatctatatgcccggttctttttcttaactctaaactttaactttgtcttttttattaacatgcttttcaaactattatatggtgcgtttttgacaaaaaagtttctatgtagaagtagttttaaaaatcaaataaatctatttttaattttataatagttaatacttaattaatcacgtgctaatgagttttctcgtttcacgtgcgcagaaaatatctctcaacggggcataagtgtacatatccgtgtttataaaaaaaatctatatatttaatgggatgggattttcatttaccactgaataaaattatttcttaatattaggaagttgctgtgctaattatatatatagggaatttctatactaactaatagaaaaaaaaagtgctttcatgcgcatgagatcgatgtcggtactgttatagtagcatgtatgcatggctagctacaacatttgttttagaaaattcaccactaactatatagcaaaaaacaaaaataaatatgaacatatatagatgagatgagatgagatcagatcaatgttgctacagtttgtgcatctagcttagattgaaatcaggtccaccacacggccggcttgtcgcaacaaggatgcagaggccattatgatgatcagatctcttgatatctctggcagatatacatttgtgcaatgttggcaattagctacaagctagcaagctagtagtaccatctatcaaagcttctcagtcagctagcttattgggaaggcatatatatgccacaaacaaaagcatacattgtggtatataggatggtgcatgactttcattgcattaggtgagacttggccttttttggggacagtaatatcttcaagtaaactcaatacccctcacacacttcccatcggtttctcgcaaattatatatataggtaccacgcgtgctcttgtccctattccgaataaattgtaggtgtgtcttattttacataggttattttttttaaagagaagataattttaacttaattttatgcaattacatgagtttaaatctgatctaaattttgaacttgggaaatttataggctattttcaccgaatcaggtcagtaaaaatgtattatgcttttcattggtacccctagccggccagcaggatgaggggacatgactatagatatatacatatttggcaattctttggtaagttcatttgaggcaaaacaactgtggaaatgttttcaacttgccatcatgtatgggcaatacatatatatgctgaaccttttttggtgcctttccccaacacagaagctcccaaccaccatatatataaccttaagactgtaaaacagtcaaaatatggtagagacacaagtccatgcccaagacacaactaattaagtaagtgaggtcactaattaattaagtaatggaaactaattaagaaatggaaccttaagcagcaacaaaatcacagagagagagagagagagagagagagagagagacccttaatcatggggggtcacccatgatgtaacacttggacggacacccttcacctacaccaatttgtcacaacaacaacaacaaagacctattggaatcccgacatccaaactactgtccgtagctctaaagctcctttcacctaccaatatttttgcgctctctctgcagcgattataattgatcatctacttaagctagcaacaagctccaaggtaattaattaatataaaacacgccacgaaattttccagatgcatgcactataactatagattagctagctctaggcatgcagtgtaattaagtggctgttgacaataggttagtacaagtagcaaaaccacccttctggcctgcccttatttgtggatgccacttgtcctagaaacttgttctctctagtccatgcacttttctcagttgagttaatattgttgcactacttttcctcttgtttttttttctaaaaaaattactgtatctatctgtatatgctgataccaggaagatatatttatgtatatatatacaggggataatatttaatattatgtgtatataatgtatttctcaccgcaaaacaaattgatgtgcttctccccacaaaacaaaataatgtatttcccccacacaaaaaccaaattaatgtacttccattatggaacttggcagcgacagtctctcacaagaacatgatgatgcatattattttagccgtgtcgggcccgatcgataccacgaaatttttgtatattgcatatatacttttgcatatagctgtagcaactgaaaaacttaatttatatgtgttaatattttcttagaatcttgttaatcctttttatagctcagtggttaaaattgtttgtttctaccaagagccatgaggcccccatgaggccatgacccacagtggggactactaaactaacaaagctaataactctagttaagaaactctcaaaaccgcgacgaatcaaaaacagtaaaccaacggacattgttccacactcattcaaagaaaacaaacatgaaaaaaaaacataaagacaaggcaaaggagtgcaaaaataaaataaaataaaataagcaaggagctaggtatgcatgacatacctgtgaatcatcctcaagactcagcttgttaaccaggtacctcatcactactctaactgtcatcctcccatctctgttaatttggccacaccatgcacacacaacatgtgcgcacacatgcatgcacacacaaacaccccccaagtcaatgtggcatcatcaaaaacatatacaaatatccatcaccaacaagaccaaaaactataaaatcaatcaattaaaactaatttaattacccaagaagttgatcaacaaattaacaagaagatcattagcttttctactgctccctccgtctcaaaatataagcatttttagctatcaatccggacagccaaaagttgttatattttgggatggaggtagtagctactagagaagtagagatgcatgagaaaaattactaacctaaccctcaagaaactccggggaatctgcggcaatggcggctccctcctcctgcaaacatggatcaacggcaaccgcatgaactaaccacccacattgtctctaaaccattcatgaagatcatcgtcgtcggccatggtgtactcactggttctgcgccgcccggagcacgaaccacgtgccggcctcgtgcgccggcggcggcggcgccgccgccaccaccgcccccaccgccgacgccgacgacgaaggccctgggcctgggtggagcaccgacagccgcagctccggtagctgcggatcggccgccgacgttgatgggcctgcggccgcctcatggtgggcgtcggttcttggccgtttccggcgagacgacgacggcgagcccggcgccgacgggccgagcccgagctgcagcgacaggccggcggcgtcggtgccgccgccaccgctgctgctacttgtgctgggctcctggtgggcgacgtcgtcgcgaggcggcggcgccgtgattagctcgggttgctgctgctgcggctgctcctgcggcggcggcggcggaggggcggcggcggtgtccttgctctggcggtgggggtgcgaggggtcctgtgccatggacctcaggaaacaccacgacgacggcggcgatggcggcggcggcggcggcgggtgttggctgctatcgcttcttcttcttcctcttctcgtatcgaagacggtgagctggaggcggcgaacgtcgacggcggccggcccatgggcgtggcggtgcggccggagcaacgtcaccatcctctcatgcctcctcccctcttgtggcgttgcgccgcgccgcggccgacaccacgatgggatgggaggagatcgatcgatcgacgagaggaggaagaagaagaaaaggagaagaatgttcaaaggagaagagtggctttcatatataggtagacaagctcatttaatgcacacactaatcactttttctaatctctctcactctcagtaattaagtggtaatagggtttagagagagaagctggtaagacgtcaacggcgattgcacagtgcccaactttgatccgtggatggaagtgaatggatggatggatgtactacaagacaggaataatttatgggaaaaggggcataatattgtgctgaggtcatcacatgccatgcactatagtgccatttgtgctgtgcccccctctgatcatgactactagctagctagtttatggttaccaacacattctagctatgtgcacatctactggcttgtgtggtttttaatgtatattatcagccacttaattgctcagtaacaccataaagatcaaatatccatgtgagctagaaataaatatatatatataacattgatgtgtgacttcctttattaaaaagaaaacattgatgtgtataaatccggtactccctccggtttcatatttccttagacgtaatcttatttacggaataattcattaaagtacctttgaactcaccttttcttacattggaaataaaaaaatagaatcaacaggaaatataaaaccggaggaagtaaaataaaaacagtgtttttcatccaaccctcgatttgcatcataattttgccactgatatctacatcgacagaaaatatagaaccggatgaagtatacttttcaaaaattttcatatttgtagtgcaactcatctagaacacgagctagaagtcaacacaaatggttcgcggccgtctgcgaaataacacgacatatcacggacgattctgttgctacaaacttcagttattgttactctaatagtggtgctctgctgatggtgggggcacacatggatgagacagtgcttactgctcagggatgatgcatgacgaaatgagttgaccctagataataaacacatagatctagctagctaatatagcaattaattgtagtaaattaattactccctctgattcaaaatacaaggcacaactagatgtttcataatataaggcgtgcatgcatatatgacagtaattaactatgaccttctctctactaaattattgtattttaaatcccccacccttaaaatctctaattatattggatacatggattctatttatcggagtgatccaaacgaggtgatgataataaatatttcttaatctttgagttacgggtggttatgtcttatattttgaaatagaggaaatataagtactataagctaattgaatcaaaaccgtctgcattaattatctctttatttaaaactataagaacaatagacctacaagaaagaacaaaaaggatctaagctacctcttctctcttctccaactaaaataacaaaagaagtggatctaaaccatgcatctccctctcttttctactaaagtaaaatatactccctccatttctttcacttgtatataaaggacatatatagtcatagtccccgattaatgattatatttttttttatttttataataatatatttataaaactataaaaatagaattgcatgaaattattttttaatgaaactaataatatcatatttcacacatcaatatcttaatattttttaaaaatattattagcgagtcaagattttgaggtttaataattaaaaaaaaatacaacctcgctaagatgtaatcttcaaaaataaagtaggccctccaccaaatctcctaaccttagatctacaaaagaatatatggaccaaattaatctcctagctatctgcaagcctgagcttaagcagctcaaaacagctctaacagacaaatcagtggtaggccgggctcctggtctcgagttgtgtaataatgcaagacagttttttttttttttgcttagatctgcatgtgaatcattgctcacagatttgccaaagaaaccatgaataggagtatatattactggtgacgtttagtgcaatatatatatggtaatcgctccatgcctttctcagttgatttcgtagagagaaattatcactgcagagagccacatctgtttatttttagtactcacatttgttcatgtacatccacttctgtccctttgactttccatgtagaagacagaaaataaattataaaaatcaattataaaaaagctgtaaaagaagttcatcggctcagtatagaaaaccatttcctaaaaaacttttaacggtgaaagagatcttttcttcttagaaaccaacttgaatttccctcgcaaaaaaaaaaagaaaccaacttgaattctaggaattacaaaagaaatgttaaaataattagaaatttaaactcaaaaactcaaaaatttaaaatatataaaaatgcaaaaatgttgaatcaacattcaaactcataaataatcacagagaaatgacaaaagaaaactcagtgcggtgaggccaacgagcttatagctatgttgggtcatcaccatcttcaccttgcacttctagggctgaaaacaggacggattcagatgaatacagtttatatcacctcatatcccatattttctaagcggatttagagtgggtgcaccaggtgtgtggatacgggtgtagagcagattgtttcggatgtcatgactggtatggagtcggtgtagaggcacggaaactaattaaaattgttggatgttacatgtatatgcaatcaatacaacatcaaactagcaaaggcagaagcgggaaccaggaggggcgtcgctttgccactaccgtgtgaggtgtcatcttttgctgtgttgtcacaaggtggaggcatgagtcatcgacatgtggatgtttcaactggaggcgcgggatgaatatcaacgcgcatcacttgccactcgcctagtgggtgcagtaaaagcatatcgtcttagcttccatctaccgtcggctgtgggtgtcaacggtgtcgtaagacgaacgggtgagaaattattgaaggaagttgagatggtgagatgagagctaggtttaggggcagagccatattaattggaggcacacctagggatcagttgtattatttttaccctaattctctataaattcaaaaaatttatgcaatttatttggaaattacatggaatcattgtcctaagcctagggcttgagccctagctgccctatgcctagatcctccgcttgctagattaattgatggattaattgggccattcagtttattaatgggctgaggaagtcgaattatccgtcaaacagttcaacggataatctaatcaaaatattggataatgcgcatccagtgtatttttgcaatatatatgccacatccaaacccaatacgcaccatatatactactcctatctgatatgttttcatccctctttttttttatgcatttgagggggaggaagggagggtcgattggagaggataggaggaaaaagaaaaggattgacggctgagattgtcttttaattaatcgaacggctcgggggataggcttcaattcgtgcaacgaaatcgtcctcgaggtttctgttaattgcgcacttatgcttagtttctccttaattttaattgatttgtctcatgtgttttgtttgcttgtgactgcatggatggaacacacgagctgtaattaaccaagttaatgatcaattatcgatcgatgggcctgtgcatcgcattgtacgttcgtacgttgcacctatattgattttgtagttaattatgtgagtgcattgcatatggttattggcattgcttataaaccatatatactgtgggatgaaacacaagtttggaaggtgattggctgctttcgcaacgtcgtagtacgcttcgttttgtcacatcagatgggagtacgtacggtgtgcgtgcgatggtgcccaattaactgggatccacgctatatatatatatatattccttccttcagggtcctcttccttacctgaccatacttttcctttttcgtgccatatatgcgtgcagtatctattcacgtggtatgaaaaatcggacgggataaatccacagggccaacaataattgttggtatatacttcatatcatgaatacatgattgtttttagtgactcggatccactactacagaaacgatttttgcatgtggctatttataaatttcgcaggcgaaataaagatttttgcatggcacccgcaagcgaaaattgttttcttagacaggcatgctaaagccgccctgctctataattatggcaaaacaaataaaaattccaaaaaaactgcaaaaccctagcccgcatttagccactgccacacaacatccccgaaacactagcccgcatcctgaggtcacccacgacacgatgaaggaggacctgaggcgtgctaaggaggatccgctcattgccgccggccgcttccaagtccggcgtcgccggatctgtccttgtgttgttgtcgtcgttgtcgttgccctagccatcgccatcgttgtcttcattgtcttcgttgtcgctaaggccggtggaggtggattcgccgctcccgagtttggcgctactggatctggcctcacgcagcttgccaccgtcatcgtcgttgtcctagctattgccgtcattgtcatcataatcgtcattgtagccgatgccagtggagatggatctgccgctcccaagtctggcaccgctggatccacccatcccgggcccgagggcggcagatctgctgccgcgtggctttgtcgcagccataaccaccgttgtcacggccacggtggaggaaagggagggggaggggatggccgttggaggaggggtaaggagagaagaagagaacagagtggggttgggggggagggaggagaggagatattttaagagagcagagaataaaagagggggaggggatggggcagctgactggatgctagaaaaaaatcatcactaccctaccaagtcaaatagcaaacatcttatgaaacccgaagcatcaagtagagagcataggagatattgctggggctcagcatgccagtcaacttcagcctgagacatgcccgacaaaccactcgaagatggcgaccagatgtgttatacatctcaggagacttgaccaaatcgctggagctctacaacatctcaaatgctctaaactcatactcatgtgaaactagttcctaggacaagcactagcttcacattttcatctaagcaatgataaacagaaataggacataaatagaaaataaaactcagattactactagatatatttacctaggccatccggcctaatatataataatatgtggaagcttgtatacccgttcccacaagcagccgacgggcctcttcacaaatctacctgcgaaaattgattttcgcacgcgatccttgaatcgtcctaggggagaaatttttgtatacgaagatagttatagtccgcctgcaacctagaggtagggatgaaaacggagcggatagtttccatctgctccagacaaaaacggatacaaatacctttcggatcggatatataattctcggatagttcggatacagatacgaataaagatattttctaccggatacggatacagatatggtattgggatttccgtcggatacggataataattcggatatccggtgaacagtgctatttggatatccgtaaaagccatgagacatatcgcatttctttctaactctataaccttcaaaatacctttatagattttaatagtagtttatctcttaacactagtccatactattaatattatttaaattttaaaaaatatttataaattatactttattttatataaaatgagctaattatatatgttgatatttgtttctattagaagttgagttggttttcgtgttccgagaaaaaaatattttcgtattcgtgtccgatcatattcgattcttattcgtattcaagataatccgtatttgtttccgtattcgttttcatatccgataaaaaatataaaaacgaatatggtatgagcattatccgttcgtatccgctccgttttcacccctacctagtgggagttttgactggaaaatcgattctataaaacaaataaatttttattaggatacacttatgaaacataataaatttttaatatcaaagtagttttaagacaaatatatgcatagcattttttaaaaattttccaactaaatatttttgaaatttagtgatgaccaaaatttcacaatcttatgctgctacctttcttttcaatttttgttctctatgttttgtaaggttccacctatgataaaaattccatccttttgtcatgtcagaaattttggttgatacatatataagtgtactaattgagaatctagtggttgataagaataatgagctatagataagggggggaaaaagaaagaaataaccatgcatcttattaattagacgagaccccacaatattactcatcccattaattcaatccacagtaagaaattgatgagatagtacgcatcatgcatcgctataggcggctggagatgcactgcagtgccgatattaggtccttgtctcacgtcgtttcgatcgatccctggcagatgagagactgagagagagcaatctggaatggaactgcaaaactataaaggttttggaacggaatctgcaagcatcctttcagctgatggcccctgcattgcatgcagtagtagcactcgccggccacttgatcatcttcgtgtctgggcaattgtcggtcgtcccaaatttgtgcatcatttctaaatgtgtgtgcatgttgccggcctggagggtgagatttacagagttaccacaaattaaatacatatctactccatctgtctcaaaataaacactacgctggatcaagtcatttgtcgtagataagtggtcactgatacctgtaagagttacctttgaccgcaatcaaaacccgttacatgtaaccttcatatgtgatgggtagttattttaactcgtcattggtgacctttatttgtcatggacatacattttagcccgtcaatggtaacttttatctacgacggatcataattgggacccatcacaaggtgaaaaattgaaaaaataaatataaaaataattttcacctagctagttatagacctttatctgggcatttacaaatcacaaaaatcatcacaatcacattcacattcatctagacacaacaaaatcacccagctacggtggagcttatccaactatttgcccggtggagctccgctccgccgttcgccaccactagatctggtgattcgggctagacatgtgcaccaggcagtctggggcgttcagatctagagacaggcgccgacgttgaccgagttggcggggggaggtggggtcgaggatgctatggagttgtgccccctccacagccatggtcgcctccatcactggttccttaggtggggtgaccaaatccgggcactgcaagctccggaaaggcttgatctaggtgaggccagcccgcgggcggaggcaaagttgacgaccggtgcttggggttgtggagacggtggccggcactcgcggtggagaaggcggcctccagtgcgctcgagctagaagatgtagaggacggattgcaggtggaggcagaggcaatggccggcgcgagcgagtagaggcggagatgatggaggtggagctagggttgcgggcactaggttaagagagtgatgatgcgggggaatcgagagagagggttgataaggcttggttggatggccgaatagataagattaaactcgttaattaccaaatgacgggtaaaaacaaaaaacaatttaagattaatttttttaccattgaacatgttgtatttatcgcccgttacatatgagtgttctcatctctgaccaactgtatttataaacccgtcacatgtgtagggtcatctatgacgggctgacatgtgtgcccgacagatgttacctttgtccagtgcacaaatggacccgtcacagataacccctaacctgtgatgggacttagcccacggtctcatctataacggcctctagtccaacccgttacagatgaggccatccgtggtaaggcagtccaagccatcatagatggtcttgtttgagatgggcaaagcgtagtgaaatcaattttaattttatacatgaatcataatatagtttatctccatatctattatatactaaaagtccattaaacttcctagaaacgctctcaagccgccacgtgacgttcctataaatactcctagaccgccatatggcactgttaaatctcaccatcgattttcatttaaattggtggacccaatactttagactattagattagatgtgttatttttttaaaaaaaaagaatactttcgcatctatactgtgggccggacaaagaaacaaaacgtaagttatctttgtacgtacgtacgtacatacggagaagaaacaatgaatcttatgtcctcttcaacggaagaaaagaaaacatgtaccgacttacgataaaaatgattaataagtaaaaaaaacatacgtaaagcaggtacgtagtgccactgaaaaactcgatgctccataaaatatgatattatactattttaaaataaaatatattactctataaagttatgcaaatatacatagctaaactagatcgtttacaatataaaaataaaatatcctatgaatactctttaaacatcctatctataaattattttaaaatcatatatctaatttgtgatcaagtcggatcctctaattaaataaactattgatgtctatgttcataaatacatcattatatatgaggtcaacatataataaataatgttataataataatcagaaaaataatgaattaccccttaaactattacggtcgaccgaattacccctataaacctaaaaaccggacatctttcaccctcaactattaataccggatgaattacgttccccccctaatgcggagtggtttttcgtcctacgtgtcaatttagttagcattttcttaaaaaatggtaggacccatatatcatatctcttcctcaccccttcatcatctctctctttcttctccctccacatatcaatcagcaaggctaggggcggcaagcggcggaggccactcctcctcagctgactcggcagccacatgcgcattccaatcaaggccgtcgtctccatcatttccgttgcatatcgttgtcgcatgatgagagttgcaggtgccggaggcgagaacctgcgctggtcctcaatggccaggttctgctacacccctgccatctagaacttggccaacaaatacggccgcagctatgtctaccatagcatgtcgtcccaccacggtttttaatcgatccccatcaccaatgcctctctcccgatgagacaacgaggcggatcaatcaagcaagcaagcgtaggggaatagacgaaggaggaggagaagagcggcggggtgacagtgtgcctacccggccggtccagtagcaatgggagggagaagagagaggctggggaatgggattcaggaagagaggcagagaggtgagagaggagaggggtagagagggtacagagtgtcacatatggccccacctattttttttttaaatacagactggactaccatgtagggctaaaattactccaggttgagttttttttggggggaggggtgggttaattcatcttttattaataattgagggtgaaagatgtctggtttcgggtttatggggtaattcagtcgaccgtaatagttagggggtaacttgtacttttcctatttcaaataattttacatcatattctaggtgtcaaataacacttgatgactatataatgctaacttaaagctctatatgtaaaataattgaaaacaacacaatttagttgtgtatttttaagcagatatgatttagttttaatatgtctgagattaagattctcatcttttttttaattgttagaactatttcaatagtatatgataagtgggcaacctaaatgttacataaatgtaaaaaataattatgaaaaatatttcaagccagtgatcttgctataatataaccatttagtccatcataggatttatggtcatatatgtatgtttttctctttgtcaaatagttttgataacaaatgaacaatcaattaacatgcgcaataaactactcatgatatattttttttatagttgaggaattccaacttatcagacataatttgatgaatgtatgtcatgcactctattgatgtgactatgaattatacttcaatcaattagttattataaataagtttgggaaaatagattcattctctaaattaattagtaaaggtatcttatgtgattatgaaaggcgttgaaaaatacgatatgcaaaattatatatatttgtcaaaatataaccaacaatatggtcctttggagattttatcgtggtagtattttaaaaaacactttattcaggtaagaaaatcacatatagtacaaatagaaataaaaaaaactccattattccattattgttttattatcgtgacacatgttgttctcataaattcatgtcattgtcataaatttagggttgtatggtttcatgtaatatgtcataaccagatattaactaaaacatgtttaaaatagagtgaagatctattttgaaaatataatctaaatgtaaacatttataataaaaaaagttaagcaacattaaataagtgtccgcgcatatgcgcgggctatttatatactaaaagtccattaaacttcctacaaacgctctcaagccgccacgtggcgctctaataaattaaagaaaatcctagaaattataagaaaaaaagaaaaacatccaccccttgattttcacttaaattggtgggtccaatattatacaccgttagatgaaattgatcataaaacaaaccaaatactgtggggtcccacctctcctcctcctaccgcgcatgtgtgggtatacgtacgtaacatgtacgtacgcttccttcccttcctcttttttttttcctttttttcttctttttcccatttatataatggatattttttaaatcaccataattttacaaacaaacaaatttaccatcatacaactcacatgtaactaaattagctctacaatttttgaaataaaatttacaccattatatgttaccattaaattaataatgtaatataatttccactaacatatgtactcattattttatactattattttcaaataatgcactattttaaaataaagtttacacatctatattgcgtacctatcaaataaacaatttaagatctatattaactgatttatacgtacacttaaactgatggacccactatttaaatcattcgaactatttttattacattggactattattctcaaataatgcattctttcaaaataaagtctacaacattatatactatatactgtgtacccattaaattaacaatttaaaatctatactcactaatatgcacttacactagaaccactagacccattatttaaatcatttgatatattatttgctaataaataaagcgtccgaaatcgtctttttggcccgctgcacaatgcacgtctgcacctttgccttttgcacgtgtgtaaagcgtcgtgtctgaggcatctaaggtgatcacgactgccgcagcactaccgctatgccacatatcaaatcatatatggagatgattaattttgttaataacatggaaagaaaattaatggtatgatgcagcgagagaagaattaaacactgtgggttgtgttttttccaacatttagctctgtttaagctgaaaccgagagttgattacagaataattataatgtatcgtgttatgtcatatttggattttgtactatttattcatataggtgaaagaaattattatattataaatctgagcacaatattaacgaatatcaagagaactcttacaaagacaagggtgttataagggagtttaagaccctcttttttttctagattccatagttggatttttgtttgcacgctttccaagtttttaaatggtgtcttttttaaaccacattttaactttttagaagtcaatttatttgtttataccctcaaatagctacaacataaatcagataattcatcaatttcagctgtcctaaaccctaagtagtacgtatttttttttcatgcgagtgatggtgatctgtaaattggggatcaacggataatcaaagtcgtaagatgaatatgtaagagctactataaacaactgtaaataggtgtcaaaattaattgctattaattagacatctaatggcttgctagccacacaattaatttctctttacatgcatataaacatgcaggaagctggaacaaatattaccatgtgccccatacatatatattaagctacatgcatataaacatgcaaaaagctggaacaaatattaccatgtgccccatacatatatattaagcggttaatattttaattacatgtgttaagtcctttaaaatttattaaaatgctctcaaactgccacgtggtgctctaataaattagagcaaatattagaaattctaagaaaaaaagcaaagtatccactgcttaattttcacttaaatcgggacatccaatattataaactgttagattaaattaatcttagaacaaactaaatactacaagatcccacctctcgtcccgtggcataggtatgcacctacgtacgtgggtacgtacgcttcctctcccttttttcatttttccctttcttctttttttccatgcatacccttctctctttttcttactatatcatgcgcctttatgggactatttaatcacaagaattttgagtatcttgctctcgcaatttttatttgtggctatactacacggtaggtatgcatatagatggactgtatgataattaactagcaattgtttcttatttactcgagaaaaaaaatgattcaaaagtcgtaagtacttaatccttctcttactcaaaagtttgtgaatggtttttaagataccttaagaaaatagaacccttaaattattataaaataatattatccgaactttagtttgcccttaatttatgagacaaaatttttgaataaacaataatcttatcttttaataatataagtgcccacgcatgcgcgtgggccaccttcctagtttatatataaaagttggcttattttgggatggagagagcacttctcatctattatgatatattttcggtttaacctcaaaaccttaaaatactaatagatgcagaaaataggagaattgacatctaaaaaaaagatatagcagtagatttgtcttccaaatattatatttaatttctttttagtaatttcataatgatacgattagagaaggaaatgaccaaacatgtacataacatactatgtcaaaaattggtcccaaaagccaggaaagattcaaaatcatttacccacacttatggcaagttttagctagaaatgaacttataacctttgatgcagaaccccatttaggacaggtgattgagaaaacatatgaacaggaaaatggtaggcagagtctcaatccattgttccaaataactaaaaagattttctcataaaattcagatcctacaaaattcctttaaatatcctttggtccaaaaggggcctaacccttgaattccctcaaagctctattttccactctgcagtgcctctgtttctgtagttcttggaggacttttctatggccgcccctacaggtgaaaacttacaattgctctttgttttcaaatgttaattttcttgaaacattggaagataaaaacaaccgaatttcgagccaaatggcatatttcagctataattttgtccaagttcctatttaaattctggaagtggagcattgtccggtacatgcctacatggaatttgcacatttcttaattaactcctttcttgaactgacttatcggaatagagtttccattatctattgcaaataaaaatagttgcatgcattggattacttaatttcatgaatcattgtttgcaatactgatgaacaatgcacatcgattacgtacctaaattggttatttatacattttaatgcacgttttgtatccctgaaaaaaaaagagtgcacgttttgtattattgatcatgataacacatatgcctaactaattcaaggactcattggcttcatgacaattatcagcaaagtatcatttgaaaaagaaaaaaaaaagaggaaaaaacgagtagtcaacttactagtgcatgccatggggaagtccactatgctgtacagagagaataatgccagctatttttgcctgcacaggggctgcagga

SEQ ID NO: 67589 - DNA, 4734 bp, Oryza sativa
ggggaatctgagaatgtcttgtgctttaaattaacaccatatcatccatcggtgcgaagtcgatcgtcacgaaggcgtgatcagcgatcgtacctttgatgatgggtgcccaagtactgggtttctgtacatgttcttggaggtggagatggtggttgaaatctctcagagagaggcacactcccacacacctcatggcagcatgtcacctgttcatctctctttcaggaacatcttgttctacatacttacattgctcaattttgagcgattcgatctaatatgcggttttcgctttcggagaaggcgtccattttcgatgatcataccttcttctcctcttgcagctgctgggtgccttgacttgctaggaaatagtttgcagctccttttccatggatgctgacctcctactgtcccttagctgcattccctttccatgatgatgacatgctacttgaacacttttcatcagagtatcagattctgctgcaaggtgcttccctctctgtgtgccaccttgcagcaacattaggtcactcacccccagtgcataaaatctatatgatcttgcaaattgtgttttcctttttgagttcaatgtctctcagacaagttaggctggatcggtgttatttaccttatctttctttgggtaaggaaaggaagaactttgaagccaagacagggtaatatagagtagtaggaaagtggagctgttgcatctccaaacaattggaacttgtgtttctactttgccggcatgaaagcaatttttaagcaagtttatcatgaatgccccggcattgcaaacatggaccttttttttatctaacaaactcggtgaactttttttttcggagcttcgaaaatggttgagtggtatggttcaaataagagtaaaaaacaatcaaatcttgggatttcattttttttccaataaaacccagtaaaagaaggtgcaatggaatttcagtagaaggatgcaagaaagagaaagttctacagggtgcagaatataggcttcctgctagtagctgctgcacacaatgtcatgggactgttcatgtgcttggttcatcagggaaaatgataagacatctgcaccaattattgtgagtgcctatctaactttgcatgttcctgtttacattttaaaatttctttcttcatttttcatggaaaaaacaacagcctaatcaatgcctgaagtctgaactctgttcttctctacgttattactgtttcaacaggatggcacagtgttattgatggtaacggttttctctatctgttaatctgacctgctacataattgtcatcatttttcttaaatctcctccattctggcaccatcaaaccaaaatctctttaggagaaaaaaaccaatccaaaagcaaaagttaatttgaaaagaaacaaatatgaaaaacaatatgttactacacatcaaaggacaactaaaattgtgtgcatgaagacgtaggtagatattgtgtcatactgtcataagcaaaggctcaaccaaacgccactagatagataggagcatcatcaacttcacctaacaaagaggcaacagtatcaccggtggagatgatggatgatgagtagtagtagacaggcagccttccaatggctaatgcacacaattatagcataattaacacaccaaaagagccatgattaacctagagaggaatcatttggtaattggaggagagggctcatgaggaaatatgcccaagttttcctttacttcctctcttttctccagaaaaatatatggtgtgatttctccttttttgttatttatatgtgatgcatagaccaagaacaaaaataaagggtaatgttatacagatttttctttgcaaaatatttttcaaatataaatgttaagtaccattgtatttctattacattgaagacacattgcatatggtgcccaattttatgcatttgagtacctgatggagactacaaatacaaaacatacacccacgatgttctagtaattttgccagatctttctaaatattttttttgaaaagtatactatctcagtatttcttttcgacaaaaacattttttccataccatcacaaaatgcagtttgggtaggcctagatgaagaaggtttcttattcaacagtatcggattataggatataaggggtttaatttcattttttttataaaagatttatataaaaaagtggtgttttagatggtacctaattctgaggcattgagtacttgggatgcaagggtacaagtacaaaatgtgtaagacacatgaggccggagaaagtggttgtgaacttgtgatgggatgttcgttaaaacttaaaagttgtgtcgccttaatatttatttatttagcacttcattgagggcatttcttaatgttaattattcgcatagtctcacgtgctgcttacataaataatatagtccttattaagggaatggggaatgatattgatatatgtgagatgtcattagctaagctattaaatacagggacttggttcctctccaaaaatatatatatacagcgacattgctgccgaaatactaatcatgaaattatatttcattgctttaatcacgtgttttcagcttataaacaacagcaaaggaactcaaccatattataagagagttactccctctatctcaaaataaattgagttcgaaatttgtttcaaaagcttaagtccgtaaattaagaaattttatccattcagtatcctttactcatacatcgatactacttttactttgccttttttacaccactcattttttcttgggatgtaatggttcgatttattttgggactgagcgagtatctctgaatcaaaatgttcatcttagtgtaaattggattgcccaacttctttatgtatattaaggggacatggtttctctagtatatatactccgatagttctattttacttattgtttagatattaacaaagtcttcattagacattgttcactactacatttacaatattattaaaatgctatacaaaagtacttttatcatgaactactaattactctgtgccgctgcacttaatttaactgttgtgcagccaatacaaacagtgtgttgtgtctgcagctacagcggctacggctgcgtgcagcggctgccctgaccagccgaaaatgcccaatatatgtttatagattaactgtgatatttgtttgtatgcatgcattctaaatctcaattagtttttttttttgctaaaacgaattgcacataatgtacaaacctcatgttgttgcactctaagcatgtattagtcttcaattggccgccgacaggcaggcatcaaatcgtgaaccggaggatgtttggtgaagcgtacggcatcaggaccatgaacactttggaacggagctgcctagtaaatactaaacaaaacaaaataagtttagggagtattagcatgtagacgtctattaaaaaggacttttaaatttggtttctaaagagaagaaacaaacaaagggtcgacgcagaaaaggacattaccgtgacggctattgttgtattttaaatttgattgaattcagtggttttactttctttgcagaaaggatgttgctcattagctccttgattaatggacatctaaggcctcttatatggttaacaaatcacatcagcccaaaagtagtgtagaaccatcgatcgtatatagcaggccaaatggccaatatatatatggaaaagtagaccattttacaccctaactaactaactataactatatatatatatatatatatatatatatatatatatatatatatatatatatatatatatatatatatatatgtgtgtgtgtgtgtatatagttattcagcacataaaaaaatatcgaaaaacgtaggcattagggaggcttttttctttttgcgagtgcagcttataagccaagaacacttgatcaaagcaaacggaaaaccagttttagactaagattttcatactttttctcttggaagtctagcatgagctgagcgacagaaaaaaaactaaattaattctaaaattaagttttagaattgaaatttcaaattgtttgatgtcatttcctttcaactccttggtgtagaatcattaggtttattgtgtattccatatagtagaaaaatttattctaaatcccccaaaaaatgcacatgataattttatacatgactgtattttgcttaggcctcttctaggttgtagcactggcctgttgattaattctggcgagccaggcccaacgttttagaaagccggtattgcagagatactggccttggcctgaatttatcaaacataagttcatatatcaaatatctaggcctaacaaaatgtagctaattttaaattgaaatttaatatatttctacctatttattttgggttcaaacgacaccagccaaattaccagttcaccaccgttttttttttaacctaggctaggacttgcaagcatcagtcaggaaggtctgggatcaagaggtaaacagagcagactatgatttgtacaaataaataaataaaaaaagacctccctaggacaaagaaacagatcagactgtgtgttcgcacctcctggttgggaacacttccctccattaggaaaaacggagcatgccattagcacgtcattaattaagtattagtttttttaaaaaaagggctgcagg

SEQ ID NO: 67590 - DNA, 2177 bp, Oryza sativa
ggagaggcaaaagagaggacaaagacggtgagaagaccaacaacaacaagcccaacaactacaagtcgaagggttctaaccaagggaggaagatggagaatcttaggaaggtttttcaacaagtttgcgccgccttcgaaccactaagtgatgtagatggtgaaagtggagatgatgataagggaaagaacgtctcggatatttgcttcatggcgcgtggcgaatctgacacagagtatgaagataatgaggtgagtgcttttgaagaagctattaatattttgagtgcaaaaaataaaaagtgtgagaagatgtataaaaaacaggaatttatcattgaatctcttaagtctgaaatgataggttaaaatcttttattcctaatgatgatgattgtgaaaattgtgaggttttaatgaatgagatttcaaaaattagagatgttaatgctgcacatgatttgaaaaatagatcttctcttgcttgttgttttgctttgcacacacgcactttggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagatgaaactaaaagatgctttaggtcgtgttgagtatatggaagatgttgtgaaaaacaatgaagtgttttcttgccccaaatgtcgtaaaagcaaaggtatcatggtagattgtgaaaattgtgctaatttggaaaaagaggtttcttatttgaaaaattctttgctaagattttctgatggtaaaaagaacctcaatatgattttggatcaatcaaaggttagcacaaataaccgtggtttaggttttgatcctcatgctcataatgctagacatcctcctgttgtgttaggtgttggtgctagaagaggtgagattttggttaaacctgatactaataaaactgtgtttaaatctgctggtatcatgtctactatgaatgcatcttcttcaaaattcaatgttgtgcatgcaaaacctcctgtttctgcttgtgttgctaaatcttcttgctctaacaatgtgtctaaacaacgtgaaaaatatgcttgttctttttgtggaaaagatggacatcattgttgatttttgtttcagattagctcataaacagaaaaaggagagagagatcgcttttgcaaaatcaaagtggcaaaaatcgggttttccctcgaggaaaccggtcagaccgcagtgcgtcccgcggtcagaccggcgaccggttagaccggctggagagcctcggtcagaccggacaccggtcaaaccggcagtacagaggcggtcagaccggcctctggtcaaaccggtcactgtacctcggtcagaccgcctcggaggaatttttctgaaaattctaaaattgattttgcacgtggatatatgcctattggatcttctggtcgtgtgtctcagtactggattcctaaattcttattatcatctaaccccagtactgaggcttcgacttctacttgtgtgtaggctttggtggcaaggaaggagaacgtgtggattgtggattccggttgttcgcggcacatgaccggtgataaaaattggttctcctccctcaaaaaggcatccaagactgaatcaattgtctttgccgatgcttctactagtgccgttgtcgctacaggtttggttaaggtaaatgaaaaatttgaattgaagaatgtagttttggttaaggatttaaagtacaatttgctttcggtttcacaaattgttgatgagaattttgaggttcactttaagaaaactggaagtaaagtttttgattcttgtggtgattctgtgctgaatatttctcgctatggaagagtgtttaaagctgattttgaaaattctgtttcacctgtgataacatttttggttgctaagtttgataaagatgtgatgttttggcatcgtagactgggacaagttggttttgatcatctcactaggttaagtggtttggatcttgttcgtggtttgcctaaacttaagaaagatcttgattggtttgtacaccgcgtcgtcatgctaagatggtttttacttcacatgctcctattgtttttgtgatgacggatgc

SEQ ID NO: 67591 - DNA, 5529 bp, Oryza sativa
  unsure (1)..(5529): unsure at all n locations
cggagttggccatgactgtctggaagtagaactccatggggctcagggagttgctgaagtacaggagcagcgtccttgggaggttgtcgggagccaccaagcaaaactcgactaagtcccggctcaagatcggccttggcgagcctgtgcatgtttcgcatcaatttgttagtgaatgacccgtgcgagaaatgacgtggactcctaccggaagcctacctctgaagagctcgaacgcgtcaggctttgctcgttgccccgacgagaacgatatctcggcgttggtgctctgcaggaggttctggtcgacgacgaccgcctcggcgccgccggaatccatcctgtggtcgatgaagctgagccccctccgcacggaggagaaggcgtagagaaggtctgcacaaacacgatcgccagttcgccacatcagcatttcatcgcttgtcatcggtggcatcgaaggcaaacaaccaacgggacgacgtcgagcttaccgtccggcgtgacgagtgggtagtccgacgcgccaagcgtgacgagccagtcccactcggcgccgaccctcagcaggacagcggcgccgcggagcacggcggcgacggcggacggaccgcggccgtcgacggggtcgcccttgccgacgacgtgcacgttcccgtactcgaggaacgcccgctccgaccgggcataccccgccagcctcgcccgctcgtacccccccgccccggcgtccaggtgcagcaggtaccggttcctcgggtggtacacggccttgagcagccgcgtcatccgcacgctgtccccgtgcccgccggagatgtagtacgccagcaccggcgggtacccgggcccccgcctcggcacggccgccgccgcctcgacaacatcgtcgtactcgtacgccggcgcgccgaggaagaaggagctcgacgcgtagccgatgatcagcaggctagtcgtgacgacggccagcgacgcgagcgcggccgacggcgagcacgtctgcaggagccaagaaccgtgcggcattgtgcaccacgtcgggatcctcagccgcgcgccggagagatgcatgagccggcgcgtacactacaagttatagtcaactcctcaagagatcgatcacacaagctgcctggcagatggaactaaccgggaatcacattagttcgtgggggagcagacataagccctgacgcaatgatgaacgggatcggagtaccaaacatcgatttacaccaatataaaacgtgtaggacagaattagtaggataccaaccagcggagattttttgttttgtttttgttgtcgggatgctacggcctacgcgcgagacgtgcatatggaggccgtggatcggtggatggaactgtgcggcagacgtggttccaaggaggggaatccagcaaatcgggtgaggaaatgatagaaaaaaaaggagcagagtatatggaagcaaccggcgtgctgcgaagctgacgaacattggaatcgttgtgcacttgtgcttgtgcagatggatcgacgctgacgctgctaatttctgtcgcccaccggccggctgccgcgcgcatacgcgatgaactgtccaaatcagagttcgctgcgtagtcgcatcgcatctcgcatcagtcaaactagttagtttccaggcttctgctagtagagctagcacacatctcctgagatctccccgctgaggcggcagtgtgtgtactaccctttatcaaaactacaattttgaactaaactgaaacaaagtgaggtatctaatcttggacgcgcatgaaacttggctagttttacctttccctctatcgaacacaatccagggcatttggtattggacgagaaaaggctagacaaaggctaagcattagaccgaaaccatgcattgcattgcacaggcatcatcatcctgttcattcgtgccgaccaaaagatccatctcatccttcggaaaatggaaaaggatccttggggcttgggcttcggccactgggccgaccacgcaaacccaacacatacttgctcactggccaggcttgtgttggaccacagctgcgtaagcccaattcgtcgtgacttgctgctgccatctggctgggccgcttgcagtgctagcgcgccgcgtgtttgcagttgggctagagtttggattcgaaacgtcttttgcgttttgccgtttgcccctctactctccccttctctcaagagccacagcgtaatgacacatttcccttttctttttttttcttttcttcttgttctatattttttcctcattttccttttcttttcgtgcgatacacctggctctgtacctgacccgcaccaaacgacgaaatacagtagcttggaggaaaaaaaatgcagcccttgcgtattccttttctgtcatatatggacttcatgaacatggtgtgatgccaccggatgagtaatctcaactgaacatacgtggagttcttgtacgctcgtttatttattctgtatttttgcgagaaatttattgtatatttcttaatttatttactgaatgaagcaaaccatgcgtatgatactacgctgcacatgctccacgatgaaaacaaccgaactgaaaagataagcatacgtgatgtgtcaggattaaaaaaaaaacttgagcatgcgtgtgcgattagtttgggggcaaatagatgttaagcattgccgtatttttcctcgcgcttttacagggggaagtttagacctaaataacagtctcgtattaacttcacaagtcatgatcccgccgtagatttcttgctcatatacaagccgaaaatcattaatacattgactaatatagcactatagcatccccataacaacggtaatattttcgatctgaggagtaaataactttatctgtactccatctcggtaaaaacacacaagaagaagaacacttgagttcaagagaaaaatactactgctccctccgtcccacaatataagacgtcccacaatataagggattttgaggttttacttacaacttttgaccactcgtcttattcaatttttttttcaaatataaaaaacgaaaagttatgtttaaaatactgtagataataaagtaagttacaaataaaataaataataattttaaatttttttaaataagacgagtggtcaaacgttaaaagcaaaaactcaaaatttcttatattatacgacggagggagtataaaagaacaatacttctataaattttgtatttggatcccagatagagaaaaaaaagcagcagcaaatacgtcgagtcacgacgcccccagtacagagagacacacctctccaaaaacgaaaaaaagaaatagagacactcccggaaggaaaaatcttactactgatgagtagacggcgggcccaccgagcaatcccacgttatccatcaccccaccggggaagcccaagcgcatcgtgacccttgaatccagcgagccgagccccggttgcgggcagcgagctcccctcctccccactccgtctccgtggctccgtgccttccaaagcgtgggaggaggagaaaggaaacggaaaattattcacaacgggaagccttcaaaaagccaagcccttcctcgcccattttccagacagcgtctctcggttcgggcctcagcgggcggtgtgtgtgtgtgcgcctccgcgagaccagacaccaacctctctctctctctctctcccatccttcccctcctcctcctccgcctcgccgccgccgccacacgccgcacggtctctctccccgaggtaactagccttgcacgcctggacttcttcccctctcctccttcccgtcgtcgtcctccctctatccggagggtctctcgggggacgccgcgttcgtgggctgggctgtctccatgtcggtggcggcggcggcgtggggggacgcgggcgatcgtcggcgcggggcccgatcttagagtccgtcgcgtccgatcgcgcggcgatcgttccggcgcgcgccgatctccccgtttcggcggcggaaattcggggttgctgctcgtgtttcatcggttggtgttggttcgggctacggttttcctgggacgatcgggggggcgccgatgatttggcgagatgtatgcgttcgttaagcccgatttttgatcggttttggttgggaaaatcagtgtcggggagatcgggataggatttggggcggacgggttgtggaaaccactgttggcaaatctgatggcacagtctgccgtgattttttttttggctggagatgtgatatggttaggagttgatgggtctgctattagatgtgaaatcatcagttggtttactcaaccttatcagtgttagtttattctaatccacatgtttttgagcagtataaatgcaggattaatccgtggtgttgtgactttttgggtggtagattcgtgcgcggcaggaagtgcatggggagaaaggatgccagagttgcgtagtggagtccggcaagctcggttgaaggcaaagaaggttgaggaccttgcagcacaggacccgctgagaacttggtagtggtggcaccgacggtggcaggaagacgtggtagaggaaggggtgggaggggtggaggtagagcaacaggaagaggaagggcaggaggaagagggcgaggtgttccggtgattgatttggacccggaccaaccatgtgaggttctttcaggagctgctattggcggagtcgctgctggaggcccccatcatatcgaggaacttgctaataaggttgtgaagatggatggtgggagtggtgagaagattggtggaggcgaagatgatgggaatgcatctccagttccggataaggtatattcttcatattgagctcttactaatntattatgcatgttatcacttgcatgcatttctcntgttattgtgattgcagacatgcactgttagggtttcggagatgacgacaaattagtagattttggcctggtaccacaagtgtaccgttatatcatattacgatattatgtcgttatgtgcatggttcaggtggaccaagcttttttctttacgtagatattggtaacgccttttggaacttattaaatgcataaaataattgacgtgataacaagcataacagcaccttccttactctaccatttttgtttttggcattgtttgtagggcaaggcaggtgcccctatttatgttctattcagaaatgtttccacttttttctatggatgcttccttgtcaatgatgctagcttgaagtttttgatagtacatagccgtagaatgggatggttgacctcacagaattcatgagggcatctccttatctgttaccgtgcgaatgccagtgcacatggtgctgtgcatccctcaacttaggcttactgtttgcttatatcatggaagctgttcttttacaacatagttgatctaagacgtaatatagttgtccccaaatctagtttggatgccactgtggagtttgtgcaatagcttggagtcattaggttcttc

SEQ ID NO: 67592 - DNA, 3309 bp, Oryza sativa
aggatattccaaagacagcattcatcactcggtacgggtcgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagccgtggatccagcaaatgtggagtcagttaccgagtggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaaccctgcctgatcagacgaaagatttccaggtctattgtgatgcatctcgccagggggtaggatgtgtgttgatgcaggatggcaaactggtttcttatgcttcacggcagttgcgtcctcatgaaggcaactacccgacgcatgatctggaattggccgcagttgttcatgctttaaagatttggcggcactatctcatcggtaaccgttgtgaggtatatacagatcacaaaagtctaaagtacatcttcactcaacctgatttgaatctcagacagcgaagatggttggagctgatcaaggattatgatatgggaatacattatcatcccggcaaggctaatgtggttgcagatgccttgagcaggaagagctactgcaatgttgcatgggtagagcaactatgctgtgaggttcaacgtgatttggaacatctgaaccttgggatagttgagcacggattcgtggctgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggcagtaccaaaatgtaccaagacctcaaagaaaagttctggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatagtgtctgatcgagggagccaattcacctcaaagttctggcagaaattacaagaagaattgggaacccggttgaatttcagcactgcttaccatccacaaacagatggccagaccgagcgagtcaatcaaattctagaggatatgttgagagcctgtgcgcttgactttggtggagcatgggacaaaagcttgccgtatgctgagttctcttacaacaacagttaccaagctagtctgcagatggcaccgtttgaagcactgtatggacgaaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagagagctcgctttcgaaacaggggattatgtgtatctccgtgtcactccgctcaggggagtacatcgcttccaaaccaaaggaaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcacatcgaaattcaggaagatctgacgtatgtggagaagccgattcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagtttccccctctccttgctttaaaaatttgttaaataaattgcccgaagaaattatcttaattaacctagagctaattccctaactaataaatgcaattaataattggaattggcatggtggaatttttcttgagttccccatgctccaatgcattaacaagatttttagtggaattttcagagccttggaaataattttaaccaattaaaaatcaccaaagtgcaattttaatcccaggaaaatcctttcttctttttctttttcctttttcctcctttttcctcttcttgggccgtcggcccagtccacccgtcgcccgcgctcggcctccccttgtgggccggcccgttccctttccccctctctccgggacgctgacaggtggggcccacctgtcaggtcgtccccttcctccagccacccgcctccgacggcaaccgccgccgaatccgccacgccgccgcctcctccgctcttcccgcgcccacgccgcgccgctcccgcgtcctccccacgtcgccgcctcttcccccgcatctcccggcccgtgcgcgcgctcgagagggcgggattcgatttcgaatcccacccctctttctctctctcctccccacgtcgccggctaaatcgggagggttcccggccacgtcctcccctccctcgcccattaaatcactctcccgagctccctctctcgttttccccatttgccgtcccctcccgtgtctcctaacgagcccacgccggtagccggtagcaccacccgttgccgcc

SEQ ID NO: 67593 - DNA, 905 bp, Oryza sativa
ggtcagcgcacgggcacccccgcgcgccgccgcacgccccctgagcgcacgcgcacccggacgaggggaacccgcctaggtcggagcgaggccatgtggggcctggcggtcgtgcccacgtgcgcccccacggctgggcgcggcggggtgaggcggaggcggaggacggggtgagggagaagggggtgtagaggaagtaggcgtagggcttgccgtcgacgaggttgtcgaaggggatggggtgaggctccagcccgtgcgccgcgtcggcggcgcggccggcgctgacgctggaagcggccgcacgcagggcgcggctggcggaggccgcagcggcgaggtcttgcggcggcagccacggcaagaccagctcggccaactcgccgacggcgccgggcgttgctgagtttctcatttgagcattttggaatggaacagacggtatatccagttatctatagtttcatctgcactagaatgagctcgactcgttgattcgttgcgagttcgatgttcgggaggtaccaaattttgtgatctcgacgaaatttgaaaacaacaaattgcacctatcaaaattttgactatgccaaggtttgcccggattttggcgctaaggctgtgtttagttctatgctaaaattagaagtttgaaaaaattaaaataatgtgacagaaaagttggaagtttgtgtgtgtaagaaagttcgatgtgatgtaaaagttagaagtttgaaaaaaaaagattaaaatctaaacagggcctaacaaatgatgacaagatctatttatgcaacaagatatacatggtagtttcataaattttgacaatttgaccttttgcaaaaactatttttacaaatgaaccgccgccaaaacttatttcaaaaataaccttttgttta

SEQ ID NO: 67594 - DNA, 683 bp, Oryza sativa
cgcattttctcgtcctgttgcaaactcctatctacatgtcagcatcaaaattatgaataaaatcaccgtgtcccgatgatatttttgcttgtgcttgtcgtttgcttaattcgttgtatattctagtgatttcctctctaataatgtgacagttgcttgtgaggtgttcagttcaccagagaatttagatgtcgagttcaatttttagtcggagccggggatgaagtagacgagttgatgttgtgttccagcgggtcgagcatcatcgcctcatcggtggcggtgacgcccggcgcgcgcgggattgcgacgtgatacacgatgaacgagcatcggcagctggatggatgctgtacgggcgctgtgtgaacatgatatgcacaccgctggcagcatccaggttccagtggacatacgtgcgtgatttctgatctgccctttgcttggccccaaaggtcttttggtgcttgggatccagacatgcagcacaggacaaaaggtacactccaaagtgcgtatcacaaagtgagaaatcatgctatttcgtcggcagttatcattttatttatcgagtagctagcttgcacgatactttcatgcttcgaatgtaacctagaatttatatattctatattcgcgtgaaattcttgatagtgtcgatatacaacattatgacattttag

SEQ ID NO: 67595 - DNA, 8125 bp, Oryza sativa
ttatggagcagtgggagaataattactacatcagtgcgatagcgggtgcaacaaatggaagttccttggtggtcatgtcaaaaggttgtctcagctgttcttttgttggaggtctctcatgttactaccattgtattcttcataaaggaccatctatgtttagaaacttggcctgtttctctttccattcacttcgcaggtgtctcaatttttttttgggaagatggttgatatgtcctgatgtagtgatgtgtatatattgacttgcatgttccacacacttagtgtttcttttgtttatgtattatgacatgaatggggttagtctgacatggtgatttactctttccaggaactccttacactcaacagtcttacaaagttagtgaatcgtttcccttcaaatggatcaacaagaaatggaaagaaggatttcatgttacatcaatgaccactgcaggaagccgctggggtgtagttatgtcaaggaattctggattttctgaacaggtatttgtggttattggtgtaatatttttttttcctggtgtgcaaatcagttgcaatctaagcgatggtatttcaattttttttttggcatgtgaaaaagggtacaaaactctttagttgtcagaaaataacttgttttcagatgaaatgagttgtcgtattgatggaaaccagtctttttgaacctgacagggattcttacatcatatatcaagttgattatacttcatctctctcatgtactgcaggtagtagaattggattttttatatcctagtgaaggtatccaccggcgttgggagaatggctatagaataacttctacagcagccactggtgaccaagctgcttttatattgagtatacccaagagaaaattgatggacgagacacaagaaactcttagaacatctgcttttccaagcaaccatgtgaaggtacgaatacatgactaattcctgtgtacattgtttttcttcacagttctctctaaccagaccattcaacttacatttcttgttcaagcgtcaactcgatcactactctaaccttgtcccatactgttgtctttttgtaggagaaatgggccaagaatctttacattgcttcgatatgctatggccggacagtatcttgaggcataccctgcacaccaactcgggcttagcatattcgcaactgagttgatgtcgggaaaaccagcaatctagttgctgctctctgttactctgtatgtgtaggtaacattggctaggtaaaccttacatcatggccagagttaggggcgcgagaggaagcagggaggaaggtggatggacagctaataagctgatgaggatgtcatccggctggtggtctggtggaggtggcagaagcggatgccgtcaacatattttgcatcaagatgtgctttgctgcagtccttgctgcggtgcacagcacggatgacccttatagcctctttggaggcctataatctgagagcccgttgtgtatagctcttatcgtgtcctgcgttttgtctggtggaagcgaaattaccatgtttccagaactccggaattgtctctaaattattgtgtgagaatgggtgtactgataaatcggtgtatcgattccattattcgatggtctcattgcattaatgcaataatgttgcattactgatcatctttttacatcttgtgcacagcgatattcatgaagtaccacttgagagagcggcatccatgaaaagtcactcccagagggtgattatcacgatactccctattgtcacgatgctcctcagagggccgttggtcctacaatttgatgtcaagtttgacattccttttgcacattcgagtttatcacctgccttgcctcgctcaatattcattatcgtctgctttgcgtcgctagcacttagaaattgaccaaaatgccctcgttgctttgtcccttttttctatttcttaggacggaggaaataggtgaataaatgaagggtatcatcttttcgcttatgcttatcagctagaatttgaattttcaattttaaatttggagttggttttgggttttttcattaaagtttatttttcagtctttacttttagatcgctaagaacacgtatataaaagttttattcacaaattatatcccgtgtgtaaatatgatgtttggcttattctacgaataagcgaagcaatgaagctggaactagactatattctgactatctaagcggttcaaaagctatctgagcggtccgaaagcaaaggttaaaagaaacataaagcaataaaaatacccctgaaattaacagaaagcaataaaaaatacctctgaaattaactacaaaattaagtaaatggtacgtagtcgaagcggtatattttgggatagaaaatggtgtttttttttaaaaaaaaacttattattactcccttgactattaaattgaaacatatgagatcacttgaaagctaatgagtcatggtgaatatacaactgcctcgatctacaagacacaatttataggacacacaaaaaaaactacaacatgctgacttagaagccttgggcctcatataaggtgcaaatccttcgcttggctagtacacaaaactcaacatgtaagcatataataataatttatttcattctaaaactaaacatataaatactaaattatcattcacaaatcattttcataatatttcaatccaaattattttatcatttctataatatttaacatatatcccgtaacaaagcgcatggcatcatctagtactttaggaaaaaaaaaaactcctttcatctggaattctttttgcagaaaaacgcgtgaacgtaggattaagatcggacggttccgcatctcgtcccggcagaacagaacacactaacgccggcggcaactaacatccccactgcgcgcatcggaggaactcgtcgtcgtcgtctccatctctccctcctcagatctcaccactccctaccgatcccctctcccccccggttctcctcccctccgcgatccccgcggtcgagataggcccaaaaccctaaccccccgccctcctgggtcggcgccccccgccgcgcctgaggagtgaggacgcggagatggccttcatggcggcgctggaggccgatctgcgcgcgctctccgccgaggctcgccgccgccacccctccgtcaaggacgccgccgagcacgccatactcaaggtattgctcccatcgcccgtgcctcgtgggtactggagatctcactgccgcctcccatttagttgtttttttgctcgctcgttcgtctcggatccaatttagccaggggagttctctccaatggtttccgaagtgtgggctccagctccagctccggtttggttattcagttcaaatacgcagtgaggtagtggcgtaggagtatgattcccacctgatatttttggtgatcgtaagcaggataactaagttttagccatttctaattgaactaattctaagaaatttcaactgtaactgtggtctgccaactaacttagcttaatcactagggttagtgaaaatgtagccaatggttcgagtgcaggatttccatatgctactagtagtggttaatgattatacagactaacctaaccggtctgaatgccaaccaatgcttatatggttgctggtagggactaggggaaacccattccttacctgtaaaacctagtaaatcctcttttataatgctaaatttagactgcagagaatgcttttaatggagtttaaggaattattgggttgccatgttgatttcaatcagagatttttcatttattttttttatttgttcgtttcttatttgaggaactcatgggctcatgctcgagccaggtgcaatgcacttgcttagaatgcttctgtaagaagcctaaggtatcaccagttgtagtatgaactttaaagagctggaggaacttaatgggttttgttcatccattataggagatctggagaaactttataactttttattctccatgtaagagtttgtacaaacttttgtttttttaattcaataagggctgggctttgaatacaacattgccattatagaactcttgacaggttctttcagtggagacctctcttgtattcaagtttcaacgcaagggacatactagaagtagcttatttgtgaaaggagccataaatccacagtagaccagaaccagaatctgagcaagagaatggggtctatcgaaattagtagtggaacacaaatatacgatgatacaatctaacctgattctgctcagaagataagctttgaagtttgaaataccaagttggaaaattgaaaacctattcttaatatttgatggaataacatctgataaaccaatcaaaatgacctttgacctaactacacaagcaagattgttttcatgtattttctagaaattgaggtgtgaacttgagtggtatgcgctgatgtgtttattgcctctcttccactttgtttttcttttctcaaacgtttgagatactttaaatgctaatatgattgacctgaccagatgactgattgtattctgagatcatttatcttctttaccaactgtatacctgttatttgcaagataatgattaagcatgtccttccgcctatctgaagctaatctgttgacgttcttaaatctttggtatcaacaaatctcctccataactcaagtgaagccaataattttgtgttgcaatttagatgatgcatagtgaacaaaagttctgtaatttcttatgttagaccacaaagtaccttttaacttgtttccttcttttaaccgtcatgctacttgtttcctaacttgtatttgaattctttttggcatgcagctccgttctctatctagtccgatggaaatagctcaaaatgaggatatattgcggatgtttctggtggcatgcagtgttaaatcagtgaagctgagtgtaataggactatcctgtttgcaaaagcttatatctcatgatgctgtagcttcttctgcattgaaggatatactgactactttgaaggatgtgagttttgatcgcttctgtatccatatacctctcactattttcatttgttctttatttggtcttaatagatgtataaactgaatcacatattttgtgtcatctagttatcctgatgacctgatgagtctgatagtgtttttctttttgaaaaaaaaaacaaacgtatgtttagaaaacatgattaattactaagtccttttgtttttgcattaggatattttgttgttttattcttgaaacaaattctgtacaatattagctgatgatttctcaatcctgttttttgtttcattttccttgcagcatgcagagatgacagatgagattgttcaacttaagactttgcaaacaattttgattatttttcagtcgcacctacaacctgaaagcgaggtagcaatgccaatggttgccatcagtttaattggttgatttgtataatagatgcaaatgttttgttattttctggtgtagttgcctttagatcagtctgaagcttcccctgttataaagaaagcaccaagattactggccattatcaaacaacttgttaccgctgttagcattttcaaaaatcattttcatgtctttctaatttggcttatgtgtatgaatatcttctttccacgcaataaggaaatcacttcccttattttattttggagcagtctgtttggatttgggggttatgacatgttaatgtgtgaaacataatgcattcttgttcaacatattctggttgactctagaatgtgtttctataatgataaaaagagtaactcaagttgcagtattaatttttgaagtcttctgaggaagttaacatgactaaaattttctattccttgggactgtttagaaccttccctcttgttttgcatagttcatgcaaaacctaaataatatgtgcagtatcattttatctctaatgcctttccaggatcataggaatgtaaccatgaataggtaggcctatttatcaatatattgtttatatctcttcaggtgaacatgtctcaagcatttgacatatgccttcacctacttgaaagcaaccgttcttctgacagtgtccgcaagtaagttccttcgcttaccattaactcagctattctgacttcttttattgtgctctcctaacacacatattgtccttagcacggcagcagctacatttagacaagcagtggcattagtctttgataatgttgttcatgccgaatcacttccctccagtaaagcttcttcagcaagactcagttcacgcgctagctctgttgctgataatgtcactcgtagcttcagccacacactgtaagactgtctattttatcttacattatacttaacgccatgcaggaatgctatttggacatttgaaatctgttgttcatgatatgcccttttttccttgggaggctttgacaacaatggcaccgtatgtattatagtataatataatcagcttcacaataaagctcgattctttttttgccatcgtgcctattaatgagcacacacttgcattgctgaatcaacagttctcttatttgtactgtgtttagtatatcactcatgttcatgtgctttatttggatgatatggcaaccacacaatgcttgtatttccattccacaagcatagacacatgacaactaaatgtatcactgatgcaacacatatatgccatttttcactctgtggattttttcatttcttttgcttgttaaatttgtattttagcttacactagcactgcatgacaggtatagggaggaactctgtggagcctaccgtgagggaaaaactgagcaagttggcaagcttggtctccgtttacttgaagacctgacagctcttgctgcaggtggatctgtatgtgcgaacaattcctgattgcacttatttattcttgccacatgattttttgagacttgccgcataattttttggagtatctgccaatttttattacggaatttctacaccttattttctgattaagctattgttgttattttctgtaggctacgtggcttcgtgtttattcattgcataggacatttgcccttgacattcttgagtaagttttctccacagttaaatgtctgaatgtttttttgtattttttcaaggcaattataattttgtagttatcttgacccaatcttaccttttttatttcaaattaagttctatgttaacaagatgtttcaattgaaccattgttatcggatgttagtgaagctcatgatctgataacactgatttggagtgttgggttctgtcaggagttttagaaaataatgtgaaggacattatacaactgaaattgaaaaaaactaatttcaacatttgtgtattcacctagaaactaaactttatagtgcaacttgtatatagagcaagctagaactcatctagacatattttgtgccaggtttgtgctatcaacatatgtttctgtattccgggcattgttaccttaccagcaggttagttcctatgtttcttttattatgtctaatatttgtgcaaatgttgatttgtaacttacgatgccattaaaaacctgccaggtcttgcggcatcagatatgctcgcttcttatgacttcactccgtacaaatgtggaagtaagtacatcaaaatcaggagttagtttttaaaattgtgtaacgtgctcaagtacatttgcaaaattgttgcgttaccacagtggcaaacgtcattggcagcagaacaaacttctgacttacaacattactagtatagaagtttaacaccagttcagatgccacaccacttatatgagggaggcaaattggattccatctaaaggaacaagtcagtcaacatttccctggcctattgaagtgtttgcactttgcacagcctatatagttgtactttcctgaacaagcaaccctctttgccagcttggatttttgaaattccttcctaattgggtaaaggcctaagagatgcaaaatgtgcctacccttccatttctgttgaatttctcagcatgaatgcgaggat

SEQ ID NO: 67596 - DNA, 1752 bp, Oryza sativa
aatgtccacatcagatcagaatgctgtttggaaggcattctgtcctagcacggccctgccgccgcacgtcaccactctgagaacactgcttgcatgacttcatacttttaaaatatatttggttaaaggacttcataggggctgggtcaaaaagaatattatgtatatatccgggttggctttgtccagtgaacaagtggcggactgatccatcccatctcatctctcgcgtatcgcgtgtgctgtacacgcgtggagtagggtaaccctatcgcgttttctcaccgtatcgtgtttttccaattcacatcgagagaaaagagggcggtggcggcgccatcatgcgcaggagctagtgacaccggtgtcgtgcggcagggcccgtggcgcctgtgccatcctcccttctctctcctcctttctcgcatccttccttttgctgccccctcgtcttcaaagccaccgccggcggcaggaaggaaaggcggcgtcagtggcggcaagaggcgaaaatcggctgtaggaacctattacagtgccctcctctctcttgtctgctactgctcctcgcatcctcttgtcatcctccatagctaaggtaaggaaactctagcactgtgcagaatctctgttattttattttcagtgccaaatatgtgcgattccgtttgcatgagatgaatatcccttactgtaaatagcatctgttcaagcacattgcatttttttccatcaattttttcatagtagacaatttactaatctgaacaagtattactatgtgatgtgggcaagtatatttgttgatgagatgatttacaataattaatgtatgctaattatcattattatatgtggcctcatcacttcctagttcctacgtatgaattgatataaggattaatgtatgctaattatcggtattttgctttggtttttgggatggctatgtgatatgaattgcattttatttccaaatatagtcatatgaatgtaatttatttttaaatagtgtggtctttatatccaaatactttttttgcaatgtgtatgttatatgaaaggtagcctcgccaactaatgtaagaaggttactctatctaggcaactcacctacatccctccaaccaaacaagggacagatccctcaaaccaaagaaaaaaaaattaggtcagttccactcatagaatcaaacataacctaggtccatcccataaaaaaacatgaatgaacgtgacacatcccaccttatacccgaaccaaacacaactaccaccttaccaacatcatgctggggaggctcgtcagggtcggaaacgctcagtaataagtgtcgggagctacaccatgatcaggatcaggtaacctagtcatggaaatatttctttctgatggagtcagacatcaaatgctcattgctaagagcatcccagcagttcatctaaatttcatcctccatactcctatttagatagtcatccaaaaagattcctactccattttacttttcactccaatagatcatccatattgcatcctccatataccaacatcctatattttactaatattttacaactaccacatatttatactcacctttcaccactctaaaaaaaaatccccccacctttatctcttctctaccgccgagacgacggggaggacgagggccgatcagagggacggcgcagtcggaggagtagctaggtggaggggtggcgtggtcggaagaacggcacgggtggcgg

SEQ ID NO: 67597 - DNA, 680 bp, Oryza sativa
gtcaaaatttgttcaaattcagtcagaatatgttaaaaattaaaataatttcagacaacggacccagaaatcataaattttttaaattttcggtaaccaccgaaattttggtggcaaccaaaattgcaaaccttggaaagtagtagtagttgggacagttgaaaattgggtggaacattccatctcttagctgaaactgagtactcactctgtaatctactctataattcaccaactcattttactcatctctcaaccttacactcttacaccttaacggctcatattcatatcaaacggtcccgatcttctctgtgcaatcccaccccatcgcggtcccgcacccacgccccagcggagagccgcgccccctccatctcctcgctccctgcctccccactcctgcgacgcgccaacgcctcctctcccacgcccttctgcccaaaccctaatcttcctgccgcacgggagcaggttccctctgctgccaccagctggtgcctccctccaccacagccgcatcggcgccatgcctggacgccaccgtcctaccgcccggaagcaggttgagcgccggggtcggggtcaactactccgtcaactgctgctcacacctccactgacgacaatctcatatccaaggtacactggggaattagggttcttggcttcgctatgac

SEQ ID NO: 67598 - DNA, 1425 bp, Oryza sativa
agaagatcactaacatgattagtagtttcagtttgccagtacattgaaagttctaaaaactagcatatattaccaagaccgcgaagaacctcttgcttcactttatcagcagagtcattcttataatttggcgaagtttgaagaacaagttcataaatatcaagaacagatttgacataggaggattatagattgccctgaaaaagtatacatggaacatatattcatggccagttctgtgaaaataataactgaaataagaactcacggttcttttctctaatttgtgaaaataatgccaggaataagtgacaggtccaacacatgctatttcagccagtggcactaatgaagtttttagttttgacaggaaggaggtttttcaaagataaagtatactcttcagtcccccacccccactctctcagggttatagcagaaagcacaaaaatgccatcattagtccaaacagtcaacagatgaatttttttttctcgaaaacgcaggagagctgcatttcatttcattaaggaagaaaaaaatatttataaaggagaaaggcaaaaacagcaaaacaaaagaaccccacacaaccaacagccaagtgagaactcgacaaaaacattgtgagtgcatggcgttggcctacttgggccttagagtgtgcacatgggcttgggctatttggttttcaagggaagttcaagctcatccattaaactaccaaagacacactcaatatttcaccgaaatagcttgcccttggttcgttaaaaagctagacgttcacacgggctcaagttcgggtagttttgagttccagataacctaaagcgagccaagcttgagtggcttttcaaattttttttgacagtttcacttaaaattaactataacagtcagtaacattcttagcttgtgaaaccggtaattattcataatatactgtggctgtgtgtgcattggggggtggggtgagagagagagaacctttgaacagtttgagccaacaaacgtctgcaaacaatttatagctgcaagagcgacctccttgctaccatttaggataccatttttgacaaaatcaagcaaaagcacccaacctgaaaattttaagatacaatccaactggtaatttatataatttatatccaatccgagaaaaatggataatggacagtacaatgaacacttaccagaagaaaatttgctcaattgctggaggaaagggaaaaaggaacgcaaaagtcgtgctatgccacctagtacaagaacgatagtttcatcccattgttttgtgctgtatttcgactggaaataagaaaggggggggtccatcagaacaaagtgtattccgacatgaagtaatatagtgtaatcaaaagctctactatctagtgagagtagtgtgagacccagaaataa

SEQ ID NO: 67599 - DNA, 670 bp, Oryza sativa
tgcgaaataactgctggagccggttaggtcagcgcggacaagtgtctggccagctgcctgcctgccacagcacacatgatagacagtggacatggtggctccccatctggggcgatggtggcactcgccccccctgcatgaatgatccaaatatataaatatgtcttagctaaagggtagtggcggccaccacattatgtaatggtatcatgtttacatgtaacacacaaaaattgattctacaatacaaatatttaatgaacaaggccatgatacactatcaaagtttcatttaatgcaaatatcttattccaaaaccaacaacatgacatctaatcaggagaaaaggaacactggaataggcatttcctgtccctaaaatccagcttcacaagtagtatcacataccaaacagcagttccaggtgagaacggagagggaaaaatatttaggatttataggcgaccaagcgagaaggtactggcaccccacctaagaggagaggttggcgacggtgaagatggtggcggcggttacattgttgatcagcacgggctgcgcctcagtcgagccgaggtaccacgtgaccacctcggcattgacccgagccgaggtaccacgcgaccacctccgcatcaaccccaaccccggcgctcctactgctcccgat

SEQ ID NO: 67600 - DNA, 1518 bp, Oryza sativa
gcgccactcatacgtgcaaaactactttaaattaatttttctcttaaattatttatccaaatcataattcgattgcaccattaaattcgttgcaattaaatctttaaaacaagaccacacatggatatattccgacgaaatttttttagcttattattgatttttttttaaaatgttgcacaatgttccaccaagtatatcggaattgtttcactaagtagattgaaaatgtttcaatcgtttaaatcgggtattgtttcatcttatataaaaacaatgtttcagcaaaaagcgaaagaatgtttcagttcactgcaacattagatctatacatagtgaaacactgtgagtacattaggtgtaacaaaaaatgaaacgaattcccttaatacagggtttccaaaatatgtgggtgatttattgcaaaagaatgtttcgttcactacaacattagatctatacatagtgaaacattgtgagtacactaggtgaaatatttttggtggataaaaaatgaaacgacccttaatagagggtttctaaaatatgtgggtgatttgttgcaatggagtatatggtgcggaccaaggtaataaatagcatatagtgtgtttatagcggattagtgtctggcagcagattgcggatagcgggcgctattgcggacgctaagttccaatagcgaaattaagaaaaataaccataaatttagattgtatatcaatattaacataaagtttcacttaaaatttaaaattagactgtttaattactgctacatttcataacataaaatttatgaaataacatatagatatattagataaagaagacaaacaatgctaaattattctatccatgcgtgaaacgctccgtttgagcattatagcgatctaacaaagtcaatagcgggttgttatagcggtcgcgaagcgctatagcaagctgctatagcggtcgtggagcgctatagcggccgctaagttccaatacgctctatgcagtccgctaccttgtagcggtagcggtagagctccgctactgctatagcgggcgctacgaacgctatttattaccttggtggagacacatggtatggggggcagagaatgtggtggggccaggtgcctgcatcacgcgcgtggggggcggggcgcgcaggggagtgcccgatctgctccacccccgccggtcgcccggtagccagcatttccgaaaggaaaaagtacgaattacctccccccgaactatcgcggtcgtccgaattaccccctgaaccacaaaaccagacattcttcacccccaactatgcaaaccggacaaattacccccctcgacccaatccacggtggttttagactatgtggcgtacacatggcagtccggtcagcattttatttataaaaaaaagtgggacccacatgtcacacacactctctctcctatctctctctctcactctctctcctctcagcaatggcggaggaagcgagcgcgggaaggcgaggcgagcgcgac

SEQ ID NO: 67601 - DNA, 5683 bp, Oryza sativa
  unsure (1)..(5683): unsure at all n locations
agaaagtgtgtgagagagatagaagagagagagtatgacatgtgggtcccacattttttaaaataaatagaatgatgactggactgccacgtgtacgccacgttatccaaaaccaccgcggattgggtcgaggggggtaattcgtccggtttgcatagttgggggtgaagaatgtccgattttgtggttcaggggggtaattcggacggccgcgatagttcgggtgtaattcgtactgacggagcgtggggctcctcaccgggagaccgcgcgggcccccctttgccggttcggccgggggcgctgggtgaggttctaagcccttgatctgtggaatggttcgcgaaagagcaaatgcgcaagacacgagcgatgtagacaggttcgggccgctgagaagcgtaataccctactcctgtgttctggtggatctgtgtatgaaggagttacaaagagctggagagcaagagagttcaaactctagagcccctctccctcctcttttctccagtctaccagctccggtcctctctcctttttttctccttccgtccgtcccctcttttggtaggcatggtcctccttgtatatctcaaggggataccacatacaccatttctacctacccttcttttgggtggggacccatcctactttgaccaaaacttggcttgtaccttcgtctgacaccgggataaccctgtcctccctcattaatgggcggagatttacaatggctgctgtccgaatgaccctccgatgggatgggtcataccaacctccactccgccggaagcaggtgcaacgtggaagcacggttgtttgctgatgacgcgaccggcgtcagaccagtcacagaccggtcattcttgtccaccacgcgtcagtttagcatgctacacgtatgcccttcttcatacaatgacctccttgcaatggttgcgatgaagcctggaatgtatctggccggggctgacgtgccaactccaggagttcccacgccggctccggctagggacgagtgtctggaggctctcatcattccgacgggacggggcgaggcgtgtgtcaggccgcctgttgccacctaacccgcgatctgaccggtctgtgaccggtcacacactgcgaccgatcacggaccggataagcatgcgctatgctgcattaaatgcggcgtgaggcgctcgtccaacccacaataaacgcggttaggtgagcgccgctgtgctcacctaacccacacacgtggcgccaaaccctcagggggtcggggcgccccagccctcggggggtcgaaacgggagcggcccgacccctcggggagatagagggtggggcggcctcatcaccctcgggcccgacccccccgagggggtcaggccacgtgggtgaccgcggctgccccaaacctctagtcaagatatccccggtcccatgtcaccggcacgtaccttttcctttccgaaataatagaggaggagttttgggtccggtaccgcggtggtgccaacatgttcgaagagaccagcccacatattagttacggcctacaatagactttcggttaaccgacatatcgcggcccaagcagatgcttgcgcttgcgctaccgtctccgtctcaatccccaattccccatcacccttattaatgatccaggatccaggttttagccgatcaatttgctccaatctcacaatttctccgccttctcgtcctcctcgccgaaccacccccatcgacccacacaaccagcgaaccggaaggatttcactcagctgagtttcctgcctccatccccacggcgatggcggaggaggcgaagaatctggagacggcccgggccgaccgctccgtgtggctcatgaagtgcccgaccgtcgtctcccgcgcctggcaggaggccgccaccgccgccgcctcctcctcctcctcctcggacgccgccgctggcgccaactccaactccaacgcgaaccctaaccccgtcgtcgccaaggtcatcgtctccctcgacccgctccgctccgaagatcagcagctccaggcaagccgttgatccgtctctcctcccggcccacgctgttcgctcctgttccgtgcgctcggtcgatttattcgtgcacgtggagggtggtttcgtttcccccttctattatgctgcttcaatttttagggtagttcaatggttggggcgagatgtagcggtttgatttggattgggggacctgtttgatgtggaaggttaagttgattggttgctttatcatagattgccacattctgaaatccaaaacaagaccaatggatcattgctattgattttgtgcttttaaatgctaacactagacagtttgcttcaatttccatctcatcattggttaactctgtattgtgtatttcactggccatggtggctaagcaatcttgttgcaacttaaacatttttgaattcaagcaattagtacatgtgttgttgcagaatatatttctttgataaatgattatactacaattcttcttatagtttttgggagaaaagcccaaagcaatttggaggcataaaccaactactgtttgagcgtttgaaaccaaaatgaatcttaaaaggttttaacagaatgtaactttgtaattaacttcaaatgatttgttatgttgcagcatagttaggattacatccttgtttccttgacgtttagatatgttcatgccttaaaagcagaagctactgtcatggatttgcattttctgtattcttgtataatagtagaaattgacttacggcttctatacttgtacacacacccagtgcctgtttcttatatgttgttagtgaaataacagttcaagatggagatggctcaaacaggcaatggcaatacaccaaagagttactccttgaacatgttcaaggattttgtgccaatgtgtgtcttttctgaatccaaccaaggtaagaataccaggctttctctttatttacgatgcttgcatgtatttctcctttgatatgtgagactttatcactagcaatttctcatggttgatgtgcagttcatttttattccaaatacagtctaggaatagcgttgttcaaatggtctactaagccgtattactaagctatatcgaaggaattggtgcactacctgtaactgtatacttgctggttaggctgcttaattggattgtttaggtcatgcgaccactactaggtgggtgagcaacaaaaaaatacatattgcccatttttggaatatcatctgggaatatgtaaaatataatctgcattcgtactttcctagactttaatgcactgagccagatgggagaggtcatttagttatagagttctgggttatgatctcactatttgtatgggggtgtctgtgggtaattgccttggatcaggttctgattactatctacatattggcttttcatcaaacgttgatgttgttactatcaatatttttttttgttctaatacactattgaaactgtgttctcaacgtatgaaactatcttctttttctataagtttgtatatgatctggaatttttatcggaacacattattgatgtttcaattcttaatttactcaatttctgcattactgaggacctccttgaagttctgctgtctgctggaaacttcatatggcttgcgtctaccgacatatcttacgtgcattcatcacataggtgtttgcataaagatttggttggcacaggatcatgctacattgaatatcccatatgtggttgatgaattctttggttttagctttgctaattctgttacgtggaagaagttcaagggcaacaaacattttcttttgtcatgttcttgccatttcaacaattttttcattcagttctttttggtgttataccttgtaaagtcttattggcattttatttgctgtattttgaagtcattgtggtataatctcctctactacatatgctatagcgaccttatgggaaggactatgcttcttcatttcatatttgggttaggaaggctttgtgttgatagtatttttcacggcttgaagataacatggattgcaatctgtttgctctgtaaacatagtattaacttatttgatacactaaatcatcaactccttgttacagggaagctttcatgcgaagggaaagtcgggcacaaatttgacatggaaccgcacagcgataatcttgtgaactatgggaagttatgtcgtgagaggactcaaaaatctatgattaaaaatagaaaattgatggtaggagtttttatgatattatatatgccatattgatctgcttcatatggtagaagtatttattgtacagattcaccttttgcccttgtctgtttttaggtacttgcgaatgacaatggaatgagcatgaggccgttgcctggcttggtgggtctgatgtcttctggtccaaaagtaatctttcttcagataacaatgccatgtttcatgtattttttttcctatgttgatagtttatcggatcctgttaactagcacagttccttttcccctcaactatcaactgctccgcagaaacattttaacttactttttttaaaccaatctttctattggcaatgtagatctataatgaagggtctataatctattgtaagtttttttttcccagcagaaggagaagaagccactaccagtaaaaccatcagacatgaaaagaacgagaagggatcgcagggaactggaaaatatcttattcaagctttttgagaggcagccgaattggtctcttaagaatctcatgcaagaaactgatcaaccagaggtattttttctcaagttatcctaattatgccgagggtggagcatttgttaagaaattgctagcaccaactctagttattgcatgttctgatatcaaagcctcaactctcccggcttgtttctgtgcagcaattcttgaaggagatattgaatgatctgtgtttctacaacaaaaggggtccaaatcaagggacgcatgaacttaagcctgaatacaagaaatctacagaggacgctgatgctactgctacttagaagtcttatgcttcggtctactagataggagtcctcgtccagtgtggactccaatccgttacttgctgcgttcaaggaaatcttggatacttcgtttatagtttgtttcttgagaaacatattttgtacgcatcaagcgatacatcttttggtgttactggcggccatatcttagacccagatttcggggactcgatatattcgtgtccatcagagtttagaaacaaggatgttgaaatttgtgtgtataatgtattttagctcttctaggcaaactaacatgatgattttcatgatcattaaacaccttgacctactcttccctgcatatccctcttttccatggatgtcaggctgggacgaaaccaactgagatcccttgcagtactgcaatagtaccacacaaatttttgacccttttaaaaaactaattttaattttacaaataaaccgttgccaaaacttatttcaaaaatgatactttttttcagcgtcaaatcacccggcgctgaatttagacaccttancgccacgtcaactggcgctgaatgccgtactatcgcggatgggaggctaaggcagcgtgctaacgcacattgagcgcc

SEQ ID NO: 67602 - DNA, 592 bp, Oryza sativa
tgatttgtgaatgaatcggataattcactcgttccgtttttctccgattgatgtttgcatatggagacggtgcaaactgagccgccgtacgtcgtctccctgcccctccggcgacacctccaccagttcggcttaggcttcgagaaatctgcgatttcaacaatgccgcgtgtatatatagagcagaattcacaaggattagccattaatcacagcaagctaatcaccgagttcaactccaactccgtctccgacgtgctacgtagctagcttcattggtttcgactcggagtcggactcggctgccgataaatcctagcgctgcatccaccacaattccttccaccccatcctcgcagagtcgcagtcgcagctagcagcgctcgtagccgtcgtccatggcgcttccccgccgctcgagtccccgctcctcgcgcccgatcatccaccgcgccgtcgacgccaaggggaagaagccgtcaggacgatcgccggtcaacgagatgtccttcaagaagggcgacgaggtgcgcgtccgcacgccgttggggaggctaggcacaacgacgctgcgcctcgtcatgtggctcgg

SEQ ID NO: 67603 - DNA, 7222 bp, Oryza sativa
gtgtaaaatttatcacaccataaatgctccatgccaaatttgccttgttattgcaccagtgaatcgtaatgaggaaagcgatgtcatatgttaattcttttaccgaaagttgttgatttcgtttcatccttctatatccattagaaatggcggtgtagaaagatattacagaaaatgaatggtttgggagatgcctctgcgttcctatgcagctgggctctggttgcatctcaacatggcatagtagtgctatatatctctctccttgtattttaggtggttgtgttgttgtgttgttgctattcgatcatttcaacgcatcaaggaaatgagacaactcaataattagttgctcagagtgcagctcttttcttctcatatggatagcccatgttccattattttctacaacaaagataggttttaacattccttttatacatataatcctagttcttagagggcaagctcttactaatgtacccaggaattcatgtcaagagcatttgcagtcaggcatcataggagattaaagaatcatgcattttgggtgtaaatgtggttggaaataggtatcagtatacataattaaggttatagatttagactaagaaatatcaagtttccggcttatcggaacacaatagttcagacatgcaccggcaatacagctttgcaagaggtcacatggggatttacaattgccttgtcattatttgtgtactttgttgttaagaaaactgtagtttggaaatgaacaccctgggtcattgaagattgttgtgactgctcatcatctttatcaccttgccaaattcttatgcggttgccataggcttactcatgctttccatcagtattcattaggattaaagtgtcattcttttactaaaactgtaatatgctcattatttgtgctttactagcatttgaattcttttctgggtagggaagatttgcactgcaaattgtttacactgtttcagttgttcttaggtttggttgttgtaggcttgtagcaggaggattgactatatctggccatcatttcatagttattaacaggaaagatgatgcaatggttttatgatttgtaataattggatggggctgattggacattatccttatgccatctccgtttaaactcatttttttttgtgatttccattttgctctgctctataatttgagtatttgactattggaattgatatctaagctattgtaacttactttgactatcatgtctattttttattataggtgagcttttgacaactgaagaagcaaggaggcggcaggggctatatgatgagcttgcctctgtcggtaagctctctcctgcactcattgtcatacgggagcatctaccttctggaaaagcatgcctaagagttaacattgatgcaacgaaagtggggaatgtggctcgttttatcaatcattcgtgtgatggaggcaacctgcatcctgtcttagttaggagctcaggctcattgctcccaagactctgcttttttgctgctagagatatcatcgaaggagaagagctcaccttcagttatggtgatgctagacttaggccgaatggcttgccgtgcttttgcggtagcttgtgctgttccggcctacttccttcggaagagacataatgccatcatttgtaattgagaatttcctgatgtggtgctgccagaataatattggcatggcatcaggacgagtagacggtacctcagtacctgatgagtgatgactagtgctttcacaaattcagtgtacactatgcatgctgccttggccgttttcatgacccattctgtaacttttatctgacactctgagaaaacgacttgcaagctatgcattctttgctcatagcatagtgtaccgcaagttaccggagggtagagagtcttttggtagggatgttcttaaatcctactagtaaaatgcaattcatgctggcagttgggcatgcatttcccgcttcaggagtcaggaggtgatgaagatgaatcctttgacaaagaagactcctggagagagtggaggactcaacagaaaaacaaccttgtgccgttgcaatcctttatccaaagcacacttccgtttccgctttccctagcgtttgtttcctctgtgcagcaaccgcagcttatgccaatgccaccattgcccatgccccatgttccatttgcactagctttgcaagtgttgtcagagtaacacgatcgggcttcgcatatgtgctgtcctatgatcccgtattcctgatccatatgtcaattgagtcttttactgaagaatcctaggattttgctgtctgagctgtgtgcctgtgagcttgaagcatcccggtacatggcagcatcacttggggtcttgggctatatggcataaacgactcccgagctaacaccctcctcttccctctccccgtgagatccgcacgcgcagcacccgcatgaggagcgcctccgcgcgacatggccctcataaatcttgcgtgcctcggtaacaagacgattggccacgccgcgccgcgcgcgcccacgcgccgggccgccacggctcagtggcgcgccacgcgcgcgcccattttaaaaacccctcacttccgccttggtacccccgcgcgcgggcgctggcgctggcgcacacgcacgcacacatgcatgcagcgcagccacccggcagcagcaagcgccggggcgccgtggagcggccagctagcggcgcgggcctgcaggcggaggaggcgtcgtcggcggggcccggggcgccgtgcggggcgtgcaagttcctgcggcgccggtgcgtcccggggtgcgtgttcgcgccgcacttcagcggatgcggcggcagcggggtgggggcgggcgtaggagggagagggagggagcgcggcgcggcggagttcgccgccgtgcacagggtgttcggcgccagcaacgtggggaagctgctgtcccgggtgcccgccgcgctgcgcgggaagcggcgcgcacggtctgtacgaggcccaggcccggcatggcgaacccggtttaggcaagggtgggcacaatcttggggttcaagcacaggtggggcacacgatctgtttgaaaattggaacagcaacgaacacacacaattcacagcctcctctaccagtcataaatcaagaacaaattcatgtcacaaacacaaactgacacaaataatattgacccctatgaaaaattccgttcttctgattcgaaactccattacgcgagacgacaggtatctctcctgcaagggcagctctccgtcctggagtctcagctcttcaacctgcgggtggccttggcgagcgcgcaccccgacacgccgccgcagcacttcgtcgtgctgcagccggcgcactccgcggcgtccacgctgaaccaggtggtggtgaactacgacgacctcccgcacgccgtggatttcatggacgcggagcccgccgcgctgaggggactagagtctctccagctctcgcagccactgcagcgggaggaagacgagggccaccgagacatgaacctcttctcggacagtgtaggacaacggcagctgtaaaattacctgtgcaattgcatgattaggtgtctctgtggctagtacattcactcttgagttggaccacattgtgtgatttgagaattgcgtgggatcatcaatcatgaatatccgtattctaatttgatcaattccttcacgcgaatttcatgttcgtgaaaattatacattttatatgcgcctttttaccctgtgaattatgaaaaaactatgaatggtagcgatccaaactaggagccaaaaatgaaataatccagtgttcacaaaaaccgatccgttctcatcaaaaccgcactgtgttttgtgaaagtgaaactattggttgttgatttctaaaaaccaatcaatttttgctggttttcgcacgatgttgacttaaagtcagtccttttaactgattttcggtatgtttagcataaactcgtgggaaatatcagaagatgaagatagagaggatgactttcatggagagaagcatcaaatgtctatcctatgatcctatcctatcctatctacacaaatcttctcatttacacaccaattaacaaattttattaaaaaaatatagaaaaaaattgtacaaacacttctaatagtattatacttatgtgtaaagtcataatctcaaattcattatattttagccaaaaaaggataaaaaaattataacagttttgagagtataaatatgtgagattctgtcttttttgttgctccctgtatataatggatttcaagatgagacttcacacataaatacaatactactaaaagtatatatataattttttttctagattttctagtgaaatttagtagttgatgtgcataatatgggggtgtttgggagagacacacaaaaccataaatccctagaagagggacttatatttttatatttttgagagaacacctcctatgtatacgagaaaacttatgtgcataatataggttcctctgcagaagctacaactaaatgcagaggattcggctcccacactatcaaagtactggaagttttaatagatgagatctcgtgggctcagtccaagtccagtgcaggggaccaaagaaaggcactactccgtcgtgaaggctaaaaagggagggggatcgaggcgagaggaacgccaccgaacccaaaccccatccaatcaaaaattcgtacgggagagctctcgatttgatcgccgcgaccgcgaggatgtacaagtcgcggctgcaggagctgtgccagcagcggcggtgggcgccgccggagtacacccaccggtgcgcgggccccgcccacgccccgctcttcggcgccaccgtctccgtcaacggcgtggagttccgcacgccggaagacgccgcgcggtcggccaaggaggcgcacaacatcgccgccaaggccgccttcgaccacctctcctccctcccgctgccgccgcctccccctccctccggtgagtgccatcttccgtgcggaaaaaaataaaaaaaaaatcccccgcatttctttgttcctggatttttcggtggaaccttccttcatataggaatcgaacctcggggagcggtaggaggactagatttgggtaatttggttgcttgtagtttgagttaactgcgaattctttacctttgatgggaggcctgaagaaagaggcacgaaccatttggttatttactgggattttttttgtgtgaaatggcaaaccgagagttagtttcttggcgactgcaaagtttacaggtgaacagtgaactgattacagattaatggtaaattgcagcgaagggaaatgctcaattgctcatcaacttcccacttgaaaaagtaggagtagtacaaagcgttcatgtaggtagatgtactcaccggtacacatcagtctttgatttggcattgaagaagagttactgcactccactcaatgccccaatgaaatcttgcaccataatagctagtcgattcctgaaggtagcaaaagtttggtgagagcataaagaacggattgtcttttctttgtggatcagtttttttcataagttcatgtgcatctttgttgattattattactaaactataggaaggaaggtcgagcacatgcatgggaaccttatttaatgtttcatgaaactcctttattttaaagaagtaaaaaaaaccccgctaatgcttatatatgcataatatgtgtgagcttctttttgtgtctgttactcttgttttgaacttgtgacatagattttttttccgactagtcattgtatatttgaatattatcattggaacttctaaaagatgccttcgaacaaatatatatttgaaacaacttattttggcttgcgtaattagctgcattgtctagcttatttgttcagcgcctgtgatctgcgaaaaggatcacatgtgtttgtttgtggaacaatttagatgttggggatatgtacattatctttttttttctaactggtgtacaagcactgacatggaaaggttggatttaattgagttcgtgaatgttggaaatggagatctcggcttactttgtcctaattgtcctgatccttataacataatgttagaaaacacttagatcagatgggaaaatgataaaactatagagattaaatagatccattattaaataacacttcaatgttgctactgtaatgtgcccgtgaggactgtcgaaattaattagctcatatttctcatccttcttgtgcatccatgttagattgcaatgaaatacaaagaacacaattttatgttcagtaaaaacgatctatacattgcaatattcttgatcaatactagtacattacgctaagttctttcttgtgtcttgtcgcatgctactgaatgtttacagtattgcaaatgtattgcagcgaatgtcgcacaggcatgcacatcaatatattgcagtatgaatcatcatttctaaaagacatggatgtgtgcctgtaactcaaagtctaaactattatagtagcattccatgctgagatgtccatgcagtaatctttagtttgttgtcttctggtgaaaccattttccatgcactatggtccatgtggcttgaattagtatccaatacctgttataatctgaactatggtccacaaaatcaacggttggatgttgttctttctctgggattttctatcgtacttatctatttttttcttagggattccaatcgatgtttgatggacttttagtatataataggtaacatttgtagttgcggggtctaagagcaccgtgtactggcatggtgtaagaaaattgttgtttttcacttttatattctctatatttctcatattgaatgatttttcctattgcagaaaaccaatcttcttacaaaagtcagttgcaaatttatgctcagaagaagggcaaactgttgccttcgtaccaaacaattcgggaaggtccaggtcatgcatctcggttcaagtcagtagtgactgtagatggcaaagcatttgaaagtccggaatactttcacacagttaaggaggctgaatccggtgcagcaaaacttgctcttatgtccttacctcaagaagcaagctcatcggagcaagtgccggttagtcaagcttattacaattcactatttactaa

SEQ ID NO: 67604 - DNA, 5514 bp, Oryza sativa
caaccgggactaaagatcaatctttagtctcggttatttcacccgggactaaagatagcgatatttaatcccggttgaataaccgggactacagggaggttgcgaaccgggaggaaagatggtttttccaccagtgatacgaaagaggtataaactacttataggccatgtaatagacagagcagtatatgaactacaaacacaatcaaataaagaagataattttattattgagctcatagtcttacaacaaaagtaaagtactaaaagcatgcatgctcgaatctatgagaaaactaggaaaccgaacaactattctaagcctaaactctactaaactagagagtatacaaatatagaatagagaaattgcttcttgagtgtgtgttatgaagtgagaaggatttctccttctatagtggcaccgcggcccgaggtcgctgagcttcccgccacccaccgccgcctgctccctgctgcctccttgttggcgccactgcccgctgcccaccggctctcgctcggagaggagaggaagagataggggagaggagaggaaaatatcaggagagagagagacagagagagaggagaggaggtgaaaaaaaattgaagttgtgagaagacaaagagaaaggataggagaaaaaactgtggagaagagaaaatattttcgcaccccacatacgaaaataggcttatttttttatgcagctgcgaaaatatatatagttttgtatgtgagcctcttaaggagccgtatgcgaaaatagagatcgatttttgcatacacgactagttacggtccgcccgcaatttataggggttctcatatagaaaaattatttttatagtaatgtatgttaaactatctataatgataattattttgggacggaggaagtaatatacaactggttgtatacaagcacgccatcagtacccagtatcacttagctactatatattaattccagatgaccgtacgattatctattatatactatattatatactaaaagttcattaaacttcctagaaacgctcttaagtcgtcatgtggcgctctataaacactcctaaatcgccatgtggcgctctgataaattagaaaaaatcctagaaatttttttaaaaaaagcatctcaccattgattttcacttaaatcagtggacccattagttttaaccattagatcaattttaaagcaatatatactcaatccaacatatgggcctactagatcgatctcacagaatatgtacccttcccttcccctgccgtacatgccaacgtacgtatgtacgtaaatatgtgatacgtattccatatgccctccccttttctcctattttctaacaactcattacaaaatagtttaaattttaaatagctaaataaccatgattctcaatttatatacaacatttgattcatttgtactattttcatttgtaattaaataaatacatcaagatcggtattgcatatattttgcgaaggtaaagaaaaaactgaaatacgtttggacatagaccctagcatgtcagtcattaaacaatataaaaaaaattgacaacaactatatcatcttaaatcattctatatatacatatgcacattaaattaaatatcatgtaggacacaaaccatcacccttcacatcttaaaaattaagaaatatcgttgaaattctatgagaaataaaaagcaaaacatcctactatcattttacacttaaatcggcagacgtattaatttcagccattagatatatcattctactctcataagccgctacgtatcacatcttaaaaattaataaaaatcacataaattctaaaagaatgaagcatccgacctcaataaaatcattatttcagtcattagatctatatttaaagaaaaactataaaaaaacaaagtaccatcccattccccctccccctcacctggattaacaaagctccatctttatattctgaaattataaatatatagtaaatgaataaaaatatcgtgggagtatataagcatactaacaaaatcatggagtagggaaatcgtcaataattaactcaagttgcacgcattagatttttaacttatgtggtatgaaaactattctacatggaccaacgggagtgctagaaaggtccattaggacacttccaaggctacacgtggccgtcgatggagacaacaattaataaaaattcatacggaaaagcgtaattttgtagtagagagagcatgtctaatatcatatcacgaaaagacaacctttcatgagaaataacatataaactataacttaaatgattatctcaactctcctttgtactatgttatttgtaggagtaaatttgtctactgtggtcaatattgtcgatggcagtaacatccttaactctcctaagatttatttcgaggcctaacaaattagagaacaagtcagagcacaatggggccatagtaagaatgcacggggtttgtgcgagtcaggaatcccgacaatggaattgcctaagcatcaactctattttatactgacaaagaattacattggactctagcaaatgagagaaaagtccgggcatggcaggcgttgtgcgagctaggcattcatggcaatgaaattgccaaagtacaactcgatctattttgtattaacaaagaattgcataggaactaactccactgttgaaaaataagtttgtcgtaaattcaagattccacaattttggtgaattttaatttagattttctatgttttaagggtcgttacaaacaaaatcataaccaaatttcagagcaatcccaaatagatttttgagagaagtatcataagtttaaaatataataaaaaatccaagtaaaaatcagccaaatttatacattcataaatctattatatactaaaagtccattgaatttgctgcaaacgctctcaagactactacaaatgctcctaaaccaccacgtgatattctaataaattagaaaaaattctagaaattctgagaaaaataaaaacgtacggctcttgattgtcacttaaatcagtcaacacgttatttccaactattagatctaatctttataaactaaaaaaacaaattgagaaggatatgtgcttcaacggtgattctcaccaagactagctaatgcgggagccctttaattgtttatatatggtgagcttgagtggtcgtgtaagtgctgaagtgagaagcatggtgatggtgaagttggtgtgtttatatacattggagccataacttcaacgtattggagaaaaataaggtgagccaatgtggggccttgattgttgtgtatgtgagtagcttgagcagctaagcggatgcaaacaaagtaattatacaagatgttaaattcttatttgttgataatatattatagaagaacttaatggtgctttggaaataccttatatttattttgagaggtgactggagtggtggtgaagggtttccatataactaggagcagcaaccgtggtttataagtgaacaacatatgtattcttattatttgatatctgatagatccaagttcatgacatatttgacagcatatatagctctttcttttctgtctccgataatgaggtaattaataataaaaatttaaggactattttatggtgtagatcatcatagaaaatattaaagacgctcgcgcaaatgcgcgggtttccttcctagtttcttaatttctttatccaatagatcgcagtagccgccatagtagattaatttgcactattaatcagcaggtttgacgatatattttctgttttacacagctggtccgattagacttctgacctctatggcttctatatatgtcgagtttccattcgagttggatactctgctaagatttttagctacacataaaacgatacgaatataaaattagatgggttattagaatataattaactaaatagtattaattatcatagattttaaatatatttatttgcagaagagaactaagggagtagtttacatggtgttttaactttcaactcatgtatataaatataaataaatactgcgcctatagtcctactttttgattgatctgttcgtcgttgcagataattttagagtgtcaatcttgcacataaatttacatatattctctactaaattaattttcgtataaagcatgtgcatgttttgataaattggaaattgaaggtaaaggagcgaggtagctatagcttcttcttataatttaccaattcgacaatcttaccgtacatgttttcatcctgtagctgatgtatatatatatataacctgttgatgttgacagtcaacatgcatgtgccgattagttggagttctaagttccaacgttaaagaaacatgtaattaacagtttcacatactaattaatactagcatataacccggttacatctctcgtcaaaacagcagcgtttgcccgttctagttccaaccttcaaaggagacacgaacataaaaaaaaaaaaagggacttacctgtactcgcatacgtctgaatatttcagtaaacttccaatatcattttgacattggtatattttaacctatgtatccatcaatgattaagaagcagagataataaatctcaaaccttgatttgtcagacgagctgagagatcaattgcttcggctcatcatccgtggagtatttgctacgtaatctttgaacattcaactgcggggaattcaatccaagaagtgacatagtactaatgaaaggtaattcaggaataatagttctctaattagcgaagctgctaggaaatcctccactgaataatcatgtgcgctatatatctgcaactgatgttgaaacgagccagttttcaactgatgttgagatcgctttcccaattattggttgactcttgagttcgttcatcacgagtctatgggaatttctttgactagccatgaagctgtaacatagacaaggacaatatcatattttaataattagctgatgcaaatgaaaggcaatacaggaattaataattcctgattcatgacgccagtcttctttatgaagaatttattttttaaggcttcattttcacccaagttaactactttgtcagacgtgcgttatttttttaatttatccgaaatatttctttgggtagttccatgatagaacagaactagatgttgtacaaaaacgacacaagccatacggaatttccatatatatagaaaacaagtgcagcaaataatatatgtttatcacgatgatttgtgtaccatttctttctcaaattattggtcgctttgacttttttcttgcaatgtttgaccgttcgtcttattttaaaagttagtgtaaatgtaaaaaagataagtcatacttaaagtgcttttgataataagtaaatcacaaacaaaataaataattatttcataattttttgaataagacgaatgatcaaattaaaagttacaaacaaaaac

SEQ ID NO: 67605 - DNA, 6346 bp, Oryza sativa
ggcgcctgggagctgcacgagccagccatcacctcctcctccatctcctcatcttccccatccacctccactagttcttgcgctcgttggagccgtcgtctccaggaagccgcccttctctctgcggggcctcgcccttctccccccaccactcctttgcccccaccaccgccggagggatgggcccctcgctcttcggtgagccggcgcggctgcgaaaagggttagggatctgtccgccgccctccatccccgcgccgccgccctgtggccttgcgcgcgcgcgagagagggggggggggagagatgcggtatgataggtgggtcccacacttgtttttataaatatagagctgacgtacgccacgtaggacaaaaccacttcggattaggttgaggggggtaattcgtccgttatcaaaagtttagggtgagcaatgcccggttttatggttcggggggtaatttagacgaccgcgatagttcggggggggggggtaattcatactttttccttacatatatgtcatggtatatacccctaagatataccatctggaaattttaaatagacggtatatgtagttatgtagtacatactacttagacaaaaaggaggggaggaagcgcaagagcatgcatgcggggtacgcatgctacgaacacagaggcatcttttgcataggagcaagttcgtcttttccataaatctttataattatgactgtctccaaaagaatactcttatttctcatacgtgcagctagtattaccacgccgtcacgtgataaattagtctcgttgtgaacttgcattatatgcattatataggctaatttactgcaaatatatgcttgtataggctaatttactacaatttcaaaaatgggccttttttaagataacagaatataaatgtctaaactctgcacaatttcgaatggggcttgaaatgtggcctgtcgaatcacgggaaactatttaaaacctatgtttttttaactcaaattaatactgccgaattctaactattgaagccgatcgacaacattaagtcggatagatcgatgcatgggcggatataagagtagggctaattaaagctctactcctaaacccaaataccaattgaaaatacacttcaaaattaaaagaaaagatatagaaaatgaaaaacaaacttacgtaaactctacaagtatccaattctactcttaattaattattctgtctctgccatcgatcgatgatcaataaccgtgaatatctcagggggttactttatgtgaatttccctagctcacggttagcaaccaagaaatctggatttccccgactcatggttagtagccagaaaatctaaatttctacttgaggggtggccgtcaaaatatattgcgtgctttggcggtttacatgccatctttagcagtttttgagcgtcaaaaaattatgtattcttctagcgttggcattgaaggaatctccatctaccgctgtacgtacatcgcatgtgcagatgatgtgcatatgacacggctagcttggtggcagtttctctctctctctgcctgcagtcagaccaatcattgccgccacgtacgtactccgactctagctgcagcagctggggtacgtcgtcttcttccttcgtcctttattttaagctgcaatgggggtcttcttctagcttcgtctcgatccgtgggcagcggcgaatgtgcagagtaaatagcatctcgactcgggattccgtcgtgacatgagtaatcgccgccgctcgcgcctggatgctagctacacgcccctgcactgcacgtgcatcaccatggtcactcgcgatagatcgtacgcgcggctgcctcgatctacccttcaattttcaccacaagatgcagttcttttcactatcagaaaaaaaaatcatttttataacatttcctgttcatttttacctgccgacaaaatatactgcgtggacatattttttgccactgctcgtttgtaaagaaaattttctaggcggtcacctgcgaatataactttgtttttatggttagacggccctctcgacggttcatttgtaaaaatctgatttttaaaagtaaaccgttaagatggtcgtttgaaaaattttacaccatcgactactgtaaaaaaaaaaagaactcccatcaatatttatcctctcctctaccagactattactatcactcattatttatccttatcatctctctctccttctccatctctcaccaatcaccagagcgatgccgcgcatgcataagagttcatcaccgtcctcttgccactctccttacacagaagcagccacagaacgacgactcagagagaagagggcggcggtttggtgacgaggaggacccccaacaactttgtagatctggcaaccaagtgcttaacgatggagacggcaaccacggtaagagcggggtggcgaggggaggtgtggggcgacaatggtgaacgagggcaggagctcgggagcagcagcaacgaccttgaccgtgacttgatgacacactgctacgacaacgacgatgcccatcaaatgttgtttatttgcttgttgatattgaactacttgtagatgtttgtttgcatgtcaatgtagtgtatatgatgttgatttgagtatgataatagtggatctaatatggatttgaatatatatgatacttgcatgttgtgaaaatcaatttttttcctttttttttcttcgatcaaaaccctttttgtatgtgggtgacttaattttcacaggcgggtctttagagtgccttcttgagaaaatcgatttttctagacgggcgaaggcctacctgtgaaaattgtcgatttttagatgcctttgatcgcacacggagtatctagccgtctgtacaaatatgttttgtagtagtatttcttaattttcgacacattttaatattggaattacaccaaagactcacatggatatacaccatcaagcacaaaaatgtataccccatccataaatataatcatttctatgagtttttggggaagttaaggttgtgatgaaattactttgatacctgtggtggattcccctatcgggtaggatggggagtagttgaaaaatattaataaatatttatatttgtaggtaaatgctaatatttgtggatggatatatagaatatagaactcgcaagtacagctcttcccattaacgtgtgcttaaaagatggagggtagaacaataaattaatttgaccttgttgaatccttactgggtactcgactgaacttcatcaccataacaaagatgcctcccctctttacaatttttggttcatttggaaggcagaaactttaagtttcggactatttttatgcctctcggaaattcttttatgtgagataaattaaatgatttgccataaattatctacaaacaaaaaaaagtcctctacactaaacttggcatgcatttgctgttatagcacaacactcatggtaatcgctcagttatctatttcgtcgacaccaatttacttgtttttcttaaacaacctctacaagatagtgcaaacttattatcattttctttttcttaatgataccttcttctccatcattgcctgcctcctgatcatccctcatgaatcttccaagaaaaaagatagaggaattggatgatcatgcccaaaattaaagctagttggcacttagcacctcatatggtaagtagtttcttcactaccttagctgctgttcctcttttgatcccctggctgccaccgtcaccatcaaaagacctatgcaagcttcaacatagaccagccaggaaacaatttagtgctcacaaccccagttagttgatcttgatcatggagatgtacatagcataatacatatatatagaaatatgtgtgtgtgtgtgtacagccatatgtacaggtcattctattttgttttgcttcctgagatcacttgatgcgtcatcatatatagacacttgtaagatgtgcagctggacatgtacaagccaagtgataaaactatgtaccaaacactactacctaatgagccaacctctcaagtaataagcacctttttgatgtggggttgacgtaggactaagatgtttcaaaattcttatgatcataatttcgtatttacgtatgtgcggatgcgcttttagtagaaatttagtaagattactcgtatttatcgctggtttctacctcgatctttatcctacctaaggaaaacaaaataaaaagatctatatttgcatagtgatgtgtgtacatgcgcatcttctacctttcatgccctaaaatttaaagaacattcatctatttttcctacttgtttacaagagtatatgcatgatgcatgtaatgccaaaggagcaagtaaaaaaaaaaactggagtagcacatagactaaggaacccctaatgatgggaattaaacttgtccttagtgcaggaaggtcctcagtgtgcttagttgctgctgatcccttcctaataattaaagcaaactgttctttatatggacggctgatcttaagaaatcaacttggtccattatgattgccaaatttcttcccagcactgtttcaagcaatgattcatttcaagctatataggtaaataattagacaaatataatggttgatacacccaattattacttgggtggggccccatgttgcaaagtgcatgtttgcattttggtgacatcatgttgattaggcagtgataaagaacagttgatttgcatagacattgatcagttttaactttagactactgcttcatcaacttactttctgaaaaggtggtaaggaaggaaggaaggttttggtgttagggggttctaaaatagcttttcggttcgagtggaaactgctgttcatcatctttactttcttggctagtgaggtcatggagtaatgtgataatgtactcatgaggtggtgagctgcatgagtgggtaactgttttcgatactagaatattccagctgctggactctgctctgtcccttcccccccttcttttttgtgttctatgaaatcttttaggaatccgttcgctctcatacatgcaaactctgattcagtcggtgtttatttgatctctgattgtttcagtggttgaaaataacatgtcattatcgggcaatgaatgtctgccaccttcaattcattaaaattggttctgccgtgtaaacttactcctctggttctggttctgttttcttttaaattggttagttcatttttaaaccataacttttttcaaacgtgcaaaagatattgcacgttgatatattagaagcaagattattttataactaacgtcatataaaaggatggaaggagtatttactaaaccagtgaatatcgctatgtgaccaaatggacagccaattatacagtttatactaccgactgaaaatcgttatacttgtgatattccagttaaaacctaaaagtttgagtttgtgaatggaaaatttaatttgcattacaagtttgagattttgaatgacaaattcgtgtgattcccattgaaagtttgatgtcatgaattgaaaattttgcataatttaagtcgaaagagtaagaaataacgaatattttgggttgaaacttagaaccatgtccaagttggataaatcacgcgcgtgtaacttagcggttgacatgagtaacaccctccaaggtcccaatttaaaaggctggatataccggttggatatagaggccgcgtaaaaattatccttctctaaaaaaaaaagtcacgcgcgtgttcgtgcattaaaatttttataacatccaccttataatgaaaaaaatataatatatgtaggcctgatttactcacgatagatgatatgatttccgcgtgatctacaaccttgttgggctaagtttctgggacatgttaagagcttcagtatgaataaagtgcaaaccttgagttcagagtaatgcacccataaataatgctatcgcagtgcctataaatattacatatccacactatgtatgttactcctatattttcggtctctgtcattttgagcatggatagtaaatgcactcgtaggtgtatacacgtgttgtgcatgtgtactatagtgcgtgtcttatatgtgcaccttctgtgtaaccgaattatttatttatttagtttttgaaatgaattcataaattccggcctctgtcggcttctcacggccctgtctttggcccattagatccggcggcaactcatactgggcctgataaattgggccggttgctctcaagctaggaataagtacactttgactcc

SEQ ID NO: 67606 - DNA, 619 bp, Oryza sativa
atttaagccaacttatttaggttggatgcttgtcattcattatatgatctcatctcataattatccttgttagaaggcagtaaggtttctatctccattatctcctcacttgcaatcttttaccgtgctttaaaagatcactgcatcactgttttagagtctgattgttggggaaggtttccagtacttctgattctccactgacatggctgtgtggtttgctgattaaatgatcaggtggcattctgttctccaaagagcagaaacatggttaatgcaataaaggggttgttcatctcctggtaaggtccttttacaatcgataaaatttagctcgtttttcttcacctctatgtagtttgcacaatcaactcataaatcctttttttttccagcgatgtaccgatggcacagttcattgttaatctgaatgcttcaatgcccgcttcggacaagttcatcctgcacatgcttgaccctacacacatgtttgtgcagcctcatgtggcggagatgatcagaggtaagatatcagagttcagagaccaaaacagctacgagaaagccaacatgaaagatcattctaccccacagtaagatatcctgtgtgtacaccact

SEQ ID NO: 67607 - DNA, 967 bp, Oryza sativa
aaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattaccttcttagggttttcttttgatttgcaccagcattttcttaggatcatttataaattaaattttaggcttgggaggagaacttcggggtgtgacatctactttgagagttctttgatttgtgtttcatcaggtttcggcggtctaaccggcgacataccggcggtcggaccggcggcaggcggcggtcagtccgacggaggagaggcggtcagaccggcggcgacttcacatgcggcaggcaatcttcaggcggttggaccgatggatcaacaccggtcagaccggcggcacgagctcggtcagaccggcggatcaacctcggtcagaccgatctacatcgaatttgagggtaacttttatttccgctaaaagattgggttgggtatatcaaccattcaccccccctctggttggcttagttcttatgattcgatcctacagcatactcttctaatagtatgaccgtatacatcccaaggtgtggagagggtggaagttttaagaagatgagatatctttatagagagcgggtgaaaataagatacatggacacttccctcggccttttatgtgcccttcaggccggttactgctaccatatggcttcttctcttctcatgctttaatatatgatgagagtccttttctaccttcattaatatacagtcccatcaatgcttgatctttcaaaaacaaaaatgatgataagacacttctgttgtacccattatattttggcaaaattggttatatagcattaaaagttcacgttttttgttttatagcgcccaagctt

SEQ ID NO: 67608 - DNA, 10884 bp, Oryza sativa
acgtcatgggagaggggtggggcccagtggtggcgtcacgtggatcgacaggcgcaccggccggcagctagcttcgatggatggatggatggctttgatggggaagacgacgatagagtagagcgagagggaggaggccaggtgaagccattttgatcgccaaaaccaaccaaaatagcaatcaaaacgggacttaattatagccgacaaatcattactaaccactgttcaaaacttattgagtgttccatcatgctttcggatacaaccaaaatcctaaaataaagattcatggtgctaaaaatttaatttaaaacagattccatattcagattcttagtagtagaaaattactttctaataagataaattatgtttgtttttttatgggatggaataagtagtatactttctccatcccaaaatataaggctcaaccacacctaacataaagaaccagaaaaaaattaatcaccttaaatggatcatatccatacatgtaagcaatatgattgggagatgtaacggtagaggattcaatataaaccaaatttaaaagcccaataggtgataattaatatatgtatgcctgtatgcacgtcttatattatgagaaataaaaaatatattgtgtcttactactatttaaaatggagatagtagtaattgtaaatttatcccaaaagtaacaaaaaaaataaaacgacgtcaaccatttcaatagctacgtgtggtcgagtggtggagtgcaaccgcgggtagttgtaatcctgttcccggcggcgagcgggcacacacacgtgtcatcaccgcgtgggggcccactggatcgtccagcccatcacccgtggtctactggtctccctgctgcttctgcttcacagtgaggtcaccctctctctttccggctggctgcaacgtgggacccaccgtcggggacgcacacgtggcggcggcggcgtccgttgacgtcgctgttccggggcgctggggtggccgtccatctcggccgcgcacacacgtcacacgcccaccatgcaaacaccgccgggaaaccgacggccaggatcggatcttgatcttctatggcggccgagcgatggatcgagatggacagtggaatttttttatttttttagactttttatttttttaattttattaatagaccatttaaaaaagtatttttgaaaaataaaccttctaaccatggccacgccaaccgtgcgtgacataataaagttatttgaccataccagacgggctgacgtggccaaagatacagatttgtaaatatttttcgaatggactatcaataaactaaaaataaaaaaagtctaaacataaaaaatttctcgatcatgtggtggtggtcgtcgtcgttttgtcagggtgcgtatgaagcaacgcaggcggttgaagtatctgccatgcaccacgcggtttgtaaaatcattgtcatgattaatatttgtgatgaacaattggctttacaaatgatttaatcaacgaattggtttgagagcatgtgtgaatgttggtgtgagtgcgtgactaatgtgggtcaggttgtgatatctgtgcccagaaattgttgttttgtctgattgtgtgcaggtgacttgaggttagccttggtcaatggtgaggaccgggactatgctcagggaggagcagaggtctagtgcggtcaggatactatgtgagaaggtgactagagtctggattcttggaggtcaacttcggtcaacggtggggattggaactaaactcagaaaggagttggggtccagacggttaaggatatcgtgtgacgaagttagatacgagatggcacacggtggatagacatcgtgtgagagagatcttcgcaacggacttcatgaggtgtgcgtgtaagcgtcagtgtttgcgaggaggaatgagaaaagatggagatgtacatgtacggtggagtgcatggttgctacagtactcgatgtactgtagcgtgtagtttgcctgtgcgtgatgtgcatgtgtgctgtgtgcatgctgatgcatgtatgatagttgtacgtgtcctggtcgatggcaggcttgatccatgcagaggcaagccgactcggctcaggcggcaagcagcagcagcgagggcaggagtctgacttgggtgcggctgtggatccggagaaaaaggaaattgaggtattgagttctactgtgaataggaataggagttctacacctactttgagtagggggttttttatgtataaatagagagggagcgtgaggcttcccggtatcgctttgagagcaattgagttgatagtttagttagggtttcgagtttagtcgagatttttgtaaggagtgctgttgttgcactttgtaaacatagagagaagcaataaagttgtcatctattttgagagttcttcgatttgtgtttcttcgggttcaagcggcagggcggcgatctaacccgcggcgtgcgagcagtccgaccggcggcgataggactacgtcgagatttccatcaatttaagggtaacttttattttccgctaaaagtttttgggtttttggttttccctaccattcacccccctctggtaggcttggttgcttgtgttcgatcctacacgcttcactccatgcttgcctaattattgacttcattaccatccttctaatttactttctccaactactccatgttgtaggccgtgtttagatgccaaaaaaaattgacaaaaatatcacatcgaatctttgtacatatgcatgaagtattaaatgtggacgaaaaaaataattacacagtttgcgtgtaaattgcgagaaaaatcttttaaacctaatagcgctatgatttgacaatgtggtgctacaataaatatttgctaatgacggattaattaggctcaaaagattcgtctcgcagtttacaggcggaatctgtaatttgttttgttattagtctatgtttaatacttcaattgtgtgtccgtatactttcaaatttttacaccctttaaactacacacccataataaaaaaaatcaacaatttcaaatttatcatcgtataactctttgacatgtagctttattatatctatgtatgcaaattgagaatatatacatgcatgcatgcaaacatttaggggtagttaactgctcgtttgttgtgtggagtatatgaggagttgaagtctacggccttatttagattccgccccaaaatttttcaccctgtcaaatcaaaatcgaatgtttaaacacatgcataaagtattaaatatatgctaagaaaataagtaattacacagattgcggctaatttgcgagacgaatcttttaagcctagttgctctatgatttgacaatgtggtgctacagtaaacatttactaatgatggattaattaggcttaataaattcgtctcgcggtttactaacggattctgtaattacttttttttactagtacccaaacaccccatgggacaccctatatgatactcgagatgtgacacatcaaaactttacacctcaggatctaaacaccccctacatgcttcttggttcttccgtatcacatgttcactttgatgctatttttaaccataccattttttaagtaaagttgccaaaaaaatgtccacgtttagtttgttgccaaatttggtcaatacataagaaatcctaccaaaattttggtaatattaccatcttgccaaattttttgcattactaaaacttggtaaggtttattttagttataatctgaacatgcccttaatcttggtgaaaaaaggtatatgatgacagagtactacgtttaattacttggtccgaggaggaaaaaaaagaacataagtaaaatgatgtaagccattagcacattattaattgagtattaattattttaaacttaaaaaataatataatttttaaagcaatatttttttttaaaataacacaccatttagcattttgggatattaatgttaagccaaaactgtgataaactgtgataagtgattcaaaaaatgttaagccataagttatagtacatctatcattatcctactaaattacaatgaaaacacgacttatatatagagaaaaggaaatgatactaggagtatagtgaatcgttttttttattgttttaggtaaagaaaacaaacaggaaaatagtttagtaggtcaagtgctttggaaaaaatagtttgagggattaaaatgtttttctttcaaaaaacacgactacacgcaacaaaaaacctagaaaatgactctctttttacatgcacactcatacatttaaataatgataaacagatatatttaagtatatatgtatagaccttagtctacatagatattttaccaaccattcttacagaaaataaccttttgaaataaataaaatttgcttatgattagcttattctccacggaattaattagcaaacctcgcaaagaagaaactttaagtgtgtactacatgctatggtaggtaggagtatatatttgtagggtaacatgtaacatatgggcccaaactttaagtgcatgtacgacacactatttaaatttcaggtattttacaaaagaagaattaggtacatcgtacggaaaaacaagataaatgccggagtacagatgtgcacaccatgacagccaagcagggcaaaagatctggaaacaatagaagcagtagtaactcttatgttgattaaaaatcgatgggcacttgagccatctgacatggaaatatctgattctgacggccaaggcaaatgacgctagctgcagctaaaaacatggccaaaggggcttttcgccacgtcagcctcctagggacaccgggcccacgcggccacgagtgcgtgcccacttgagaaagcacctgacgtggcgtgacagctcggcaaggccaccacctcaacaaggttaagggatgtaaacggttaaaaacggctcgaatcagtaggatcgaaacgtgaaaattcccgaccgatcgagcttcatttttatataagtggcaccatttccatttctaatgatatacaaaatttgatttctctaatttatttcaacatagtaggttgttggtactgaatatttaaatttataatatggtcaattaccgaccaaacaagaattattttggctcagttgagaattgaccatatttatcaatgtatctattcactattgacaacaatatggtgttaaaacaaaatagagaaattaaattttatatattgctaaaactgaaaatagccagaaacggtacggctaattccagtaacaacgctatgcgatttgttgtcttaattttgctgtacaaatggactctagcaaaactataggcatacaccaaattttggagggcactatcccatccaactcttcttgtacgttagagttgacatgtctctcccccatactatcctccaatgcctagtcatccgcaagctctctcgccaacatccgaagatcaagagtgagtcgtgtggttcagggtgtcggatccggcagcacatgtggtgggggtggggtggagggaaggtggatcctacagtgaggcattaggaagataaggatctattggtagaggggttcggggaatcaaaaataacggtgcatgaaagatctcgtgttggtcggttgtagctaatgcccttcgagagtggcgatctgatcaactcgagaatgacagaggtaattgagagggtgaaacggggaaggggagcagtccgttccacccatcttgtcatcaagacgaggtccggggctgtaaacgagatgggcacgttgtggagaaagggagaaaaggggaaaagaaaaggtattaacttctaaggatttattttccattgaagtggttgtatttcaagaaaatggagagtttgaatagcttcccaatgtttaacacgaagaattgggaagctattcaaacattaagaatttgaatagcttatcaattcttcgtgttaaaccttagaagttaaccttagaataaaccttagaagttaataccctttcttcgcgtaaaaaaagatgattatatccattagaaatatagtagttataatgaaattataaatataggaatagttagaaatatattagaagagtgaaacatgaatagtttgttagagtgggaagtattgagggagaaatattttcagatatcatccgtatggagatatggatattatggagggtcataaactcataattggctagtttgctgcagatggttgaaggcctgttcagaatgaatgaaattaaaaatatttaaatatagagccctgactacaggctacagcttacagctagtttccttaattaggagaaaaaaacaaattaagcatccctagaacgtacacataagaattcgcagcaatcagtttatattctcatatgaatcagaaaaagaaaatctagcactccaagtttcttctaagcacgtggagagtttagtatttaaatgacattataaaaaaattttcctccatcccataatatagcaacctagtcccgattagatgggataattcatggtacaatgaattcgagcatgttttctgtttagattcgttgtgctataaaaacatgtccagattcgttgtattatgaatatcatatccgattttaggttgctatgacatgggatgatggagtagtttattttcacgtcattccaaatgctgttagccaagcaagggaacgattgatgtgatggatgcggctagcgataataaagcagaaaaaaaaagaagtgagtctcacgcacgaacgcacgcacgcatgcataaaccaacgctcgctttcgttagcgatgatgtatgcaattaagcgaatatcctattgatccctgattaggctccataattaagaagcaagcaacttgtcacgttctgattactggtttgttaatgaatcatgacttcacgacgtcaggtgccacagttcacggcctctattaactgatcttgaatttaataaacaactcaatttttctttgatataaatcgatcgagcatctttttctccttaatttgacacagatatattattatattccctccaaaatgtaaggcgtatattttatttcatgaggacaagaacttaaccaacaattactctatgactacctctactctcaaatataagagattttgcctatataatttacatggtcaaaacccattatatttattgaggtaatagattgttttttgaaaattaaggttattatattcatattcaaaagtaattattttgtagttataattttgttccctataattcttgtattattaatgcaattattagttaaatctttcataacaaaataaaaatatgccttatatttttatacatagggagtatatgaagaagcattagtagtaaagaggtaaaatcgaaagacattattactctagctatttacaagagtttaaattttggaacttacaaatattacaaacatgtggcacacttgcaataggtactgaatgggatcaaggaaattaaaaaatgtaagaccatgtatttctctatctttttaagcatgtgtgaagtgattacgcatactcataggtgcgctcgtagcgatttgtattcacgtatctttcatgtaattgaaaaggtatattgtaacatgttactaaataaataaagttggagtgatatgatgcaaaaaaataataaaagtacctaattattttgggtgatgagtgtggccacctccaacgatagtggggagggacaaaaactggttgaaatctttagagatgaccaatgggggattgggtggctgaggtaagttggcccccaaaactaatggccgtagttttcttatccgggggcgacattttggtggaaagaatgcacttttgcactgcttactagtagttgctccatggtgcatgccaccctttctttctttctatctctctctctttttttttctctttgtttcctcatgctattacgtacgtctcctcctcttgtttaatcatgccatctggtgctttttgttgtgttgtttttttttcttgtcttgatgcaaccaataccatgtttaaatatattgttataattatatttgtccatattcatcctaaaataccttacattttcgaacgaaaagagtatatagatattgagcagactcaagaatgattttaattatgtataaaatatatatgttcttttattcctcaaagagatatcatggtaccatatatagcttatagtgttatatttgtggttcgatctagtggcgtagctagctaggtggcactgtgagccatggaccacctaaaaatttgatcaagattaaaactatagtatatatactagttaatataataaaaatagtataatggacaaccattttaattgacatagtacatatagatggaccacctttactttaagagcctatttagattatagccaaaataaaacttaccaagttttggcaatgccaaaattttggcaacatagtaatattgccaaaattttagcaggatttcttatgtattgaccaaatttagcaataaactaaacgtagacattttttagcaactttgctaaaaaatggtatggttgaaaataacatcaaagtgaacagaccctaaatcctagctacgccgctggttcgatcggggtattattggtatttcataatatgtacctcataaggtttcatatggcatatgcttttcttgttgtttggtgatcgatcagtgtgctagggctagaattttgtagaaaaattaaaatttggttcagtgtgctaacttgggttgtcgtggtgaataatattactaacataggagacttgtcctgagtgctccctaagcgataaatggtcactttgtgtgatgtggatacattgtttgtcacgtccatttcccccattcctctagctatgtcaaaagcacatatgcatcaggggtgcctgctaatcgagtattattagataacacggtacctgtctatctagcaaacttgtcgatctcgtcattaatctaatctcactttttttaaatagggatatccccggttctattcacgaaggaaggcatatatattagttaccatcaattactcctcatcgtttattcctcaaatacttagtttaaagataaaaaggtaagtttattatataccttaaagagtgttgtcataatattataaacttattctaatataaaattaactgtcagaattttagaagttagaccaaatcttgttttaaatatttgtatttattacccgaggaagtatatctctctgtctcttttttaattagtgtgatgggaagacctttaatctagtattctagtttaacctatgccaaacatatgtaacctaatttacacaaagattttgatggtcactattacttgcttctagtttatgttgatatagattaatttagaaaaaaaatcatggccagagacctcaacctctatgctagcatcaaattaatatgccctatgtttttttggctgatttttaaaatcaatactaattactgaacatgtcaatccacatatcgaagcagtttggatgactacgtacgatggtgtgtacactgcttaaagtaatatgtatttttatttggaaagctacataattactgcctctgcttttagataacttttatcattacctacgctttgacaactaataactcttattaaaagattcgattacgatgcaagaaagttttattcttatgttcaatttggctgatgccgctttaaaatatagatgaggcggagaacaaatatattcattcggtaagagcaatcgaatataacacatattgtatttataattcaattgcataactgcatcgatcattgtttgtggtgtgtgcatgttatgaacagacgaactaatctgttgagcgttcacaccttgttatacctaattttgatagaatatgactactgtaaaggggtagagggtcttgagggtgtggggcgacatgggtcgtagttgggtcggtcgactcaccctacctaataggtagatccgcccaggttcaagatgaaatacactttaataatatgttattttcttttcaagtattgtaatttcttttgcaaaaaaagtaagacgagttgttaaaatttgaagatgaatacatataattccactgtcagtcatttaaaaacggagtatagcacactaatatattcatcatgctacaacgatttaatactcacacaatatttagtgagtgcatctcctctcctctcctcatcatggccatcgatctatccatctatctatctatcatcatctccatctcatgcacaccacacaggggggacctaatggcgatcgatcgcctggggacgggggatagcgataaatccccctccccctccctccatccacctggttttctttttttgcaccgtattactttcctattttagtaaatttatgcacctaaattttatacatctcaagtttacgcatctaaagtttatatatccgattcaaatttgaatttgaattcaaatattttttatatatagtatttctatacatctaaagtttatagacctaaagtttatatacccgtttcaaatttgaatttgaattatatcttattcaaatttgaatttgaattcaaatattttctatatatagtatttctatgcacctaaagtttataagtcaaaagtttatatacccgtttcaaatttgaatttggattatatccgattcaaatttgaatttgaattcaaatattttctatatatagtatttctatacatataaagtttatacacctaaagtttatagatccaaagtttataagtcaaaagtttacatatccgat

SEQ ID NO: 67609 - DNA, 749 bp, Oryza sativa
cacgcagtcgctgacgcgtctcctccttggcatctgacaagagagaggggtctgagaggcgaaatagataatgaggagcgaaatagataatgaggagagagatctgaaaggtgggccctatcaactttttaatagaagaattgttgactggactgccacgtaggatcaaaatcgcttataaagctacccgtggtggttttttatctggtattgatagttaagggtgaaagatgtttggtttttaggtctagaggggtaagtcgtactcacccaaaagttcaggggtgtaattcaaactttttcttttttttcttaggtagtattgtgttttatttgtaaatttcatttgaggtgaaatgtcaataaatatactgggaaaaaatggaagccaaacagaccagaagaaaaaaatacataaaaaaaaaaagctgagccgacgggaagtggaaaaaaggaaagcagaagtctctcgtttattccaatcttctcagtctctctattccccacgctttttacaagcgtcggctcacctttccttttactttctctatcgacagctctatcccaggaagccacaaagccagctagcaccaccatggttttgcctccctctcgaacagctccacagcgaggtgatggtttccttttccattcctttgatctggagtggatgggctgagaacgcatatgtttattttctctttttacttttctttttctaggatttctggtgcttggtgaacagtgtg

SEQ ID NO: 67610 - DNA, 1830 bp, Oryza sativa
tcatggaaagcatgtcctcagtttcggggaaaggtgattctaatttgagctcgaaattgctcaccaggtggctcaaaatcacttttatctgctggtaggcgtagccctcgcccatgcatgcatgcttcccggcgccgaacgacaagtaggcaagatcacgggcgccggcaacggccttgtcctccgccctcccggcggcgaaccggtccgggtcgaacacgtgagggtccttgtagatgttcgggaggagggtgttgaccaccagggggctcgccagcaaccgcccggcagggacgctgtactcgccggcttccttgtcgcgcacggtgaagccccggcgcgcgcgccggaggatcatcggcgtgaccgggtggagcctcaacgcctccttgatgcagcggtgcaggacgtccatctgcagcagcaccccgtagtcgatgccaccgccgccgccgccgccatggtggctgcgctgctgctccgccgccgccacgagccgctcctgctccgccctgacggcgcgcaggtgctcggggtgggtgagcaggcgcagtgccgtccagacggcgaccgtggagctcgtgtggtggccggcgaagagcagcgccactagcagcccggtgacctccgtgtccgtcgtggcacggccgtccccgtacgtcgagtctatcaggtcctgcagcatgtcgtcctcaacacgtccagacatcttgcgcgtcttgacgatctgggagaatatctccccgagcttcgcgcgtgccttgtcacgccggcggtgccccggcgtcgggaggtaagggaagaacatgctgatcaggtgcatacctcccatgagctcgtgaaacagtgaggcaacctcgtcgaacatgttctcccggacctccttcccgagcaggcaccggctcgcgatcagcatcagcacgtgatccacctcttgcatcagatcaaccacgccacactctccccattttccaaaatattcctatacaaaccagattagtttacggagatgataacagacatgatctgagctttgatttataggatcaggtaattgacaaaaaaaaaatgtacttgcctcgatctcacagaccatggggaagaacatggcccctcagttggcgagcctcaagccttttgggcgaagaaggaaggtcgttgcttccttggggccaaatcgatgtggttagcaatttcttttgccaagaatggccccgggtgacttcgtccaagcaatggatagctatctcaacttctgggcgtgaaaaaaaaaaaaagtggtcggagcactccggcccgacgaggaacgtcaccgcaagcccaagtgacctgagcgtaaacacgctgcccagcgccctgtgctgctcgcggatcacggcctgcaggcccctgcgcagcacggctggaattatcccaaccagaggagcacctttcgcctccggcggaggccgcggcttgctcgtcttctctgcagggagagttactgatgatcttaccaccttcgcagctagtgtaatgatgaagacgagggctatggtgagccatgcgttggtggagaatatgtgatccatgatcacaacccagctggagcctctgctttagtctatactacgctctaagaaacaaaattaactacggagacggatttcattcaatataaatatatagggccgtggggcggagaacatgtactgatccatgatcacaacccggctggagcctctgctgcctctgctttagtctatgctacgctacggaatgaaattaactacagagagagacttcattcaatatatagagcgtgggacagtaagttagctgtcctactaa

SEQ ID NO: 67611 - DNA, 562 bp, Oryza sativa
ttggatcatgcaagatagcacaagattttttttcacatttgtttttggttttttcgtgctccaacagctacttttgagagagagtcaactatcaatgaagtgaaaagtataatgagattgctcccggaagttgaggttaggcatattggaagatggtgtaatagggtagctcatgacttagcacaattatagtacaatgcatttgtggagcatggatacccagtgttgaattcatgatgttgtaaaccttgagtgtaacaatcgggcgaatttaatataataggggtgaaaacagagaggatttgggcaatagcagtcatacctagggtgaaaatgaatcggataatatccgatccgatccgttctgaatctgtttgaaatgagaatatggtaggggtttatataaatccaacgattgtggtatcgctaaaatccagcggatgaggattatccaaagttcccattggattatccaacagcccaattcatcagataacataaactccttaattgtagactctcaccgtctcatctcatgcttgtgtagccaccaccactcata

SEQ ID NO: 67612 - DNA, 1382 bp, Oryza sativa
ttaaattgtcagtttgtgtacctcggctgattcctggacgaggattttgtgcacaaataagttcggaaatcactagtgaatttctgggcatgacaagttggtatcagagccatctcaactgtaggataagccaaatggtcaaaccttaaggacaaattttccgaaaacatgatttgtgaaaaattttcctttcttccttctttagaattctttgcaaattgagtagttgttaaacttgatggagaaactcgaagacgtcgatgttgtcaacttctgcaagtccagtggatcgaggaataagaagatgatagtcgaatcaaagtgttccgctgtcaagatagagtgaagtttggaacctatcttagcacctataccaccaaagtgactttgaagaatagttagtagggtaaaacgttgttgcttgttttgtgtgtaggtacggttgcattcccatcattggtgtagttcaatgatgagcgtgtaattatactaggttgcttgcttaatcaacttaaacaatataatgaactacacacatcagatcagtggtaacttggttaaggtcttgtctttagtgtaacccctctcctcctaacttttccaactctgcaacgaaaaaaaatgcaagctatagtggaaacaacaacaatgctagtggatcaggaagttggaccaatggagcaatttaggacaatcacttgggcggagttcactgaagcattcaagaagacacacatatttgcaggagttgttgctttgaagaagcgtgagttcaggacacttaagcaaaaggatcgtatcgtgacagaatatcttcatgagttcaaccgtctagctcgctatgctccagaagatgtgcgtactgacgaggaaaggcatgagaagtttttggaaggcttaaaggatgagttgtcagttatgttgatctctcatgactatgaggattttcaggagttggttgacaaagcaattcgactggaagacaagaagaacaggatggacaaccgtaagagaggaaggattgttttccaggaggcacaggatagtagccagaggcagcgtatcaagccactccaaattggtgaatcttcttctgcaggtcaagaacagtcacaacaattggacataagtggtgagatcaactcagagactaatacaagcactgaagttaacatcgagcaagctactcaattagtgccggttgcgtcttcaagggatacagctcagccaccgtttcaaagcaagtagttttttttaaagccttagagtaattatcggagttatggaataagatagactgcagtttacctatttcctttttctttctagccgttccgaatctcgggacgagattctttgtaaggggggtagatttgtcacgt

SEQ ID NO: 67613 - DNA, 752 bp, Oryza sativa
aacggaatcagccagtcagaaatacaatagtccataatacctccctagctcagcccaattcagcataatacctcccgtagtccataatacctcccctaacctagaggcttagagagtagagagtgaaggactgagagggagagtgaaggactgagagggacatcgaagattccagagctgagcggcggagcgacgcatccagatctcacgtcgcctcgtccccctccgtctgtttgaagtttttgtccatcgaagtttgaagctcagtttgagggtttcttgtattccgataaattttcgttatcgtatccgtgccggttcgttttcactccgttttcggtttcgataatattcaattccgttttcatatccggtgtttccgattctaattctgaaaaaaatatgaaaacgaaaacgataaaggtagtttccgttcgttttcataccgttttcatccctagtgataagggacaatttggtccaaaagagaatgacaatataccgaaagggtaagtagttacatatttccgatttcaaacaaatttataacgacatccttttaattagatggattgtaatggtattttttcaaaaccgttaatttatagagatatggattcaattaacccaatcaaataactctaattaacaaatgctaacataaataataattgtgttaattagccaaattaaacctttacaatttatgaaagtttctatcaagttattttaggcaaataaaaatgaatatg

SEQ ID NO: 67614 - DNA, 6869 bp, Oryza sativa
tctcccatacagcccccgagtctactcccgttcaacttcgagcacctgacgctacgggctacgggggtcgcgacgacgtcgcgtgctgctgccgtgcccgcgtacgtgccgtgctgcggtgccaccacgcatcacgcttcacgcttcacgcatgcccgccgcgcgtttcaggcggcgtcgggattaccaaggcgcgggcgatcgaggtgtagggccgctactggtggagtcgagcgagtgcaacatatgatgatttctttttcttctgcccataataaaggttgggcattttgctagtgttgtgtatatatgaacaagaacgcgcccagagatccctccattaattatcccccctctctgctccgtcagtcggtttggcggtcgatcgatcggtgacgccgtgacggtgtatgtaggccgactggtccacgtacgtgcggtgcgattgctgttgtgatcgaggaaccgcgaaatgggtcgcgggggcgacgtggacggcgcggcgggcgcgctgcggcggttcgtgcgggaagcgggagggtgcgcggtggtggacggcgggctggccacggagctggaggcgcacggcgcggacctgcatgacgagctctggagcgccagctgcctcgtctccgcccctcacctcatccgcaaggtcacccaacacacgatgcgtggtccttcactttctccataacataactccgagttgttctgacggcttcgtgcaattaagccctgcaggtgcatttggactacctcgacgccggcgccaacatcataacctcggcgtcttaccaggtgtttgacaagctgttgatatagtaatagtatatggcgtctaacgtcggctataatctcggtgtcgtatatacggtctcattttcgcatgcaggcgacgatacaggggttccaggcgagaggcctgtcgcgtgagcggagcgaggcgctgcttcgtcggagcgtccacatcgcgcaggaggcgcgcgccatcttcgccgagggctggtccaagggcccgtacgccaaccaccgctcctcgccgcgccggcccgtgctcgtggccgcctccatcggcagctacggcgcctatctcgccgacggctccgagtacacgtacgcacgccccgatcgatcagtcgttgatccctggctatatacatatagttgtttagttcgattacgtgtgctgtgtgcagcggcgactacggcatatcggtgaccaaggagacgctcaagagcttccaccggaggaggctgcaggtgctcgccgacgcggggcccgatctcatcgcgttcgagacgatcccgaacaagctggaggcgcaggcgagcggcgaccccatcacggagtgcgccgccgtggccgacgcctgcgcgagggtcggcgccgtcggggtgaactgcaccgcccccaggctggtgcacggcctgatcctctccatcaggaaggtgacgagcaagccggtcgtcgtgtaccccaacagcggggagacctacgtggccgagaccaaagaatgggtggtcagtgcacaccgttgattttgtacttcttgttttggtttgtactgtacgtgttctttcgatcgattggtcgtacgatacacgcgttacgtgatgcaaatgcaatggtgcaggagtcggagggcggcgcgtcggagacggacttcgtgtcgtgcgtcggcaagtggaggcaggcgggcgccgccctcgtcgggggttgctgcaggacgagcccggccacggtgagggccatctcgtgggcgctgcgtgaatcggatgacgccgtgggtggtgacggcgatcgcgacgatttccctgcagtggccgtgctctagttgttcctgccttgtcgtcgatcatcgagtctcgtggttgtctggttgagcgcgcagttttgtgtgtgtatccatgcttccaatcaatggaaaatggaaataaaatggttcggttcgtgcagtttattcgattttcaacaccttctcgccttctcggtccaggaggaacacaatctttcacatcttgtaacgaaaaataaattgatccgcctcaatgtttcatctctaatgggcttgtctatggctactgatcctattggcttggacttgaatcacgaatcattgaatcagctaaaaagaggcccaaaacttcgttgattttatttagggtgcttacacgtctgagtagcacgcaggaaacaaaacaaaacgcggattcggtaattcttcccaaacagattctataaataaaatctcggtaagaactttggggagctacgatttgcctatgataaacaaattttacatcggggtgcatgtgtatcctcatctggtaacataattgcagcagtcagtatcatcttcaaaactctcatttagcaccctggtgaacaatctgtctacagccatatctctgacgatttgtcaaatgcaatcaggatctgtttacttatcaccacccatgcctccaaacatgccacccatttcttttgagcccatttgtttcatcaaagattgcaggccacccatgccgcctatctgcttcagcatctgcggcgggagaactttgctcatgtgctgaacgttcatgttgcgggacagtgcactcatttctcctttctttggtatcttgagccctttcatcttgctccagattttagcaagccgcttgtactcttcgagcatgtcgacaacatctctgacaggtcggccagatccccgagcaatccgaagaatacgcgattcagtcatcaatttaggatttgtgctgtcaagctctgagataaaattttgacatcagcataataaataagtatacagggggaaatcatcaaccacacactcacctccatctgtcatggaatccatcatcgtcatgtaccgtttaatcttagcttggctttccttctcatgtccctttggcatcaattcagaactaaatccaggcaacattgagaaaacctgcaaacacaccaatccagatttaaaagcgtgctgtgataatcttaaaagaaatgaaccctgggcatgtcaattaaacaagtaaacagacatcatgagctgtacgtttcatttcaccgcaagtaaaagatgttgctaacctggccaataggacccattttcaagatgttctggaactgctcatacataagtctcagagtgaaggttccttcagacagcttctgcaaaagctcaggttgttgatcagtgggtactacttcatgaatcttgtccataaaccccgaccagtctcccatgcctgtcaattacactacaaaggttaaccataagaaacactcagcaacatgggacacgtagtattttcactgacctaaaagacgactgacaaatggtttcacatcaaaaacttcaaactcatcgatgtgttctcctgttccaataaatatcactggactttttgttgctgcaaccctgtaaagaaacaagggtgtcagatatgataagtcattaacagattctgaaatgttaataggtattcattcacagtatcaaccctaaataaggcatttttcacaaaaggaaatgactacatgaacagagaaagtgtcgtgcacacaggatctctgcactttgaacttttaaagtatgctatcctgaagcacatacaatatgatgaaactgttttgcggataccacatctaaatgccacaatatcatgatttcaccaagctcaggtacttaaaataaaatttgcattaactgaactaaacttcatggttgacttgacactatatggttatctagaataaaacagggctctataagagttcttgttttaaatatgacccaaagttcacacaagatctctttcagattatatggaaacagtactcatgaagtgggaaagagaatagaacaaatatgctatcgcaagggaaagaagagaatactaacgcgctaagtgcgccacctcctttcgcatggccatccattttagtgacaatcacagcaccaacagaaacactttgcttaaatgcttgtgcctgatcaaatgcagcctgaccgatactactgtccatcacaaatattaccagatctggtttctgcagagaagcacaaaaatgtgttttagtttttcactataatcagggtgtttctcgaagtacttcaaaattttgactatattaccgtcgcttctgaaacttggcgcatttcttcaaaaagggctgcttcttgtttgtgccttccactcgtatctacaatgatgagatcacagttttctttcttgaacctctccacaccctcaacagcaattttcactggatcagactccatgtagctgcaacaagacacccattaggggggaaaaaagaatacataaggttaaacaaaagttaaaggtagacaaaatatagcaccttccgtaaaaaggaatcttggcctttgttgcattctgttttaactgatcaaaagcaccagccctaaatgtatcagcacaaacaagtgctggcttaaatcccttgcgctgatgataatatgcatatttggtacaagtagtagttttaccagaacctgcatggacacggtgcttgtcatgggaatggaatattgcaattctattaatgaatctaaaaagcagaagataaaagccaaacagaacagaacattggtctttgtggctaaagcaaacaacagggttcattgctaagccaggtagtttgacaagaatgacaaaacttgcaattttgcacatatttgcaacagatccatccatcgggaagccataaaaaattctggttatagtgtccaattgcaaaaaaaaaagagtaaaaaagtgatagagtatatctgttcatgatgcatcatacacaagcccagataaggaaaaaaactagatgaatgtcttcgtgcaagacccaatttaggattacttaataatataaaatacttagatgattcattgcttctgaatgggatgatccaacagataaaccatgtcacacatgataagcctaactacaagaccacaataggaacccacggttcttaaaaaggaaaactaaagtactccaataaataaagctgttggacaaactactcgatacgtgcatgatttattcagctgctctgctttttgactaaacagaagaacatgaaactaaaataagaaaaacaaaacttgcagcatccttgcaacagtcatgctaacactagccattaactggaccatgcacatgaatggttaggataaccatacttgtgtgaccaattcatttttatttattctgcctggcaataaaatcagaagagaaaccacttaatagttaatactatcacatccttctgtttgaactaatttatcaagttccctttcagaatcattcgctgaggcaaagttctcaaattcagctaagatcatggtgattcagaaagtgtctaataaaaagtcgtgatagataggacaattctactttctacattcttaccttgtacagatgtaataaaccgaaattatcataaaagagaaagcagcagaagtaattaattggggcataactcagcagcagctagactgaccttgcaaaccaacgaacatgaccacgcaaggtttccccttcttgggagtgaaggaaggcttcccgggatccaacatgttgcagagctccgtgaagacggcctaaccatcaaaccatcagtcaacaagatgctgcaaattacccgcaaattacaccgatgcgaagggggcaggggggctcacctgctggatgatgcgccgcttgttggtcccggcggcgagcgtctcgaggttgacgatgcgcttgatgttggactgcatatcgcggaccatcttgaactggacgtcggactgcaggagcgcgcgcgagatctcgttgaggcagtcgctgagcaccttctcgtcgatcacggtggcgttgctcatctgcgccagcgcgcgggagatgctcccgccgagctgcgcgagcaccatcttgcccggccttgggggattcgcctacctccggtggtctcccctcctcctcctccaaaccctacttcccctcggatcgccgacgcgcgtgcgggagagaattagggttccgtcgattggggggactgtatatctattgcgagttggatggattacgccgccgcggaggtggagccgtggaggtggtggtaatcctcagatggggggcgactcggttgaataccggggattcctccgacgggaaggcacggagtacgcgtgtgtgtaacactattctttttttcaaaagaataataataattttcataaaacactacatattatatataatgcaaattacgcaaaaccacattaattttagcacgcgacgcataatctcaggtattatcatcctaaagttttacaaaaccacaccgttaaccattctgatatacttatagataaaaaatttaaaaacagatgtaatatttatgtgattgataacaaattcataaatttaagcaatgattttagaagagtaaaatccatcaccggtccctaaacttgcacagctctgtcatccaggatcctaaactcccaaatcgaccgtccaggtgctaaaacttgtccgactgtgtcatcccggccactaaacttgcagattagggaccgggatgacacagtcgaacaagtttgaggacctgaacggtcgatttgcgagtttagggaccgggatgacatagcggtacaagtttagggaccggtgatggactttactcattttagaatttataaaacagtggtacatctgttagtgatatggttccgggggtatcagaaccatagggaggaggctgcccccggtagccacgtggccctctcctcgaggggggtcgggcccgaggcagggcgacggccgccccctccaagtctgggggtcg

SEQ ID NO: 67615 - DNA, 715 bp, Oryza sativa
aaataggagataaatcacattggtcatgcatcctcgcctttgatatgatctgactctcaatgctacgagcaagcatgaataggtgcccaatatgattatatgtcacattatcaagcaaaacctgaatttcagaattaagcccattgaaaaatctacgcgttgtattttcattgcactctttgagaccactgtagatgatacagaccttaaattcatgaatgtactccctaacagttctgtcaccttgtttcagatgttctaatttctcccgaagagtacatttgtaataagatgtcacaaagcgttttctcatcatggttttcaattcatcccaagtttcaggtttattactaacataagtccaccaaaataatgcagaagaggtaaacttattactagcagccttaatcatttgagcatcagaaaaatcatatatatcaaattcattttgtactgctagctctcaatcaatgtatgcaacagaatcatacttcccatcatagaagggtaacttagatgcaacttgttcacaattatagtcatgtacctcatatgcatcatttggagaagtcgtcatatctcgtggaaggtgtagaagttgatgttctcgtattccattacgcaatcatgccatggttagtaccaaacaagaaacacacaataatatgcatgctcctatcaactactaggtagtggcagctcaaatatcacacac

SEQ ID NO: 67616 - DNA, 6556 bp, Oryza sativa
  unsure (1)..(6556): unsure at all n locations
tccgacccccttcacatagtgccgcgtgtgtagggcagcgcccacctaaccgcatttaaggcagtgtgaccgagcgctccacgctgcattaaatgcggcacgtggtgcgcctagccggattgtgaccggtcgaatgaccgatgtagccaaggtagtgcgcctgcgcactggttgcatgtcaggcggtgtgccatctgacatcccctgtcacgtcacgatgatgagaggttgcttagcctctcatcacagccgaagacggtttgcctaacccggttaggatagggtttacgtttcccgacgcaagtgaggatccaaaagtcttcactcattaaatatcgaatgacatgcgtgtcccccgtgtcagccagataaatttgacgggccccacgccatggcaaggcgtgcaagagacttccaaggcaagcaatgagacatgcatttaatgagattatcctccatagataggctaggtagacccatgtggtaaccccttaagatataaaaggaggtccaagcctacctagggagaggatgagcccttttttttagagcagtcctctgcccatcatcatcaacaccttctactccaataaggagatattgtaatttctcacacaatcagctaagcacaggagtagggtattacgcttttcagcggctcgaacctatataaactccttttgtctcatcgttctcggggggttcgaccccctctagactgcctttctcaccgagtcctcgaatctcacccgctgcccccggccgaaccaacaaaggggggcctcactgtcccccgctagtggagttcaccctccgacaacatcacagttaaaatgattaatagtgtggtcttgtgaaactttatgatcataatactttggtttatgtaccatatctcaaaattcatgtggttttgtacagattggaccattagctcgtgagataaatgtctcaaacttagattggccggactaatatgaaaggagtatcaaaatatcacctattgactctgatataaagaccaaatctaattgtaatgcataattgaaccgagacaagccattacatcataagcatactactccctttgctgataatacttgtcgttttagacaagggttaggtcaaactttagaatctttgattatgaatcatttttaaaatatttgtctttcaaatatggtcactacatgtatagattagttctaaaacgtactttaataaaatcatatatttgttaacacttttacacatattataatggaaaataataatcaaagttatttttttggagaccatgctcttgtccaaaataacaagtattatcaacccagatggagtacattttgtcggattatggttttctctgttttttagtgtgttttggcacatgttacgctattttgccaaaaatacaatcctcatatttgtacgaaatattgcatagttgaaaaaaggctacatcgttcgaaccaaaaaggttcacaccgtccgaaaaaaggcagaaatttcgggtggatttcaatcaaatccaccacctttagatccgtgctgcgtttcgcgctacacttcttctccaccaactcaggcaagatggcagcaacctgacgaattatgtctcaagttggggtcaaggtggaagggtggaggaggagtttgccaccttagaaggatggttatgggaggcgacaatgcagtgaagggcagtagaacggacggggaacgatgcggcgacgacaccgaagccgcggggtcgacagcaggcgatggaggcaaagcaaagtgattggttaacaagcgagggagaccgtggcgcctccggcggcggngagcctccgaagacaaggaagaaggtagcacgggggcgccaccactagcttcangaggaggaggatgaggaggaggaggaggaggagagttgagaagggatgaggaggaaggggggaggggaaggtatgcgggccttcccggcacggttggctccttttcgacattggcgaggcttgaccgcgggggattgggcggaggaagcgaactcaatcaattgatagggactggtggcgtagtcgtgggaacatgaggaggtgaaatagagttcaagtttagagaatgcatgaatcttagaataaaaaatacaagctatgggatgagattttctatcacgcgttgtataggtggtcccagaaaatgcccaccttcaatcaggaaccagtttggcagtcatcatgttctacgaatgtatagatcctttttcctttggttttgctagatttcatacgactaaaagtttgtaactctttagttacctaaatttgcacattgccaacccaaatatgcgatgctatgcaattaactgtagttttgttattatatatagttttgcgctgaatttatctaagtttgaatcatgtaatttcatgaattgcatgttcatttcatgtttgtgttagaaaataattattattcaactgtcggagatatgggtccgagggtatgcgaagtgtggggaatctaccttcctatcttgccgcgtgtccctacagcctagtcctgcccccgcagcccgcgaaccgctggagcggccgggagggggggtcggggccttgtggtgccacgtcatgcccctcgggcccttgcaccgcttcgccccgaggccctcgcccagccgccatttggcgggaggagcgagcgaggagggggcccaggctgagcttccattaatgcgcgcaacgccccaactgccccctgtcgtatttaatgcagtgaggcagacgtgcggcgtgctaatctgacgcgccatagtcaagaatgaccggtctgtgaccgacctgacaccggtcacgtctgactagaccgacaaccgtgctcccacgtcgcgtctgcttccggcggagtggaggtaggtatgacccgtcccatcggagggtcattcggacggcggccgccacaagtcttcacccattaatgggggaatgacagggctgtcccccgtgtcaggcgagggacggcgctggccccactcaagggcaagctatggcttagcttccgggcgaaggcacgggtcgagcccggtcaggatagggtgggtccccatccgaaagaaaagtaggtagagacggtgcatgtggtatccccttgagatataaaaggaggaccttgtccaccaaaagaggggacgactctcagtaggcttgaactctaggagaagaagagcgagagtgctctccggagttgaggaacccttgtaacactcaaccataatcccaaacacaggagtagggtattacgcttctcagcggcccgaacatgtataattcgattgtgtgcaagctaactagtagccctaggggcggatacgtgatctctaagaggcgagctccttcctccggtcgaactcacgaaagggggggggggtctcacgacctcccgctatcgagggacttccctcgacatcaacaattttaaaaaagagagactttgtttaaataagtaataaagggagtgataagaactactccctctgctctattataagtgcagccatagttttccgcgcctaattttgattatttgtcttatttgaaaaaaaataaaaacatacttcctctgtttcacattataagactttctagcattgcccacattcatatagatgtgaaacggaaggagtaagtcacaagcaaagtattattcatgttttatcatctcataacaacaaaaatactaattataaaaaaaattaaattagatggacgattaaagttaagcacgtaaacttatggttgtatttaaaatgggagggagtgagtattagattgtcattcaggaggaaaaaaatgactgaagtactcgaaaattccagtcacatagtaaaagctgggcactcctttttctttctttattcacacaaacggtttgtccaaccaaaccaaattagtaaattacaatagggcaccctatctattggttcaatttaggactaccagagaggttccagaggggaaaaggagtagggcgtgaaggcagtgatggacttctgaaggtggccgcaatcatccattaagtggatagcgatggatcgtcaagggtcagctcggttaggctgattatcatttggacgtattcgtaagaagctagctaggagtacggtttaggtggtctttttactctaaaattttcatttacgacgatagatccaattatccaaacataattcccataccattctatcatattatataaaataattttcgtttcatcatacattagcataagaaaacgaatccctttatttcttccttctcataaatcgatccctatatgctccaaatagacgatatattcgctcagctcaaattcaaatgaattaacttagcaaagtgagtgtaactcttgattaaatttcttatgatagatccaacacacatatgttcaagttctagacttagacacgggttctcacatagaggtaagtgcgagcaccttataatcgtctccgtttatactgtgtttaaaaaagaacccaactcagctcagctcacaagagaccctctttgatttacagttgaagtgctcaaacgattgaaggacgaggaagatcagtgctcaggtagtcatcgttaagagaagaagaatcacgtcaaaacaatttagtagagattagagacagatttaacaacggaaaatccgagcgtctaagcacacaaatgacagatttaagtagggaccagtaatgaacgacaaatcaagagtaaggagctaataatgtatttttgagattatgggaacgtagatgacacatacgaacaaaatatacatcgaatttccagctgcccgcatgcttgcacctcatgcgcaccatgtgtgttaaaattacaaactcaattcagatacagagtacaaggaattggcataatttacaggagtgatctacgtcaaaatataacaaaaaagaagctatctacctgctgactaaaacgaaccaccatatttcccaacaaaatgttacatatacaacctttctcgtaagcacaaaattgcccgtcgcaatgtagaagcaaaaagggaaaatttaccagcaaaactctataattctatgcaataaaaataatataagggaggattacaccactcatcgttacgttagacgttgcagtcctagttccgaggcaatgagtctgagcagaacctgtacaagctcccgtaccctagcttctttgatgcattgggatatatagaacttcagtataacttcattagcaataaaaagttggtactataataaactgaagccaatttttaagaaaaaaaaaaacaccaccaactgctttagccgtgcagcaaaaaaaaaaaagttgggaactatacccagattgtcaaatccctaacaccgatacttatttttctctatagagcttcagggcatgtccatctgttaatatttatattttgctgtgtcgtgtatactataacagacagaataaacctgaagccatttccataggttattcttgtcttgttcaaatttcaatgcaaagtgtaaactgaaaaggacaatccaatttttggcttccatgttaacaccatcctaatgttgaatggaaaagaaaaacacaaatggcttactcagcaaacataaacatgcattgccagcacataaagctgtcggctatgacacagagttgtactgtaaaattgcatgcgcacttaagaactgtggggatacaaaacctttttcttaccttgagacaacaagctcagaaaaggttggtagcaaagccaataaatgagcccgtccatgggactcattcttctctaaagcttcttttagatataatggcatgctgagggcattagctgtttccatgtttattattagtctagcgagttcttgtagaacacaaattgtctcatcaatccttacactaggcaatggtccttctcctgcagcatatttgaaatatcaattaccatgttgaaaggaaaccagaaaatgaagcaggtttacatattatatataaggaagttcaaaattatatcattatccatttacctagatcattttcatcagctaaaaactgacccagtataatctcacaccgcttcgtaagaactgagatcgatactttgctggtttctgatactgtagcacataagcttgtccccgatgtacaactgcaatcattgaaacaagctatactattcagttctaaatgtatgcagagtgtagcggaggttaacgttctgatgagttgctagtcttgtgggtctatggactatcctatgttatcatgtaatgtgtgaattctcaaacatgggcaatgtttccaattatttttaagataatctgcaaatgcttttgaacactgacggatctggttttcacagtgaggagcaggtgcaatgcagcactggttatcacgtttgtcttttggggctatttttgtcagatttggtaagtattaaatactatttgctgaaaaagttgcaataaatattcaaacaaaatatgagtaaaaaacaaatttgcccatagtttaacagttaatggcccaaa

SEQ ID NO: 67617 - DNA, 7651 bp, Oryza sativa
tggatccccctgtgaatttctttcaagaagattagttcatattttcatactagctacaataagcatggtttagtttaattttagtcaacattcatatcatgatactggaagtggaactggtcttactactttttttttgtggggggaagtcttaatacttattataccaatattaagctggaagtttatttcgttctttttattcagaaaaaagaatacatcatttcatctccataacaggtcatggtgccattcaattacacccaatacattgatgatgtgacatctcttgttaagaagggtattatcaatatgagcagaattgatgatgctgtcaggcgtatccttcgagtcaaatttataatgggcctattcgagaaccctttagctgatcttagcttcgcagatcagcttggaaagaaggttgataactacaacatgctgtatactccacagagtaaatttcacaaaactacaaatactttggttaaattatcacaaaaccatagatttaaagtgatgtaacacagaactacatatttaacaataaatttatcacacaactataagtttaaggctaagtatcgcaaaactacagatttaataataaaattattatcacaaaactacaaattttggggtttaaatccttagcactaatgttatgttggacttataattgttttaaattttgtgattaaattatcattaaacctgtagttttgtgataactttgttactaaatctgtagttttgtgatattctaccttaaatttgtagttttgtgataaatttagtgttaaatctgtagttttgtgatgtatcaagttaaatctgtagttttctgataatttgatcaaagtatctgtagtttcgtgaaaattactctacacaattgacaagtttggaaatcatccaagtaaatgagtaactaatttaacaggagcacagagatttggctagagaagccgtcaggaaatcacttgttctattaaaaaacggcaactctcccaatcaacaattcctgcctctaccaaagaaagctagaagtatccttgtagctggaagccatgctagcaatttgggctaccaatgtggcgggtggtcaattgaatggatcggaggtagtggagatattactgtaggtatgtgttttttctatatatcatatattcttttcttttaaaacgaataaatctactatttcaggttcttatttgctaaattcaactatacttaagaaaagctattttgattttttttccttactgtaataattaaatgcatttattctgttcaggtacaacaattcttgaggccataaagtccactgtcgctgattcaacacatgttgtctactctgagaaccctgatgaaagcttcatgaaaaacaatgacttctcattcgctattgttgttgttggtgagcgaacatatgctgaaacaacaggtgatgacccagaactcaccatcctagaccctggtacagacacaatccgaacagtgtgttccacagctaagtgtgcagtggttatcatctctggtcggcctgttgtcattgaaccatatcttccaatgatggaagcgctcgtcgcagcttggcttcctggaacagaaggtcagggtgttgcggatgtactgtttggggactatggcttcaccgggaagctcccacgcacttggttcaagtctgttgaccagctgcccatgaatgttggtgacctacactatgatccactcttcccttttggttttggtttgacaataaattcatcgcagccagggtaagtaatttcatcaatcatccacactaatgcagctcaaaatctaatcctaaaaatctgaaaggcacactagttcgaatcaatgctttgtggtttgaccttcatattgtttcatgttttcaggttctctggtgctgacagactgagagataggaatggggggatgatatacgttgtgttgagtttggtactgtcagtaatactgatgcatgcttcgggcataggtatattttaactcgagttgccctttcctagtcgtagtatggttccacatcaagtgctccatgcctccatcgttatacgttgtatgtactagctctatggagattttttgattgcaaagatgcatttatccctaaagctaggtgggtcagtgggtgataagcagatttgttctttcacggttttaccaaattatgtgtggttataatagagcatttttatctagggaggacaaagtagatggattatgctctgcaaatactgatgggcctacagcacttctttactctccgtaccatgtgacactccacagaaagtaaaggaatattaaaatgtgggtaagaaattgatgggtttgaatcatactccctccgtttcctaatgtaagtcattctagcatttttcacatttatattgttattaatgaatctagacatatatatctatctagattcattaacatcaatatgaatgtagaaaaatgctagaatgacttacattgtgaatatatatctatctagaatagtttgttgcattatgatattcacattgcaaatgcccttaaacaccgtaataataagttaacaaccacaactaagacatggcctaggctcaccacccttggccatataggcgaaggggcaaaggaagggcccctctggctggccatgcagcacggccgtgcaccacaacgtcacaggcagccggccgcagcaatcctccatcctcacctccacctccagcgacacgcgctcgcgccgccgccgctggctctccatgcgctcgtacagctcgccgggtatccccaccccgtcgctggtcgccacgatcggcacggagccgaccgcctgccccggcacgcagaacccgcccgggaggtcggcgtgcgcgagctgcacgccagcgtacgacaccgccgcgctggcccggccggcgcagaacgcgcggcgcgtggcctcgttgtcgacgcggagggtgagttgaagacgggcgccgctgccgccgcgccggccctctcgagcccctcgatgccgggcaccttcacccagaagtcgggcttccggtagccgtacatgctgttccactgcccgtacgctatgagcgataagagagtcgcgatgaaggtcgctagtagaaagtatcgtagacatgggcgcctgtccaggcaattgccgtggtcgtcgtcatcttccgccatgtcggcgcccatgactctaaccgctaaaacgatgcggcgagaaattaacagtatcaggaccggacctggataggcacgtacacctgtacgttacttataaaagactggtcgtaactcgtaacggaaaaggtaagactggtcgtacccagacttcgggcctccggtagccgtactcccgcgcagcgtcgtcgtggccggcctcgtggatagcagcagggcagcacagttggccccagcaaacccagtgtccacaggaggcaagctcgcgaggagcgacgactaccacaggcgcttcttgttcgcgcggatcggcgccctcgacagcatggtacgtcgctgccgccgctgcttcgactggtcttgatcgccatgagcccatgagctgccatgcatgcatgctttaatactagctagttacgttcgacaagatctccaatggatcaaatataatagggtcgttgaatccaatcacaaaacggcaacactaccgaacgtgatcaccatgtcccacagagtcttataagtaacgtaccaaatccaggacaggtcctgacttttttctcgctgcatcctagtacgtcttagcggctagatcatgggcgccggcatagcgttagatgacgacggccacggcgattgcctggacaggcgcccatgtctacggtactttctactcgcgaccttcctcgccactctcttattatcgctcatggcgtacgggcagtggaacagcatgttccgcgaccacgacctcgacgccttctccgtgcgcctcgccggctacgagggcatcgacctgggcaggccggccgccacggtgtcgccggagttcagggtgacgctcgggacggcgaacggcgcgtgcgtggaccgcgcggccgtgaccgtgctgtactcgggcgtggcgctgggttgggcgcgcgcggagccgcgcgactgcgcggcggggcgcttggagagggacgtggaggtggtggcgcggggccagggagtggggctgtcggatcgcctccgcgcgcgcatggcgtcggaatggcggcgctcgtcgatcgggcgcgctggagctcgacgtcgacgtgaagatcttcgacgaggacacctacccggtgcacgctacctaccacatccctgacagggtgatgctgtgtaaggtgaggacggatgggcgagggtcggagtcgccgtcttgcccttggttttcgccgataactttagctttcgcatagaaattagtaggcacactgcaaactgattaattaatattagtagattgtatatttgtactactgttgtttgtgtacaaagtccatatattaagattggtagattgtgcatttgtactattttttttaacaaagtccgcatatgttttttttccataaaagaaagttacaaagcgagacgcttatatatgtgtgcacatttaccactatgaacaccttcaatcaccacatacatctggttcttgacaggtactgtatgtctttaatcactaaaaagataatttaaccataaatatgagtaacccatgtcagattttaaacctgaatttttaccattatctaaaaaagattttaaacttgaacttggattctcaagtggacatatttttaaaaatacacagtatgaatgcagacgttcataatgtggatatattcatcctatgaatgcacgcaagcacatttacccgtacagacgcacaccttacctatgtgagtatctcttaccatatatatcgaccatacattcatgcttattttacgtagtttaaatatgttgttggtaaaattccacaaaattgcgttgatgtatcggaatttcttctatcttttttttccctcgtacaactggaatactcggttgagtttttcttctttttgcgagatacttgctaatttgcaccatacaatcaccaaattatttcgatttatttatacacgtttgatgagtttggagaaagcgagcatcagaccgttgggcctcacctttttcttatgctggctcatcagccaaaattgaaattttcactattagggcccgtttagttcccaaaaagtttttccaaaaacatcacatcgaatctttagacacatacatggagtattaaatataaataaaaagaaaatctaattgcacagttataggggaaataacgagacgaatcttttgagcctaattagtctgtgattatccataagtgatacagtaacccacatgtgctaatgacggcttaattaggctcaaaagattcgtctcgcggtttcccgacgagttctgaaattagttttttcattcgtgtccgaaaacccctttcgacatccggtcaaacgtccgatgtgacacacaaaaattttcttttcccaactaaatacacccttaattttggagttgattttggggttttttcatcgaaatttatttttcagtatttgtttttaaattgttaagaacatgtatacaagttatatttataaattattttttgtttgcaaatatatcatttcatttattccctaaaagatgcgtgagatgtttgtgattgcgtgtgttcggcatgcacgccacgccacaccggtcacatgaaactagacaccagcccacatgagtgcatgacccaaatagtgttacagtgagaccgaaggacaacgccggattactactctcactagctgatgacgtgaaagttgaaagtactcccttcgtccaaaaaaacacgatttcatcacacctggaattcgaggtgaacctcggtacacacctcaccgcgccacggcgtgagctttcaacctcagctatatagaagtagtactccagtaattgacattgtgttgcttcctccgcaatcgcttcaaacagttgttgccacagacctactccctacgtctcataaaaaactaacttagtgttgtccagattcgttgtactattatgtatcacacgatcatctccaattctagattcttttttttttggacggaggaagtacggcggttgaaaccgatctttatcatttctctcctttcaaatcacccacgtggtcagtgtatgtgatgcggtgtcaaatcctattagagcaagtttaacagtatagccaactactagctccaactcatctatagccaatctaatagctcatttatacaatagttatatactacagtattaatacatggtcccatctatcatacacacattgcttcttggagtccgtgttacagctggctataaatctgtagcccgctgctcttctctctccttatttatctccttaaaatatgtctgcagctggcttatagcctgctattgtacctgctcttagagcaagtttaatagaatagcccactggtagctccaaatcatctatagccaatgtaatagtcaattcatacaataggtgcttaccatactattaatatatggtcctacctatcatacgcacgttacgtcttagagtccgtactgcagctggctacgatctgtagcccgctgctattgtacctactctaatgaaccacctccttttacgtgtttggagggagagttcactctccctaccgaggacagccttaaaacaaaagcaaaccaaacaaatttacctcacattaatccctggaatttctatttctactttaaatccagccatcacatcgatccgcactaagagcaagtttaatagtgtagctaactgttggctccaaatcatctatagctaatctaatagcccatttatacaatagttagctataaaaatatactataccattaatactcggttccacctctcatacacatataacgtcttggagtccgtgttacagccggctacaaatctgtaacccgctttcttctccctcttctctttttttctcaatatgtggttatagctggcttactgttgtactatacctttgctttgtgaattgtgaggtgcggccgcgccgatggaaacgtgtgtgtccgtctcgagcccctcgaggcctcgatgtcggggtaccttcacggcttcacccagaactcaggactttggttagtaaaacgccatggcacaagaaactctggacgccttggtaagttggtcccgactctgattggtacacacgttacttgtagcacgtcttgaggtatatggttgcggtaatcatatatcgcaaggggaaggatttccatacatggatggaatcaaattgttgttcgatcgatcggaagttcggaactaatcacggaatcgaatataaaaccggctaaatagaccctaattttcttggactctactataaaatctccagtcgaacgtaaacctggtagcattgttgaacgtgctaattgcatgctaatcatggctcatggggaagacctcgacctccaagctgcggaggccgcggcgccataccatgctctccagggcgatctgcgcgaacacgacgaggcgtctggccgtcgttgctcc

SEQ ID NO: 67618 - DNA, 1770 bp, Oryza sativa
agctctcctccaatggaagctccaggcgtcgaagacgctctgctgcctctttctgccttcgcctacatttgtgagagaagaaggggagagaaagatagaaagagaggaggagggagatagaagagaggaggttagggagaagaggagatgggacgaaaatcgctaatatgtgtatcccacgtgctgacttagcaagtcaatcgtagttaaactgccacattagcagaaaatcgcttctaaaacatcaaaggagtagatttgcactggaggcgttatatcctggttttgccattaaggggggcagttcagccaggggcaatacgtcatggaggtaaaatagacttattcatgtccaaataaaattgagggctggagagattcctcagtaaataggcccattatctcatacaactagctgatctggactaaataggcccattctcttgacagcccaaaaatgcttttccttctgtttcgagatacttttgggcttactccggaggccctgatgatttgggctaatccaagagtacgaagaatatctactgctgtactgtctgcagcaaagaacaataggatactacggtgccaaataatgttgaccgattagggctcctctagaacgcctaaattttatacgattttcatcgaaatgaatctgattcccgtaagtcctttgaaaattggaatttcattcgttccatgcaaggccttaccctggtttctacctaattaagcatctgattattactagtagtattagcctaaccaagtcttattgagactattacacgcttgcatgcatgtcacaggctcacatctccggcttcagattcatgcagtgataagcaaattgaactttttaaattaattattgcttgctgaaagatcaaagatgcgtgtacgttgggtatctgacgaggtaggcaggcaggcaggcaggcaggcaggcaaggggtggctggctaatttgcttgatgcttagctacgcgtgcagatatttctcatccttaatttaattacttggcaaaggcacctcataaaaaggttaatttgcgtgtaaaccgctcttaattagcaggaaattcacaaagcttttgcgtatatacttgacttagctttagctaagatcatgactgtttgcttttgggtgacgtacacaccaacaccgtcacccaccccttcactctactttaatatcttatctccctctcactaacatatagtccactccaattatacattttttttcttacatacacgagcactttgcacatacatgtgtatacatcattaattatatatggtttgtatatattgcagatataattaattaattacaagaggtttatgaaaaatcaagattcattaagctggaaaaaagggatggtatatatgttatttatacatgaaagataatgaccaaaaatacttacagggtaattaaagtgcagtaacaagcgagcaaacaagagaatttgctactacagaggagatgaattaacagctgtaataaaaggaaaaaaagtattaattacatttagatccagacatttctgtcaaggccctccactttaactaaccttctcatcccagtccacccctctcggctcagtacactaccaagctgtgttgttattcaccgatgtatttttgcagccaaccccctctccttgactgaaattacgtacgtaacgtgggctgtgtatctactcaactacatggacaggattgagctagcggcggcggcggcggcggccatggccggcg

SEQ ID NO: 67619 - DNA, 18192 bp, Oryza sativa
cgatgctatataaccaattctgccttatattttcctctctttgagaggatcaaatttccatattactattataagatgatagtctacttttcctttttgaaaaagtgtttttttcctgtgtgattttgatgtagcgttgactgctttatgatgtagtcatctgccgttattcaaagatatctactacactcttatgcgcatgcacaatccaagtgctccatccgttttaggacatgaaatatgcacttgagttagccaacgcatagtttacttatccacatcccactgatcaatgaaataccctccttgttttcgactcatctagaattccatgtgatattttgttgctaggcaccgtaccaaaaaaaatattcatttttggttgaatagaagagagaaatagtgtaaaaggtcataaataccccttgcccttcaagtcagggtccacatctcccatctcctatctctctttctgctatctcttaggaaaccggtggcgcacgcgagctggccggcaaacgaaggtgtagttggcaacgcggcgctgtactgatccatcccttgccttcccgatcctgcttgaccttgctgccccaacgtggtccctcttatgaaatcaaagtgtgttttgattaatattttgtgataaacaattggcatataagataattggttttgatatttggaaatcatcggcgaagtggagctcactgactctgtggacctgtcagaccaggtggactaggctagtcagaccgacgtgtgttacacggttagaccggccaacccaatggtctgaccagtcaactctgtgtcggtgtcgattttgggttatttatttggatactcgtgcattaattattgtctctctagcaatgtttctttatactgtgcataatactgttgtttgttcaagttaagtcaagttgggaaagaacttatgctcggatatgatttcttgtttgagtgttgccggtgatagatcgagtctactttggagaatatgatgtctggacgatcagaatatcatgctggattcttaggctaaagaacaattcatgtgtttgatagagattccatgaggcatacgacagaacattgtatgcatatgggatgaggagtcaaatttggaaggagtccaaatttgggaagtttggaattcgaattgtgatgagataagtttgtttcttgtacagaaaggttttcttgttgattagaatttcttgtacaagttaaattcatggctttagactgcttacctcaggtataaatagagagggggttgagtcctcttggtattattttctgtgagttgagtttagggtaaagttagggttttgagtttagtcgaattgtgtgagaggtgtgcttttgttccactttgtaaacacgaatagaagtaataaaattcaatctacttttaagatatttcaatttgtgtttgatcgggtacaacggtcatatcggcgaattagcgacggtcagaccggtggcttcatgatggttagaccagcgatgtttcagcggttagactagtggtggtgacagacggctgtggcttgattgcgcgatcagactgatgcatccacaccggtcagaccgcaacatatgtactgttagaccggcgttgaacctttggtcagaccgatctccatcaaatctcgagggtaacttttattttcgctaaaagtttttagtttttggtgttgctaccatttaccctcctggtaggcttagttcttattgttcgaccatacacctctcaccgatcccatgctcgccatagctccacaacctcgtcaatttttcatcgctgtcgcggtctatggccacatctgcgtcctctttgtggctccggcctcgacccctcaccctctactgcggttccagatcgatccacctggtgtagaggccggccgccctccaagggctgcacatgctgtgaccccttggcgtggtagtctccatgttgctccttagattcgagggaaagggatcctaacggatttcatggtgatcactatcaccgacatcctagaaccagcagggaccgcttcttgtgggtgcagcgtggcccgcttgagaacaaccatggctcgacagctcagctgctatcacaggcacacatatggcaacctttgagaagttgtgctcgagatgaaacgaattggaagggggcattttagacatttcatggtgttctctctccttacatggctgaaatgaatgaaatagtagggggcagtgtctactatcaaatatccaatttaattagttttttttccaaacttgattttgcgatgttctacaaataatttcacaaagtgatgatgtcatctaacaaaatttgcctttttaagaaaatagcaatataataccctttattctttacacacctactctaacctttttcttcttgggactatatggttgttttcgctatttcggaaaggactcgatcatggttatcttggccatttccacgaaaactgacttactatatgaccccatgagttcggctcgaacaggacaaggctgctatggcgatgatatggagtgaacctctattattctccccaatctgctgaaactgggttgccgatagaagcattgtattcgacactagcttcgagactgaaaaacagtccatgcagaaggagttctgaactctgaagagtggctatatgaaacggctagtctttcagatcaagggtggatatatataggacacggatactgtgccttggtcattactattgcagagaattccttatgtgtattttatcagatttgagccactcatccaagaatggacgggaaagacaactcccaactgttgattcttcttcccaattttccacaacccaaaagaagagagaaagaaagggataaattgtgatttattttaaactgaaagaactatgcagtgcacgtaagtgcttcacaactagtattaatgcagaggatttgcatccctatattgtagtcttcagctcttccagttcattcccactgtccattgttagaagaagcaatgcaaacatcattcctgatgtctcctaaccctagatttggcttgtcctaacactcctgtatcattctcgtgattggtctcatactcttataacagcatcgtcctgtatatcttaaaggtgtggagggtggaagtaggagatcagagatctctccatagggagctgtcgaacaaaaaaataagatatatctgcacttctctcagccttttatttgccctttaggttgctgttaccagatggtttctcttctgatatactcctacttctgttaagaacaatgctttaattgatatgcgaacctatctctaccttcatttcattaatacagtcccaacaatgcttgatcttcccaaaataatgatgacagacaccttttgtataccaatattatttttatttcttttagaaggttgatttgcaatattactattgtataacataataatatgttttttttcctcttttaaaaagtatgtttctgtttctcaaaaaaagtatttttctgattgattttgagagagtgttgactgctctaagatatattcatctggggttaagttgttaaacatgcctactacaacgaattaggtcatgaaaaatactccatgtatccgaaaatatagctaccttagtagtgcgaatttccaaacgtggttctaaaacgtagctacattttagaatggaggggatagtttaccagaaatttgtgaaagtaaattagcaggcctaggcccgcaagaggcagaaaaagaagttgaagagaaagactacttttgactcctacggtttatggatactcttttgtgcacgctctgtccatatgctctgttttaggatgtgaaatacttgtgttatcaaaaacgtattttacttatcttctccttgtttcggactcagctataattctgtgtaacataaagatctccatcgagagtttgctatacccacatgtgagaattgtaaggtcgtgacatgagatctgcacacgatgcattgtgatgcacatgtgtatggtgacatggggtttatctgttgacaaaatattttggtatggagcacacatgaactacgaaatgataaaccgtccctacatattccttttttaagataatagaagtttttattaaactcggtcaattagcccacatagtgtcgtaatacttctactgtaatttattgaattggtgatctacgtacattaggttgtcagttatgtatatatggttgttaacacatggaaattcgactgttttcttgttctggtcaagatatttttagcaccttatcataacaaatattgtgtgaaccactcaacttctttgcgctagttgaccagcgaagtcaagccagatcatagagcaaatgcagcaatcaaagactaggttaaaaaatactaaatctgaagatgctacagaaaagaaatacgtggagcatcagtcctagaggtttttgttcctatgcagagcacatgcatcatttcaccttcaacactgagatccatccatggtagcggagcactgaaccctataggtcttgcaatcagggtttgaaatttcgtttcaaaatttccgaaatttcgcccccccaaccagcaagcttatatctcgcctgaattttgggtttttttttccaaatttttatgaatctggtcaaattttattcaaattcattcaaaatcagttaaaatttcaaataatttcggccaaaaaagttcaaaatttccgaaatttcggtctcgccccccccccccccccccaaagcagaaatagcaatttcgagatttaaaaccctgcttgcaatgaagagattttcgactggacatgcctacgttttcagctcttctgttgtgctctgatcatcccaggtcaaacgatgcagcgctagaatcattccggatatctcctaaccctagatatgtagatttgtctgtagagtacgtatagaaggttttaagaaaatgagatatatcctcatctccatggagagctagcttttgaaactaagatacacacgcagacacgctcttctcaacctttaatgtgttacagagtgattcttcatttcatactctttaatatatgagaacatatctctaccttcattaataccagcaatgcctatcttccaaaaaaaatgctgctggacacgttttacgtgtttgttttcattttgagaatatcaatttctgttgtaatatgatactgtactctttattttttagatgtgttttttagggataaagaatattgattgctttgtgaataataatctgaggccaggcaaaagggctttaagaaaataactacaaacaaatatattttaaataatagatagaaatccgacttctaattactagtacaaagcaaatttgactagggaccaaccaatgacagcgtttgaaacaataaaatagagaggaaagatttctcgatcttcacacacacgtttcccgagccactgaacgtcttttgaaaaaaataggagagttttttaataaattatattaatctatttttaaatttaaaataattaactcttaattaatcatatgtcaatggttcatctcgttttacttttgggagttttgaacctcaccggtttgtttatgtacactaaaatccacacgatagaaaggaggaagtttccagtatctcacccttataaactgcaaccaatacaacgaggataatttcattcttgtccttactttcatgtttatttttggttttgccctgttttttttcatttttacctttgttttttctaaaggaagccaaattatgcctctactttggataaacaggccaacgatgtcaaagttattggtgaaaggacatctatatccttacttccggttgcacaattatctctctacttttttcattaattgtgttttttcctccatgtcgtacatgcatattgcaatttgatttttacgacgatgtttaaaattaaatgatttttgactaactttaatgaatataacaattttgatagaatatcaataaaattttgtgacaaatttgacacgattttgtcacaggtttgatatcattttgacataatttggacagaattttgacagcattttcacatctttttacgcaactagcagttgtcacagctcttcctgtgcaacctgctcgctaccgagccaagccattagccgcagggtcaccgccatggcaacctgtacagttcattgccatgatggccaggtccccgtcgcctcgccgggtggctaatcaccgcggcaacatgtggcggattagaactatccctcgtcgaaagatagaatgctagcttcattcctgatggctcctattcctaactggagttggctttattcactactagagattactcatcttttatctagtgccccagatcataaaaatatcggatgtatcaataaccggtactaaaaactctttaataccggttctaaaaacccaagtcccaaaaaatatctaaagatcaccggttggtgaccgggactaaagattgtcccagttcgtgttatcaaccgacactaaaaatgtatttttagtatcggttggtgttaccaatcggtgctaaaaatgtctctagtgttagtttaaaaagaatgcatcactatccatccaagttagatgtgtgtagtaggtgtgatggtagcacgtgtaagggttgtggtgagagattttgagtttaaatcccctcacatcccacattttttttacttagtatataaatttagtaccggtttcttcaaccggtacttaaaaaaaatcaagtactctcgattccctacatcaaacattaataggggttgagaaccgatacatgagatcatatctgtccaagtgatcattgtcatgatttgtcgtatacacacttataatataggttgtgtatatatacctttaaggtttggaggttggtagtttgaaaaaaaaaataagatctccatgcatagagacctaatgaaaataagatatatggacactcttctcagacttttatatgtcctctatgttgttgttattacggaagacttctttgtcttctcgtacttgaaactttttatgggtgcattaaagaattcaaaattttaagatatcattttagaagtgatgagtaaagaaaattaattaacaacgtggttttgtgaaactcaagttccataatactaatacacaaggtcatgtgcaatataggactataatatctgggttacatgaaattcactctgtattttacataaattctagtaattcttttttcttgtttgtttacaaactttcgttatccaaattttcctcttggaccatatagttgtttttggctatttcgaaaaggatcgaagcacggtaatcttagccatttccaagaaaactgacttgcgtacttgatatactttgacggattcagctcgaacaacacaaggctgtaacagcgatgacatagaacgagcctatgtttctatccaccattctgctacaacttcaattccagatagcagcattgtacgtagttgacgacacttcgacgtgtgtctttcatattcttctttttatttgtagtggatgtcttacatggctaaaacctatacatgtttggcacaagcgctatcgatcttggctatgtataccaatttacagaataaagaccgaatttctatctattattagaaaaacaaatgacaccgatttcgtgaacggagaactagggcaattggcacagctgaaactgattacacagtatgtgccaattgccgttcttcagttctccgtttacacatattctcatgcagctgaaactaatttacacaggatggcaatatacacaggatgtgttagctgtatgatcatctcgatcgcatacctaattagtagtaggatggagtattcagttagcattcgactctgattcgaccacttcaacgggaacacatagatacataaccactacctgtagagcacaactgcttctgaaattgtatccactaacctaccttttttgtatatatagaatacctacagaatacttgtgtacggccaggtacatcacagaatgtcaggatcacgcctaccaaactgtggttatgcacaataacagcagatgcaggcatgcagctggagtgagtcataaaaaaataattaaaaaaacttcattgaacataaacatatatactcaacaacaccttgctattattatcagaagattcttttataatgtgctcataaaaataaaacccgggtatctacaaaattcattttttttaagtagagtgtaatatttagagatgctcccaataggattagtttcgttacgttgtatagacttgtagctttatcaccatggttcttaaaatgaaacgataaccgctcgattatcgtaattactccctccgtcccaaaaaaagataaaccctgagtttccgtgtccaatgtttgaccgtccgtcttatttaaaaaaattatgaaaaaaattaaaaagacaagtcacgcataaagtattaataatgttttatcatgtaacaacaatgaaaatactaattataaaaaaatttcatataatacggatagtcaaacgttggacacggaaactcagggtttgtcttttttttagacagagggagtatgccggttcatatacggtaactgttcaataaacatgctagctagctaagatttttttaaaaaactcagaataaacctgaagtttctgtcgataaccactctgttactgcaatattcaactagtagtgctaaccaaattatcaacccatgttaatttaccttgagaactatggggcggttagttagctgcaagctatctatgtgcttattgtggacacggtgatgcgcagggaatgatctgcctacatattcttgttcatactgtcacaaaataccattaggccccatttggatccctggaatttcgaggaatggatttcttttctattcctaatagagttaaacaaaacatggcagtcaaaccgataaagcgtctttgatagaatctgtagtttataaggcaaacatgtttaatctagaccattttttagggaaaatctagaccaattttggtattgtaattcacttggttttgcaactccattttaactctcttttaatttactttgaattcccaagcactcgtggagggttgatttgttgaggctaagatcccaatacctctcaatcctataaactgcactcacagaaggtatctttgcatgagtcctactggggtaggtatctgatcaagcaaatgcctatacaagagtttggcctgaacatcatggccatatatatggggattggatgctagcagccacagcaacaaaggtggcactcacagtacaaagagttcaataacaagccaatatattaacataccattgcagtgtgtcaatgttttctttccattgatatttgattctcgtattcttttgtcagccttttattgaatgcccatgtggcattttgagacaaccttcatgtggaagttaattcttacttatgcattctcatttagagaaagtttaatacaataggctaggctgtgttctttattttcccctctttctcaactcacttccctcgttttccgcgcatacacttttcaaactgttaaacggtgtatttttggtaaaagttttctatatgaaagttgcttttaaaaaaatcatattaatctctttttcaagttttttaggctaatacttaattaatctcactataattgcgtgctttattttccgtgttaggaggtaaggttcccaaccttgcctcccgaatacaacctaaaagtacatgccaagtcatctgaagataactccatatatagatgtaatatacaataagtagttcctaacccaacaaacaggatatgcgatttattattaatatatttctcagctaattttctctcggcctcttctatcccttcttcctttacaacattgtccatcaaaaactcaccacccaaagtaccccagcttgcttgccaatcaccaccagcaatgtaagtacttctcaaaccggccatcgaacttgagcaaactggccgtcgaacttacaacgtttgggcggatggaggctctcttctgatcactgttcaacgaaacaagagtatagttggggctaagttcccgatacctcttaatcctataaattgtaccatcaccatgcaattgcagttgatagctagatgactatgcaaatgcttttgcaagagtttggcctgaacatcttggatatatatataggagctgggtgcgttgtcatcacaacaagtacgaagagttcaatttaggaacctacagtagccataggtgtcaaattaagctggctttgaatttgtcatttgattattttggtatataatttgatagcttttttaatttttgaattaatccgtgtgtgcatgtatggcattttgagacaatattcacatggaagttaattcttacgtatgcattctcacttagaggcagagcaagttcagctataacaataagcaaaaatcgtctgaagataaagaagaaatataatttacaaatatatttatcagctaattatatctaatagatgcatatatataatgacatgcatgtacctatgctgccaatgcctgtgaggtcagtgcacagatatctagtactatataggaaagttgttctagaaaatcagattaatctatcttataattttttattaacacttaattaatcatatgctaataagctaccttgtttttcatacaggaaaaatgggttacgaacccacatgttcgagcacgacctatcttcatacgcccattctaactgactctggagcagcgcatggcagctaacttgtggcccgtacactgctcctgagaattgtgaggtcttgacatgaaatttgttgaagcaaagaccgagtttacccattatctttaaaaagttaaaatataaatggtacgttgtgatgcttatgtatataaagacatgcagtttaatttatgtgtaggcaagcaattgtgttcattggataaaaatgtgagttacacaatgatcagcaccctgcattcctggaaacactgcatagtgttgcaataccactagtgtaatttgccaaattggcatgatcaatgtcaggtcacaatttggaagcttaagatgccgcttaagattaagatcttcatgtggtacttacttaaaggggttatgttaacaaagacaatttagcaagacggaattagaatggtagtttaagatgttgtttttgtatgaaaaatgagaatattcaacatcttttcatagattgccattatgcaaagtttatatggagaggaatacaatattcttttggtctatgcccttctagtagtatatcacatatttttgatggttggcttttgggggtggacaagaaaaggagtaagcttatacttgtgggagcctctgcaatatgttcgactctgtggttgagcaggaatgatttggtttttgacaaatcaccatctattacatatatgcagggaattttcagggcaacatattggctccggtgttgggcttagctacaaaggtgtgatgaagatgacaagtttatgaaggttgcatgccgtaggcttgagacgacagttatgcaactttttgccaattatggttggagattcacaaatagacttcaataacatgttctccttattttagatgggttattttttatttaaagtgtgtgttctcaatgttttgttgaactacactatttttttagtgtaacttgtaataattggctgtagctcgttttgagcaaagaccgggatattttattccattatctaaaaaaatttatccccgcaaaaaaaatgtcaggtcacttgtggcaccatgaggtcaccctagctcatcactacacttgctgatccgagtgccccacaactacaagccagtaaaattggagaagattggtgacttggtgacagatgaccatggttttcaattttgattttgtcctaaattttgctcattttggttctcccgaaagttcagaattttcggcatattttggatcgaccttttttgaaattttagcataatttagctgaatttgactaaattttgaccaaatttgtaaaagattgagaaaaaccaaaatttttagccgagataatcacttgctagggggtccgaaattttgaaccgaaaacgcaatccctggagacgacctataatggtggaaatcggtcgagagaacgatttgcacaacagggttaccgaaaagcagtggacaaaaggaataaattgtgatttattttaaactgaacacaaattactaccaacaaaaccaagcgtttgagcataggagagcatcacaactactaatgcagatgatctgtgtgcctatgtgccatatttagctcttcaattgtattcacaccgtccaatatcagaagatgcaatgatagaatcattctatatgtctcctaaccctaataaaagctagtaaaactggagaagatttgtggcttttggtacgggtgaccttgaactgtggagaacggtcaatagaaaaacttgctcaacgaggttaccatgtgaatatcgttttatcttcttttgtgtgtttgctgctcctgtaaaggacttcttttaagtctcttctcctaatatgaaatggcagagctcctgcccgtttcctcgaaaaaaaatgatggttaacagaaaccaaggacttgagcataggattgcatcaaaactactaatgcagatgatctgtgtgcctacattgtcatgtgtagctcttcatttgtatccgcaccatctcatgtcagaaaatggaatactggcatcattccagatgtctcctaaccctatttagcttgtcatagcacttgtttgtcattctcattattggtcgcttattttcttataacagtatatggttgtcttaaggtgtggtgtggagggtgcaagcttttacaatatgagacattttgatgaaaataagatacatgcacactcttatcactcttttatgtgcccttcaagttttgcggtttccacccgatggtttcctctcttctaatgctttaatattaaaacctatctgtaccttcattaatacagtctgagcaatgcttcttgatcttccaaaaacaatgatgataggcacctttcttgtaccatttttttctttttgagattgttggttttcaatattactaataagatgataatatacttttcttcttttaaaaatatcttctctgaccgattctgaaagagtgttgactgctctgtgataatgtggtgttaaggtctctaagatacctacgataaaccacaactcgtgagttacaaggaacaatgcctaaagtctaattgagcttcctgagatagagcaaggagaaggaaggaaatagatcttcttctcgtagggtcgtaaaggggaaatagatcctctaacttactgccttcttataggattgtaaagggctttctcaccccaaaagctagctaatgaggtaagggactcccccctaataatattagatccattgcctcccacaatctatgggactatttaacaatctcccccttcacacattggtctctctcagtcgttcaccgccctttcaccgtacacgacggtccctcaggtatacaggccccgtaggcacccactgtctaacaagccttcatacactttgtccctcggattagagatgttgaactagccaggctttgataccaattatagtatcgtcaagagcctttctcacctcaaaagctagctaatgagatgaagagcttctccacttatatattaggtctcttatccttccacaattaatgtgggattattcaacacttctgactctaagtagctaacatatgagctccatagctcgttgatctacatgtcagcgacccatgtttgagaacaataggtcagatgagcctcatctgagaaggaaggttgtgtgctttagttaataccggctgattgagagatggaacaacgagagtgaattctctgacaaattggtgccaaaattttgagttccgtcaaacaaacttcagaaactacggttccgtgttgctctttataaaagcctttgttctttacacacaccttgtcgcctcctggacaaagtacatatggctgttttggctatttcgaaattactaaagcatggctatttttatcatttccacgaaaactaacttactaggtaccccttcatttcaaaatattgcaagcatttgattagatgagacctaatttagtactaaaaatcttaacatagatttgtttaaatttttaatattatgttgtgtctaatccattaatagcttacattttgaaaattcaatcggtttgaaaacgagacacagttgtgcttaattaggatggtaattaaaaggcctgatattttatcctacaaaatttaagggtagagtttaatatagggtgagctgactaggctgtggcggcgatgacacggaaagacacagctgtttgtgtgccaaattttttttatatacggacacacatttacattacagtattaaatatagactaataataaaataaattatagatttcgctggtaaactgcgagacgaaactattaagcctaattaatccgtcattagaaaatatttactgtaacaccacattgtcaaatcatggtgtaattaggcttaaaagattcgtctcgtaatttacatgaaaactgtggaattggtttttttccatatttaatgcttcatgtatgtgtccaaatatttgatgtaatggaaaagttgaaagtttgaaaaagaaagtttaaatctaaacacggcctgggtttattcccggagaagcattctactattcatcactagcttcgacgtctgtctttcatcttcccttttttagttgtacatcagacagatcagtggatgtcttccaggtttaaaagttaagtagtacgtgtttggctcaaacgccatcgattttgtcaaccaagatgacgtgctgcttcgacgacattagtttatcagaagatttagagaacgaaagaatggcaattggatttgcactgcttataaactaatcaatctcatgatgtgtaatctgtaggctcatctatcgcatattttattccaggtggtattttttactccagttctgccattacatgagatgcgataaaacctcggcaagaacagttggataaccgaaaactgcagaacacaattgcctccgaaactgcaatttacagattttacagtagtagtgaactgtcaggtacttgttccgttcaagaataaatgtagggatttcaagatttctatattttttgagtaaatatgaatgaaagttaaataagcatttgtaaattgtttagtaaatatgaaggttaaaccaaaagatttttttatgtcacttcagctgttaaaatttgaattttaaattgcttatattccttttctaagcatctgatcagttttagaatcatttgataagaatccataagccataaggaatctctatatcacgtacaaatttaaatcctacaaatccttatgttaacagagggaatatacatcacataggaatctctatattacgtacaaatttaaacccttatgttaacagagggagtatacatcacatgatcacaccaatcgaactgttgttatggacaatagcagcagatgcagagatgctgctggtgccaattcatttaaaaaagataaacacctttcattagaaaaaggaaagaacaaaaaaatatatatactcagccaacaacactctccagccatcaccacctcacataagtcacattagcaacacttgctgtggtgatcatatggttgggagcttgggggcagtagtaggagctacaagcaaaagctatacatatgtgtacattacaatgccccggttttctatcagcgccagattagtctcacgcccatgaaaaacagggcatgttgttgtgatatgagccaaaagctgctactactactctgtatgcgttgttgtgcaactatcttcaaacccatggcctctggttttcaggcccagattgcaagggatgacatggagagagcgccgaggaacagtgcaatgtatgccatcacctgctgccgtgtcgatcctgtcattttcccgccaaggaagtccgcggcgatgagatcaaccagcgacatgtatattaggatgccggccgacacggagtcgaggatgccctccaccactagagcccgtgggctattggcgttgtagaatgacgccacaccggcaccagctgcgatcccagctggtgttgtgatggcgaagaaacatgccattatagctgctgatagtgtcttgaattgtgcctgtggtcagaagatttgttagtgtgtaactaagttatactgatgagaaaggttttagaaccactaagatcatcaagaaaaataacaatgaagcaaaagtataaaaaaggtgctgtactcagcagatagacatctcacttaattttctgatagtacccacttgaatattattggcaaagtagttggccgttatgagaagcatagcagtctaatcaatttatttgcattgaccaattaagttttaagagaaaaaaattataatcccaaactattcataatattgaactcaaatggttcaattgtcatacatcaatacctttcaacttcgagagtattacaaagtggacaaatacaacaagaataatatttctgggaatatcaaagtccgattagggtcagaactcctgctgtcaacatcatggcatgctgccaacaattacgctattatgccggagataatattgattttccccacgaattaaaattctaaaaataaaagttcaacttcttacggttgctatggagagtgacagccaatttgaagcttggagacttagattacctagactacgagacatatagtcgtatggtaataccagagggacctaatagtaccaactaatttgtgaaccagattttttttatagcaaaattccaatcacaaatggtggtagtgaaaataacaggatagctaactgcctcaaacaaattcactgttctagaagccacattttatacatcatgaaagatgatttgctcagatggaaaatgacgtctatgtaaaagcctgcatccatactatcaactctatgttcgtcttaaggcttgcaagttgaatgtcccatgataactttttaaataaaaaggttaatcatttaacagtaaataccatctggacagaggtcaacttgctagtaaaaatatagttgttgcacaataattacaacaaactttaacaagatgagcatacgacatctgaatccaaatgtcacgccttcccgaaattcaaataggtggaccccatgtgccaaaaggccaatgccatatacatacaacaaacaaacaatcaaacaatccctgacaacaagaacataacatatagtcacatgtaaaattgttatgtataaactatactcaattggatttaccacggttaagcatcaattaaataatttcatcaatagaggaaaatatgtaaataatgagaattgatgcatgacgttctgctgaatttcctcacctgagcaatgcatccgccaagcgcgaacccctcaaagaactggtggaacgagagcgccgccaccaacggcctgatcgtgcaggggctccgtgacaccccgagcgacaatccgatgatcaccgagtgcgacacgatccccatctcaagtatctgcaagaaacaaattcatcagacatcatgcattgcgccaaaaaagcattaatgaactcagcctccaattcagagaacagatgaaacacctgcgacaccacgacggaccgcacttgcgccggcacctccccctcaccgccactgccctccggttgcgccaactcgtggccatgcccatgcccatgggggtggctgtgtgagtgcgagtgaggttgcagcagcggcgccttgttgtcgttgtcgtcctcggtgacggtgaccacggtgatgtcatcgtcgctagccgaggaggcggcgagcgcggcggcggcggcggccttgacgcgttccgtctcggccctgtgcttgccctcgtacaacctggtggcgaggaagtcgagcacgagtcggggcgagcgcggcgg

SEQ ID NO: 67620 - DNA, 2143 bp, Oryza sativa
gaacccaaaacctccgtgcttccatggagagcctcaaccactagtctatgcggcttgctgtgaaaccaatataacaaacatctatttgaacctgtttaaaccggcggtttgaccggtccgaccaataaacgaatgacccgagtgccttaccggtttgatcacctgtccggtcttaataactatggcccaaagtgaaggaggggagatttaattgtttttctttttattaaattggttaaatgatctttgtgactttaaaattactacttgagctccgaaaattcacagaaaaattcggagagtattttaggacacaaagaatattataaaatattcccggccaatgatttttaaaggaattttttaatttccccattatttcacttgattaacttgatttaatttttattttatttctagaaaatacattattaattgatttttaatcccaaacgaaaatcggggcgttacaaatctaccccccttacaggaatcttgtcccgagattctgggatggctagaaagaaagctggtgtgaggcggtctgactgatctgcttgatctgcacactgcattgttcctttctgtttcgaactgactgattgtccgattgaccaaacctgcatgactgaactggctggatttgactttttgttccttagctttgcaaaaactggaccgattggttatgcttgaactgacccagacaaggactgcagatgctcatggaacttacatatcttagactgaactgttatgctggcaattttggtaacctgacaatttgtaactcattgaccctacgtccgcttgaactggacctgactcgaatgacgagtaattccaggaaacctgcttgacctgtctttcgtctaaactgtaaccgtccctaatgttgcttctctaggccgaactgttgacctgcttcacgagtgtaacttagaattgaatctgtcgacttgagattggggtaactctgctagtggctcgcaactgactcctttaactactaaccactttgtttcacctcgtcgatccttcgactgaaacgatgacgaggtaagccaaaactcatctctgagacctacccccccttacagtgggtagtcatactttcgcctgactgggaacaattgaactattgtccttgagaaaatcaccaacacttctcgaattacgaagagccctgactttgaaaattgaaaacttgaccagtcaatcaaaatgaagcaatgacggtgcactttcatcccggcaagacctgtaacttaacccttagctgatgataggaaattccacataaaagtgactcccacttagctcatgaacatactgactcttgactaactttctcatcagttctaattgttggtatgattgtcctgcttctggcctgacttcggtgtcgagttgcatagttgatttctgaaaactaacctgaccgactctgcattggaactgatgcaacttgaggagttggggtgctgcaaataaagttgtcgacctgatgacactaacgccttgccgttggacaacctacggaggagtgacatgtcgtacatcttccattaatgttgaacaccttgaaagaactgcccttgaaaaccataaccattgtaggtagcacttgttgctcctaggattagtggtggcttggctgtgctggtctgctgagaacttggtggtgtactgtctgaggttccgggtgcttgctcttggaaaacaaaactggctttggctctgatccaaaatcccgcttgcatcttgagcttgtacttgttgttggagacactgttgttgcatctgttgcatcggactctgtgggtgctacataatatctggcacatccatcttccaatcttggctaaccagagcgaggtgctctaactaagctggtagcttgttgtcttgaactgatccactgactctgaccgcaacacactactgctggagtttcttccgctgcattcgaccttgcattgagctttgcatctcctgcatcaacatccaacacctaatcttggacaccaaaaattgatgacgagcaggggttcttctggcattggggcaccttgcagctttcaactgaaccattgatttgtgaccttaacacatcgttattgctgttgttgttgttgttgtt

SEQ ID NO: 67621 - DNA, 1603 bp, Oryza sativa
catgtgacacatatgactttgatgatttattattgatcatacttcaattggctaagtgttgtgatgccatgatgattattttttcaaaagccaattgaattagtattcatctagacatattagttggatattatgatttttcatatgtctagaaaggagttttggttcaataatttgatataccaagcatctggctattatgtgaagaaaaatttatatactaaaagccgatgcttgatttcaaaagtttggacgaaattggcaaagtcatagaccaggggcggtctgactagcattgcacggccggtctgaccggtggtagccagcggtctgaccggctctgcatggccggtctgacagggcagacagggtggtctgaccggcattgcgtggccggtctgaccgatctcgggcagagagctgggggcacgttacaattgattaaaaggccaaattaattatgaattcggacatttgtgctcatgagttagaaatagcttggagaattcctttgattaaatatttgaaagatcctacacttaaggttgatcggaagattcggcggcaagtgctcaaatattatatcgccgaaaaatagatatagtattacttagataatgatcaatctaaagttgctaggagagtagtacatgaagggatttgtgaaattcatcaatatgcccgtaagataaattggttgcttaggagagtggggttttattggctgaaaataattgatgattgtttcaaatgctatagagagattgaagcttgttaacggatcggcaatgttcaaactagcgcctatcgctatattgaatactatcatcaaaccatggccgttccaaggttgggctttggatttcattggtcaaatttatccttcatcatcaaaagggcattggttcgtgctagttgcaatggattacttcactaagtgagtcgaagccgtgccactcgagaatattacttgtacggagataattgactttattttgaagcatattgttcatagattcggtattcctcaaacgttaaaggagcttcttttatgtccaaagaagtgagaagttttgccgaatcttatgatattaagttgttgagttcttctctttactacgctcaggctaatggataagccgagtcgagtaataaaacattgttgaaattgccgttttgccagttgaggtaaatcttggctctcttcggtatttcaagcaaggcgacttgtcggttgaagattacaagaccttgatgggaagtaatttttgaagatgtcatcgacgagcgtttgaagactttgagggagatgaagacacttcaagacggtgttttcagagatcaattaatgggaaatacttgaagaaatacttctcgagcacttggcaagatgcttaggaagtcctatggccggtaattggattatcgccctgagataacatgttctatgctttcaggttcacgtctgttcaccaaaaaagcaggggggcatgtgtttacacccaaatttggcatctatggacgaaatagggaaaaattgccaaagtttggaaagtgacgggtttccttactcgggaaggcaggtttggtgtttcctttggtt

SEQ ID NO: 67622 - DNA, 10626 bp, Oryza sativa
  unsure (1)..(10626): unsure at all n locations
tgtttcgatataggggtttgttgaaacgatagaggatggcggatcacttcgcgctgatggctggtcggctgctcacggagtcgacgctgcagtcagccgtgcaggaggctctcgctgtcgcctccgtgaagatagttcatgatcagcctgatcttcccgttcatgaagatgttcaggatggaaaggcgaagagcggtgtcatggtggaatgcagaatctgccaggaggaaggtgacgagtcctacatggagaccccttgctgctgcaagggcagcctcaaggcaaggttttctctgttcccattctgaattctctgcatcattacatgattaggtgttgccattttgataacctttatgtatggaagagcttgctgaattgattagtgatcgggatataaattatttcaatctctagcccttttttttttttggaaaacgtattttctagccctgtttaacccccaggacaaccacaagttcagagtttctgggcacaaattcagaatcattttattcccattactgagtttccaatcacacgacagttcttaccaggtcttctactgctgtaaccaacattcagttttccatattgcaattaataggacatttggggtttcatcccttatggtgaatgctgataacttgagttttccaatagatggtacttgaagttgaagattacttctacctcgaattcaccctaattcagacttttcttgaaacagaaaactcccggtttccattagatagattcttacaatttaaaatgttatcattcatttcagtgttatttctgcctgccattcttacccaacagatttccctgctgtccgaatatttacttgaattagtttgtcactgtctgcagtacgcacaccacgcatgcatccaaaggtgtgcaatgagaagggagacacagtatgcgagatatgcttacaggtgaacctttctgaaaccgtccaacaattcatcatccaaatcccaacaaattctcttcaaaaaaaaatcccaacaaattcaggaaagaagcagatgcaatgcaatctgtccttttcttctctcggaagcaattatgttattatactgaagaattttacagtccaattttaatattcgatttgttacttctgctcttttaccgcagcaattcacgccaaactacactgcccctttaaagttgtttcggcatggaaggaacctaattagtttcaggtaccagctgatgctcctactgatattataagaaggggccatccagtatctactggtatcttaaatccttttctcattgtaggagatctggagaaagatcagataatattgatactgatcgcagtcaagaacactttgcgcaaacctcagatcaagctgccggtacatccagttttgactctcagaattccagcccaaaaggtgtcttctattgccgtgtagtcgcaatatctgtaagtgttgcagagcatgaaattccatttggacattagtactctcaatcatgccatcaaatgtttctgaaaaaaataataaaaaaatgcaatcttcagctgatggccttgttggtgctccgtgatgcgatctcacttatcctcggcgatcctgaggtctactcgatagcactgttcactgtaagatactgatttctgaaactcgattagcatctttcgtgcttggataacctgattacaaatgactgacacaaatcacttgaatgagacagcttttgatgattagaacagctggaattgtcataccaatatacatcatcttggtatcagttaccacattgcttcatcgatacaggcaacatcaggtctgttaccacattgcttcatcgatacaggcaacatctgtcaaaacctcaaataattctgttttctccctttaaaaaatcagttgcatccataatttgggtttgtatgagatttcaggcagtgcacgaggcaacggattcagaacctggaggaggagagggcttgcggccgatgccacctccacagcatgttatcagcatccagtagaaatctgcaaggagataagtaatcaggctctgtaaataactgatatatgacccatcagctcagtaggagtcgttgaatgaaaagtccatagtaggatatgaaaaaaaaatcagtggttgtacagcgatttgatagtattcttgtacatacgaattttagacatagccactcaacttcaccgaccatgaagatgcgaagtgaagattaagtgggcttgatgtgtatattacatgacaagttggaaattggagtggaatgcacatgttttcctacattcatgtcaaagaataagcttttttttcagttgaagcaccgcaaaagcaaaagcaacacgatgcaattaaaagaaagttcatttacctggcattttcccatttttaaactgaacaagaatccaaataaagattttacaagggacttaaaaaagatagtgtgacatcatacaaccaaacttcataataatggaccaaccaatcagtgcctcgcgttcacaagtgaaatgcatatatcatatttgaaggaacgttagaacgtacaatatcatattcttccccccaaaacaatttgatttaaattgaaaccagggaaatctttactacagtagactacatttagggccagaattaaaggggaaaaagaaagaggaagaaaagcttgacaagattacactcgctgcctcttgctctgagtggcgccaagctgatcagcacatctcttcttcttctcatctttcagttcgccattcacctgaaccccaggcgtcttcgcgtgcttctgcgtgcgccttatccggagcatgtctgtgaaggtgcgctcgtcgccgtgccggacttcgaagccgctccacttcgcccagaactcctcgtcggcgtcgggatcgccgtagcccgacgcgtgcacgaacacggcgcgagcgcgggcggcctctcccagcgcttcctcgagcgcggcgaggcggaggcacagcgccagggcgtcgcggcgagggaggccgccggactcgatcgcctgctcgtagacccgcctcaccttcggcacgccgcggagctcggccgcccgccccgcgtaggcctcgtagacgctcgccctgtcgctcgccggcacggaccgcgccgcctcgtcgtacgacggccatggcgcgcggcggagccgaactcctcctcgtaccgggcgtggcgcaggaagaggcgcgccctgtcgtggggaggagcgcggcgggtggcctcagcgaagagttcccgcgcgcgctcggccttgctccggccgtgcctcgccacgaacctctcgaggtaggtgtcccagatgggcttgctgtgcgggtggccgaacagattggcgcccgtctcgtacgccgcgaacgagtcctcgaagtagccgcgctcctcgaggaacgaggcgtattgatcaccatctgcggcgtcgcggcgcgcgcggccatggcgccctcgtaggcggcgcgcgtcgacgccagcgcgcccaggctctcctccaggtcgacgtagaagctccacagctttgcggacttgtgaagcttcagctgggcaggctcgtcgtcgccggcggcggcggcggcggctcgcagcttcacctcggccgagggctccgcggtggcttgtcgcatcagggcgatggccttgtcaaagcgcttgtgccggagctgcatctccgcccactcgcaccacacggtggccaggtcgtcggccgatctgtggctcgcctgcgtggccttcgcgaacacctcgtcggcgctgtccaggttgccgtgcgcctcgtacatcttcacagcgtgcttggtttgcccgtcgccttcgccgggtcgacggtcctgacggcctcgacgtaggtcgccgcctgccgcgcggggtcattgtcgaagagcttcacccgccggtgccactgtgcgacgtcgtgcgggttctgacgcaggaggacgccgttgagaagctcctgccggcggtcgagcagccgctccagcctcgccaggccatgtcgccgtcgtcgccgtcggccaaccagcaaccggtcacgagcttgtcgccttcctcgtccgccgtcttctccatcttcgccgcgaccaagctctgctcgagctgcgcgtacgcttcgaacaccagcgcgaactcagctgcggtggccgccgtggtcaccccttcctcgaagacgtctctggctttgtcgtaaagccctcttcgtgcgtagcactcggcgagcagcgcgcgcagccttccggcctcgtccggaaactcgcgcatggcgccgcggagcacggcctccaccttgagcccggcgacctcgtcggcgtgcttggcgagaaggtcgcacagcttgagcaggagagcacggttgttgtcactgacgtcgcttccgccgttgaggaccgagacaatgtgatcggctgcctcctgccaccgcccagcggagacgaggagctcgacgagctcgtcggcgcgggagggttcgaactggaggaaccggcggtagatgcggatggaggtctcggcggggcaggaagggagggcggcgaggcggaggtagagcggccagacgcggtggtgctgcgtgacggggagcgcgcgcagcgcgcggtcgaaggcgcggcgtgcgcgcgtgacgaggcgctgctcgaggagcgcggcgaggtacatctcccatatccgcggcatgcggtgcagcgtggcgagcgcgcgctcgaaggcgcggttcagggcctcgttcgccgggtgctccccgcaatgcggcttggcgcgcgcggcggcggcggtgcgctcgaggaggtaggcgtgccagagcttgtagctgcccgggagggcgcgcacggcgcgctcgtagatgacggcgcgctcctggaggggcgcggcggcgcgggcagcgaggtagcggcgccacgggcggatgctgtgcgggtcccgcaggacgtcctcctcgtacggcaggtcggcctccgacggcagggccagcgccaccggcatcgcgacgacggcggcggccattacctgcgctgcgcgcgcgcgcccgcgtttcccgctgtctacggcgaggtctcaaactccctcgatccgtgagaagttgagagaaattatggggcatggttatgcttttatagcggcgggtgatgatacaaaggagatccgactccgactcgtcagcggcgtcagtgatactggcgattccgattgcgtatggccacggcagtccgacacggaattctgaaaattcatttggagtgcacacacactggaaagggtagtgaaccgaaagtccgaaactaaagctctgaaaaatataatttcaaacaaaaatacggtgccatgcttatgctgaattaataatagtacatgtatggccatgctcatgctcatgccaaaaaatttgtttataaattgtcctaataccctctatacggataactgaaacgggacaggtaaatgaaaaggaacagtcctatgctctgtagtagtctagtcctatacattgaaaactcaattcataaattaaggggatatcctcatttttgcatgttacttaaaaaaatcatcaaaaaaattgaaaaaaaaatattacgatagatcaatatgtgatatgtcatttcacaaacatgcaaatttaaatttgacttatacaagtataaacaaaaataataaatttgactataaatagaacgtgtaattcactgtcaatgtaccagaagatctggggcacattacctgcaccttcctatcaaaaccgcccaagttccaaaaagaaaaaaaaagatcaaactggattcgaatttcagcatagtttccatatttcaaacggttttcacaaggtttgctgcaaaccctgcgctcaacaccgatacaaattgcaaattgcaaggcaataacccagcaaggatgatcaaagagagataaaccctaaatatgtgagacatttcagcatgaagaacacgacacgttattagagtgctagattattatgtagctacaattattgtcaaataaaaaactccaacgacatatggtcctaggtgacaaaaactttggcagagtcgtggtttgatttgagagcaaattttgtcctgctacacagcccctaataacgaccatctggattggcatactcccaatccaattaaaacaaccaacatactaagcaattgcataataagattgcgaaaggaaagaacacccacatacttttagtccaagcattgaagattttcattcttcaggtttgtgctgtgcttgctgtcaaaactgaatggcagacaacgctgaatcaggagtacaaatgatattcactccagttcgcatcaacaaaccattaagcaaaaccatccaagtttcaaaaagagaaaaaaaaacgaacataattcagatattcagaaaagtttccgaatttcaaatggtattgtaaataccaaagcagctgctcaggagcgaatttcgatcagctgcaaacaatatcaaacaacttggcaaatcgcagcacaattatccaacaaggacaatcaaagagagatgttactctaaatattgtggccaaatccatttcagcatttcagcctgaaccacagcgctagatagataataatataacaagtagctagattagttcgtcgcacggatacagaatcaataaggaagcacataatcagtttcgcaagtgcatcaatagggtcctaggctatatagagtgacgataaattacgagttgggaagtgccttcgacccaaaacacgatacctagaaagtaataagcaaccttgcatatagaatcccaactccgcactgccttgatgaacattccctgcctccagttaactcaagcaatcctgccagacaaaaacatcatagaacttagatggtaaccctgctagatatttttcagtgatataaacaagacgaggcgtgccgtgtgtgatccacaagaaaaagcaaagtacaaattttacaattcaaatgatgtagcagtccttacagtagaattactttgtagctagtggggactcatcaaggtgttggaatgcattggtagggaaggcagccggccggaggatattggagcggacggagtactgcgacaactggattttcttggtgcacatgtcgagcccgcaaatgtgatacatttgggggtcactaggtccggtcatcggtttcggcaccaggaagtagagtgtgccatgtgcgtgcggccttaggaagggccacacgggtaccatcctgggcaacccagactgcttgtagtcccgttgcgaccatatgttccccagcctgaactccacatcctttttccagcacaggccaccttggtccagtgtccacacggccactgttgtgttggctaatgcagtggcgtcatgacagggcctgcccggcggtttgcctgccgcggcatcagtagccggagtgttgatagagacgaacttgatggagcccccggagacgcccatggtccggtacatctccatcgggccaagctcctgggatttgataatgtcatgaagcaggtactggtgggggaagctgaggtgtctgaaatccacggtgtcgccagagaagaggacattggtgtcgcagcacatgaaaccctgtgagagatcgacccagaaagtgttgcccttgaacgagaagatcatgtccgggcagaagaagcccaggggccccgttgggaggcgcatacccttcttcttctccatccactgatcggagcagcaggaactctccttctccttggtaaacagaaggagaacgtccccgtcttctctgctcttcctgctgaggtacctcgctatgagggccaggtcatagcccccagtggcgcggcgccttaggacaggccgcgggtggaaggccacgaagcggtgcggtgacaggctcgggatcatggtgagtgactcgtcgatgccgtcgtagacgaggtagtagatgtggtgggcgtggtcgaaggacgcggagaggacgacgaggttctcctccgcggcgtgcaactcgcagacgaaggtgacgcgggcattcatacttgcctgacagcggaagagcgggcggatgaggctcttctggatcttcgttggcgccgcgaccttccgcagcatctcgtcggtggcacggacggcgagggcggagaagagatcgtcgctggggccatcgttgcggcgcacgtacagcgtcaggccatccaccagctcctgaccgaactccccgcagccgtaggcctccttgcgtgcgcacttgacggccgcccacctgggatctcgctgcgtgtcgacgagatcggcatccctcacgtacctgtccagcacgacccacggattcaaatccggaaccgacgccatgagatggatcaaaaggtggtggtgaacgtacggcgtgagagggggagaggggatctgcgtggatagagacggcgcttcggcctccggagtcgagacggacgaggagaggaggggcgtggcgacccgtgaccgtgagaggaaaggagaacggcgcaaaactcaaaagaaacacacgatatgcggatatatggccttgaagaaaaaaacgacgagaagggagcgtggattcggtgcaccgtagaccaccgtcatgcaatacgtttcctttccgtcgattgcacccggatttcttttggagagggtccattctaattgggaattgctaaaagaaactatataagtttctcgattaaaaaaaatcaaatttaactataataaagaataaattgtactggcggtccttaatcttatgaggagatttcatccaggtccataaacaaacaaacccggggtcaagggcataatcttattttattgtatcaatccggntccatagaacgctttgacccgtttcgtgcatacgtggacaacaacgtgtcgcgacacgtgtgatgccacaccgcaccgccccgcaccgtgccctttttcatctaagcccctctgttcgctcgaattctccaaaccctaaccctctcttctatctgttcttctcctctggacgacgaagcagaggcgatcgccatagaaattgagggctgcgatcgctggtgagatagggattcagaggttgcggggagggtgcggagtcttgacgctggcctcccgaaggtgttgaagccggtgaggaggcatgttgtttcgactagtaggggagccgccgccggtgtacggtatgtagaatggacccaaaatttgagttttttttgggttgattgcagatgggtggtagttgtgctagttgtggtctatttctttgatgactcttagccggaagccctcccccgccgtcgactctcagccaaaagccctccctcgccactcctcttcagttgccctcccacgccctcactcgtcgtctagaggagaagaacagatagaagagagggctagggtttaaagaattcgagtgaacagaggggcttagatgaaaaagggcacggtgtgggatggtgcggtgtggcatcacacatgtcgtgacacgttgctgtccacgtatgcacgaaatgagtcaaagcgttctctggaccggattgatacaataaaacaagattagtgcccttaccctggatttgttagttcatggacctggatgaaacctcctcacaagtttaagaaccaccagtgcaatttactctataataaaattagttctaattaactacatggtacctttatataacaacttttgtataaagttgtacatatttttaaacacatatacttcatccgtttcatattataaaaccttttagcattgcctatatttatatatgtgtctagattcattaacatatatatatatataaatatggcgaatgctagaaaatcttataatatgaaacggagaaatataactattatatggtaggtatagttattagggtagaattatggccatgcctttattatagtggggacttggtaccatggagatcggaatcgtcatcagcatcggcgatgctactggcgattccgattgcgtaagagagtgcaatactagaaaagtacggcttgtaaggcctttagttggagaaaatttttaggtttagttgtcacatcggatatacaaacacacatttaaagtattaaacatattctaataacaaaacaaattacatattctgccaggaaactgcgagacgaatttattaaacctaattaatccgtcattagcaaatgtttactgtaggaccacattgttaaatcacagtgcaattaggcttaaaagattcatttcgcaatttacacgcaatatgtgtaattggtttttttagcctacatttaatactccatacatgtgtcaaaacatcatatatgacagcgtgaaaatttttgttttggaaactaaagagggcctaaatatagcttcaaacaaaaatgcggtgtaaaagctcatggtgaattaatagtacaggtaaggatgcctgattgcaaaaattgcttcggagatgtcctaatactctctttctgggtaactgaaatggaacagtcccgtgctctagtctggtatagtaacagttataaccaaggatacattgagctacaccgtacagaagggctaaactacgatgagcagagatgataataatctcagaggtgaagtacgtaacttccttctctctag

SEQ ID NO: 67623 - DNA, 752 bp, Oryza sativa
gcgcctgctgcgagtcgtatgtatgaagcggtatttcagccgccagcgctaactatgtgtcttacaggagtagttggttgatgtttgctgggcaattagcaaccatcaaacaggtatacagaacaacagatccaagtcagggcagtttcttggggtgtcagttctcaaactggtgtctgcacacaacactccatctggaaaactggaaactaatactagtaagttcaggatacggagtacgttttatctggcaatggctgattttgaacgacggcgcttctggcatggagcccagtgccacagtttgcgagttggagccttggaggcatggagccctgtaagaccaggaacaatcttttggctatacgtgccacagtgcaagttgcttcttgtgtgttttttgtgggtcccactagtaccagctttactatttttttctctctgctctctctcatgtccaattttccccaccgcacagagagtgccgagcgcatcgggcggagcagccaagcgcaacggcgccgaccggaggggcgacggacctggtgctcgccggcacaccaccctcatctccctccccctcccccatgcgaaacaacagcgagtgcttgcgcgcagaagaggtggacaggtcggcggcggaggaatcggcagcgacggcggtgagggcggcgagatacaccacccctctcttctcccaaagcggtggcgaggggcggcgagatccactgcccctcttctcccccgaagcg

SEQ ID NO: 67624 - DNA, 15417 bp, Oryza sativa
cactagaaaattttagccaggataaaataagatatggtataagcacatgaacaaagacaaaaggttcaataagtccctagttagttctaagaaagtcaggaagaaaacttatgtgttgttatctgatagtttgattcaaatatattctattatccgccaaaaacttattttattgactttttaataattaatgaggcacaactatcattgttaaaacttttgaaattgtatgaaaagcatcccagtccaataaacaaaagaaaacatggaggtgtcaatcattcagaagacaaatccgaaacaaaattcggtgcaatgcacataaaagggaggataattaagccatatttaagaaaacattaggttgtacccctgcttggcaagtgcttgcaaaagaagcccattcccagttccaacatcgagcacagggtagttggatagttgcttctcatcaacttcacaattgatgctttcattaccagatggagtcccaccattaataatgtctatacacaatttttttgtccaaacagccatggtgtccattacatctgcaccaaacctacaaacagagaaaagctctgttcacaacccaaaagacaatcctgaatcaaccaaatttttagagaaatgccaatgaatcatcgagtaatttcctataaataaaaaccaccccatgagagtcaagttaagtaaataacaaggcaaggtgatattttgatatccaaattctgagtttgaggatcaaactctggccacaggtttgcgaagcttgtgattgatgcatataccaatacatctgtaccattaaaaaaaattgaaaagacctaaacagtcacatacataatcaaagcaggtactaaattggattttcagcagatagtgaaaaaaaacaacaaaagaatgatagtacacctccaacaactttaagttcacactaccaggttcctttacattccttgggaggtatctactttaaaaaaagaaaaagaaactctacacaaccatacttgcatttttctgagtttaagcaatgtcaattatcaacagataaaaattataactaattagtgtcaacttattgggcttttttgcatcaactgatatatcaacacttcagttttctatttacttaatctgaatgaccaaatttttcggtataaaaaatcatggtatgtagtcaccatatttctccagcatgcccatgttcctgaaaatttgcaagatcttctgaataagaagcatcccaataactttggagccccagcattgagccttcaacctcgctaggatcttgatcatctttgtcagaactgtgtcaacacagcaatattttagaatattaaaacaaaaactgctgataataacagaccaattataaaactaatcacaagaaaattcaaaggaaagaaataagtaggcaacagacacgtttcccctcttgccatttatgctgatatgcaacatgccataaacgatctagtatattgatccatccttaaatagcaaaatgtaccaattgtctacaaatataatgtatgtattctgattatacactctggagcatgatatatgctcattgcatcgatccatgtcatatctattaaagagtgcgtagataggccaccttcaaacaatgaggtggagtgatacagtattacaatctcaacctcttggtctcgtccttcaacgtgacatcagaatggactttgtcttttagaatggagtatatttcccctggaggaacttacatggttctagtggctttctagtcctatagtggacaggcagtcaggaagctatgattatacctaaaatgtattttctgccactggttagtggacacctacccataacccaacctatctagcagcaatagataaaataaagtctactttatattggattaggcaatcaaacgcgtgtaggtgatgggtccatatgatcatcaagtatcactaactaaacagaaagggtcttctaaaaaaccgtcatgtgtaatttgtcacatttttcagtgctaagggatgatttgcactgcctcgaggcttaaactccagcacaaaaacaaagtgggtgaatttgctttgcttttcaacaataaactcgcttggatgtctgaccacagtcaatttggatgcgcatctgacttccgatgccaacttgcccaataaccacgaagctggcaaagacatctctagcacttcctctttccacatatttgattacaatcctaaatgcaatcatcaagctagtcgcaaccagaaagtgcacaaagtaaaaggtacggacggcaactccacaagagcatgagactacataaccctgtagggtatctagaaaggcaaggcgtccatgagatcaagcattattatttccaacaaaattcaccagatccacattccagagccgctagcgtcacagttcgcaatcccagacagacaattcaacgcgagttaagtagggccaggagccaaaataccagcaatcggaggcaccggaggggaagttggcggaggccgcggccgccgcgagcacctcggcggcgtcggcgtaccgctggtcgtcgtcgagcgtgctcccgtactcgctccgcacggaccacgagtccgccgccaccgaccgctcgtcgtccgacgccatctcgaggccgccgccgccgccgctgccactgccagccaggacggcgcccgcgccggcgaaggcgggcggcagctgggggcggggcggggtgccctgcggcagctcgggctcctccggcgtcagccttattccagccatggtggggatcgggaggaggaggggaagggagatcgcggcgagggctgcacggacacggcggcgattgcgaagggaggaggcacaagagagagagagagagcgaggaggggcaggggcttttggaccgcggacgcgaggacgcgtttcgaatttgggtcaagtttgcggtggtgaatgggtaaaataattccgcgtttgtaggagatgggggttccctcactcgcggggttctgcacacactggagcggtgatgtgtttgcttccatccggaaaagggttcgtgccactctcgtggccgccgcaccggtgcatgagaaaaagtttggacctgccgtccgtggcacgtgtaactttgcttggatttaggtttcatcaaagtggtccacgtttttaagttaagagataataaaacacgcgaagccacttatcaccttgtcaagaagtattgaaatacagacgatgaacggaacctagcttagaccagcttggcctctcattgacggtggaagaagaatatagaaaaacatatatatgatactatatatgttcctaacaatcgggtgagtgattcaattttcaaactttacatgggtttgtcgtcacgccgtgtactttacaccagtttataaagtatgttaagttgccaacatggtactccagttacaacctactcccttcatccaaaaaaaggcaaaccctggtttccgtgtccaacgtttgaccgtccgtcttatttaaaaaattatgaaaaaaattaaaaagacaagtcacgcataaaatattaatcatgttttatcatctaacaacaatgaaaatatgaattataaaaaaatttcatataagatggacagtcaaagttagacacggaaacccagggtttgcctttttttgggacggagggagtaactcgaacacatctctaagaactgcctagcactcatataatgtaatgtagggcttatttggtctagtaccctaccaaaatattggtagtgccaaaatctatgcaagttttggtactattaatattttgatagggtagaattgtaaatggatgtgtttggatttatgtcaattgagagccaaatttcaaattgtggtaagaatattttagaattgtgccaaattaagtataagcattaccaaatatctggctttaaaccaaatcattacatttactattcaaactacctaaaaattggtatggcacattttggtatcaaaccaaaacgccatgtaatgtttatgtgctttaaaaagtgaaatgatcatgaaaaggataaatacggcactccttagcccttaggccatctccaaaatatcacaaaatcggaaaaaaaatggagaaataagcttgatccgatcatacactacaggtattgaagctaaggaaaaaaattgtggttcgtaccattgaaggccatgtagccgcacatggcccccaattctttgggcccccatcacaaagtaggcttgcagcctagcctaagttcagcggcccacgaacgaggaggcaaggagtcaagagtgcttaggcagaaggcaaatttcgcttcggcttcgttattagcttgcggaggagcgacttgcggcgtgtagtgcagcaagtggtagcgacaatgtcttgacaacaagtagcacaatgttgacgtcgccaaacgccaagatcgtgaacaccaacgttgctgagtggagcagtgaggtgccaaggccgcaaggtccaacacccagcccatggccagtggcgaacgacaagaaggcaagcagcgcaccgacccaagcggcggcgatcgaggttccgaggctgcgaggtccaaccgtagcgcctagcaagcagcggcgaacggcaaacagctccgagtggtgttctcaacttctcaattctcatctgagtcatctattcgtcctcgggaattgaaaagttggaattggtaatttactaatttgaaacaaacctaatgaaattacattatagtattttgaatgatccatagattgattattgaattaaaagtaatgtgaatgtcttctcttttgtttataaaacatgaagacattcatttactcaaatcctcagcatttcatttagaaacatgaagtatgattcggatgctcaaaaacataagaagaaccaaagattagatgaagcagctcaatcataaaagtgctgttgataaatttgttgtgagagaaactacggatttaactaggcgaatgatgtttttcagtagaatataaggtattacctttatactctcttagcattaatacttgaaaatgtatttataaatattatacagaataatacatattaaagttatatagttgaatgaaagtaatattggtttattaaattttaggacccaatttgtattttgttccggggcctcaaaatcctggagacgattaaaaaaaattgtatgtgtcagctaaatccattaaaatttgacaaaatgatcgctgttgtgcaaccacagagccaatctgttttttttaattgttgtatggtctcacatttcgtgctatataaaccgctgtatacactatagatgactttaggtgcgaacattatacactacatttactaatgagtttttttcgtttcagtgcgttgaaaatatccctacaactggagagaacgaacggggccgtgcagtcacatatataacagttacaaatagagaggttgggcaaacacaaagcacaaaacagatcattgctgcaaaacacaggtaataagcacatgcactcagcagtcagatggccacgaacctctggtttcctgttcctgcaaggctggaaaatcaggggtagaagatgaccgtgcaagtagcaacaggccgacagcatccactgcacatgcaatgtctgttaaactatatctagttttgctaaactttattcgggaggtcaagtgacccattgaacatgcaaacagatcctcacatgcctatccaggaaggaattcaagcttcaaggtgacccatgcaaactactacgcgccaaaccgccaacgcgacgtgatccgatcgggcaagtcacggctccgcgcctccggacgttatccggtcaacgaacgcctggacgccgcggtccgacgagccgccgccgcccacggcggcgcgcgcattctcccccaggatcgccgcgcgcgccgccatcgcctccgcctccggcccggccgtgacctcctcgacggacaggcggagcgcttccctcgtcagcggcgtcgccggggctcggacgcccacacggtagacgtcgacgacgaaccgcgtgttgatgcgctggtcggaccacctcggggaggccaccatcggtacgcccgcggcgagcgcctcggcggtggagttccacccgcagtgcgtcacgaagcagcccacggcggcgtgcgcgagcacgcgccgctgctcgcaccacggcaccacctttccccggtcgccgccgcaggcgtcgatgagggcgtccttggggaggagcgcgcggttgccgtcgcgcagcacccacaggaacgggcggcccgtgctggcaagcccctccgctatctccaccacctcgtcgtggccgatgtccacgaggctcccgaaagccacgaacaccactgacctccgtggctgcgcgtcgagccacgcggtgcaaccgtggacgtcgtcgtcgtcgacgccgccgtcgtctggctcgacgagtggaccgaccggtataagcggtatatgcttgcgaagccccgccacggcctcgtgctcgagctcgtcgaacgtgttcacgaaaacccatggcgccttctccgtcatgctgccgagatccccgacgagcatctggcgccacatttcctggtcggaagtgtaaatccggagtggccgtagctcgtccatgtccagctccgggagacccgggatggtcacggcgccggaggagtcagcctcgtcgccggacgggaaggccgcgagcgagtagacatagtggtagtacacggacaggacggcgcacgactggatccacagtatggcgcacgggagaccgacgtcgccggcgacgcggaccgcccaggagacaaaggcgttggccacgacgcacgccaccggccgcccggcctcggcctcccggcggatgagctcctcgagcgccgccggcccggcggcctcgacgtggcgcgccatgtccccagggatgcggagccgtgggtcgtcgggctcccacatccctccaccgcggaggcgctcgacgcggacgccgccgccgccgccgtcgccgtcgtcgaagacgcggatgccgtcgcggagagccgtagtgaaggtgacgctgaggcccttgccggcgaggcggcggccgaggcgcaggagggggttgacgtggctctggaaagggctggagacgagtagcacgtgcggctgagccttcgccggcgccggcgccatgcccgtggccgcggcggctgctgattcttggctcatttcgctggctgcgcgcggctgcatgcacggcagtagtgcagctaccaacgaagtccaaatctccgatgtatcggataatggaggggagccgcttttctccgagatgagacaagaaaaaccaacaaactctactccagctcggcgtcgctgtgtctgctcctggaactatcggtatcacggcgtgggcaccacagtatctcctcagaaacgcacgccggttctgggctttgccgagcatgggagcgcgatggccaaccgaaccggtctggttattgaataaccaccgaaattaaacaagagctgttacgagatttcgagtggagagtaaaagccatgggaagctatcaacatactactccctctctccgtttcaggttataaaactttctaggattactaatattcatatagatgttaattaatctaggcacacatatatgtctagattcattaacatatatatgaatgtgagcaatattagaaagtcttataatatgaaatggagaaagtagtattttaagtcaggaaccacgtggctggcccgactgctacaatggcgcaactactcgtgctagcacgttagcacgtaaccgtctcccacacacaaatggacacaatagttctctctttcgagggaagcgagcataggggcacagactgttatgaaaatagatgcacaacggagacatgaattttacgtggaaaatccttgcgggaaaaaccatgggcgccgaccggcaatgatcactatagaggaattggatacaaacgcaagtgatacattgggctgtcgcaccctcccggtgtggcttacaagggatatatatagcagaaatctaggagccctaataggaaactaatcctataaagtagagtcctattagataactaatctgaatatattgtgggcccgaaattcggatcacatatttaacaatctccaccttgagacgaatttcccttgtagcataaaaatcttcaatctccaaagaacctcgtgatgataaaatcaatgtgcgccaaatagtcacttggactataatccataacacccttaatccagaagaggtagaccatacttcaaactcgccattggaaacaaatcctgaatctgttggtatgacattgtggaacccagcagagacgtgaaactgatgcacaaacttcaaactcgccatgggaataaaatcctgaatctgctggcattaatttctggaatccaaacagaaacgcgaaaaattcttgtgcacaaaaacgaagtacttagatcccctgataacctcctggtatgttggatacaatggtagcaaaattcaccggacaatttgatcatcttgtgatctagacaggagcgaggctccctctcgacgacttgaatgtacttttttttaatctcaggtgcatgacttatcctccttgaaacatgcgccaacttgcatcttcacttgccataacgagattgcatctcaatccaggagtggtagatcaaacttctaactcgccttgggaataaaatcctgaatctgctggtacaatttatcaaaccctaacagaaactcgaaacactctgggtgcataaaacgaagttgatttccatgcagaacctcctggtagactggcttgtgaatatagcaatttagaacgtgaatttgtgttcccctgaacagaaccaaaacaatgcaaggcttaaatccctggtgcgaagggcgtgtgcacgtaacaattccaacgtgaaatttaattcacatgaacagaaccgagaaagctactgaaggcttggacttttctccttcctcgggatgcgtgcggaatagatcaatggcttcaaccctgctgctgctgcttctgattttctcctgcgttgcttgatggacgtgattcatatcgatgtgttggagcacctgcttaaatcgatctggtcgacaccgcttcgggtttgcttcaccggtgattcaatctcaccgaattgatttctgcgatgatgacgacgcgttgctgctgcggccgattctctgcgacgtgcgctgctgctccttccccggcggcgtcgacgacgaggccaatcagatcgatatatactccgatccgaaaaatcacaccggtggctgtgtgattagtagatcgatctccaatgctctgataccacttgttataaaaatagatgcacaacggagacacgaattttacgtgaaaaatcattgcgtgaaaaaaatatgggcgccgaccggcaatgatcactatagaggaattggatacaaacgcaggtgatacattgggctgtcgcaccctcccggtgcggcttataagggatatatatagcagaagtctaggagccataataggaaactaatcctataaaatagagtcctattagataactaatccaaatatattgtgagcccgaaattcagatcacatatttaacatagactttgccggaacggtgaatcggtgatgtaggcagagagtagtgattaggagtacattacactagtgttctagtaatctagttgagtgttgagacttgaaacgaacggagactactcgtgccgtcggtgcgcgcgaatgcactgaaattgagcacccgggcggttcacgtacactcaccactcagttcccattccaaggctctcacgtgcactcaattctcattcaaattacgtgcatgcaatctgtagggctaaataagtgtcgagctgcaccacttggtgcttggtgagggatgctctagctctaaaacatttgcccagtgagttatggggatgcttagggttgataaaaggttttttttttatgggacagggagtacttccttaacgtatagtgtggaaatgctggtgttactagaaatgtatccgtcaattgattactttattcatacttggagtacacacatgtacgaactctgccggagtccacaaatatttgccttaatttatgcaccatgcaaacgcgaaaatatgggaggattaggaagtgatatacagccacatgtacgcaaccaatcccaacttgttacgtacaaacacagcttattttgacacgcagtgatgcacagttgtacgatgtgccgctagagcgctgacaagtcagcacccatgttctacggacaaggacagcagagcatcggcgaagtcccggattcccatgtccgacgacccgccgttagccaccgccgcgctcgccttgtcgctccactcccgcgccctcagccgcatcgcctccgcctccggcccgctcatgacctcgtcgacgcaccgggagccggacaccgacgccgtacacgtccgccagtaacttggcgttggtgatctggtcggaccacgccgggtaggcgacgaccggcacgcccgccgccagcgcctccgtggtcgagttccacccgcagtgcgtcacgaagcaaccgacggcggggtgcgcgagcactcgccgctgctcgcaccacgccaccaccttgcccttgtcgccgccgccgccgctctcgccgtgcgggtgtagctcgcggctgtcgtcgcgcacgacccacaggaacggatgccccgtgctcgcgaggccctccgcgacctctgccgtttcgtcacggccgatgacgacgacgctcccgaacgccacgaacaccaccgatcgcggcggctgcgcgtccagccacgccacgcagtcgtcgtcttcgcccgcaccgctgccggtgtcgaagagggggccgactggcaccaccggcaaatgagcgcggagcgcctcgatggccacgcgctcgagctcgtcgaaggtgttgacgagaacccagggcagtgtgtcgtggaggctgacaaggtccgcgacgagcgcttggcgccagacgttcggctcgggcgcgtacaccaatgctgggagctcgccgacggtcagcgccgggaggccagggacagggaccgggagacccgtctccgctccggccggggggaatgccacgagcgagtataagtggtggtagtacagcgacaagacggcgcaggactgcgtccacagcatggcgcgcgggacgcccatgtccctggcgacgccggccgcccacggcgcgaaggcgttcgccacgatgaacgacaccgggcgcccggcgttggcctggcggcggatgagcccctcgagcgcagctggaccggcgtcctggatgtggcgctgcatgtcaccgggggcgcggtaccggggatcggcgggtgcccacaggcggccgccgcgcaggggctcgaagcgcagcctgccgcttcccacgtccatggcggcgccgtcatcgtttggctgaagcttcagcttgagtccatcgtggggtacggtggtgaaggtgacgaggaggcccctggaagagaggcgcccgcccaggcagaggagcgggttgacgtggccctgtaacggtgcggagacgaggaggaggtgcggcagcgaacgccgcgccggcgtctcttggctcattatactgaattctgagctgaaggctgatcagtacggacggagctcgatttttcaagggccaaagtgtgggtcagtgtgtgggacaggatgccaggccagggttcttttcaggtcgttgaggtctcacttggataggcccatccgcccatgcataattatggcccaagatgttgtcatggaataagtagttttgcctccttcaactcatgcccccggttgaatagcatctctcaaccgtaaaatcgggtataacctatccctcaactcccaaaaccactctatggctgtgttcgttcacatgagaaagggaagattgtaactcgttttccgcgcgcacgcttttcaaactactaaacggtgcgtttttttgcaaaaattttctatagaaaagttgctgtaaaaaaatcatattagtccatttttaaagtttaaaatagttaatacttaattaatcatgcactaatggctcacctcgttttacgtatcatcccgcaagtcttttctgcacactttatcgtcactcgtgcgcacccgggaagaatttcacaagaatttctcggtcggtcactcatcccgaaattgctcaagaccaacacaacaacacaagaatttcccgggaaattgttctaggccaagcacgcttaactttagagttcctttgagatcgacttccgaaaaagaagttgcaacttgttggtacgattattctattaatcctattaagccgtgagccgggatgtcacagtttccctttcagatcagataattctcggatagtttggatatagatacggatatggatatggtatcggggtttccgttggatacggataataattcagatatctggtgaacagtgctattcggatatccgcagaagccatgagatataccctatttctttttaactctataaccttcaatatacctttatagattttaatagtagtttatctcttaacgctagtccatactattaatattatttaaaatttaaaaaaacatttataaattatacttcactttatataaaatgagctaattatatatgttgatatgtgtttctgttagaagttgagttggttttcgtattccgagaaaaaaatgtttcagtattcgtgtctgatcatattcgattcttatttgtattcgagataatccgtatttttttccgtattggagctatccgtattcgttttcatatccggtaaaaaaaatgaaaacgaatatggtattagcattatccgtccgtatccgctccgttttcatccgtagccgccacaggcatcgccccgagccgtagcgtgggcagagtcttcaacccgacgccatcgctggcatccatggtggtgaaaaccaagccatgaggcaagttggaaccttcctccccttaccagtcccgagtctccattgtcgccagtgcccttgaaccacctcgtggtaggagtgcggacgaaggtcggcgagggcaagggggaggccgtcagcagcggcagcaaagtgatgagcgctgcggtggcagaaccaacaagagggggactggaaggtgagacagtgagagagagagagagagaggaggaggaggaggaggaggaagagggatctaggaagagaggtgaggaagaggatgggatgagatggaggccgctgataagtgggtcccacctgatgactcaaccagttaacgggtcaaagatgccacgtgggataaaaccgtctagggagtcgatttgctacggtttttggaattgggggataagttatacccggctttacggttaagggatacgattcaaccataggcatgagttgagcgaggcaaatagacttattactaaaagaaattgttagtacacaagtggatggaaattttagcctatactattcctaactactactccctccattccacacaaaaccaaccgtgataccgattcgtttcgtaaaattttgtttatagaaaaatgcccttgcgttgcaacgggtgaagattattattgtgcagtttagctaaggtgaaattcactgtaggaattcgcttggatattctttttataaaatcatgagccgcaattaggggtccgatcatctcaagttagcatgcaagttttttaaagagattttttatatgactccttctgtatttctaaaaacaaacaaaattaaaaaccgactcaaacacggatatatacttccaaaagcgaatgaacttaaaaaccgattcaaacacggatgacgtaccaaaagtatcggcaaaaacatcttcaatttttatatttttgtttatttactatttgcaggttaagttcttttgtatggttatcgctttgtcgtttgtaaagaaacaaaaatttacgagtttgttgttcggagaactgtatcaccggctgatcgtgttgtaaataaactcgtcatagttcgttgttcggagaactgtatatagtttgtgaaactgctctatgagctatgacgaatttcagcgtcctattctcatagacaacttgaaggccattaccgcagtccatcggctggcccctgctcggctgctttggaaaaaagcccaagcacacatatataagactataagagtgtcttgatgaaattgcattaatagtgtttctcttccaagaaaaggtctatttcactccctcaaccataggccggatttaatttatactccgtatttctcaactataaaagcatagttataccgcctccctcaagtgttaaaatcgaatctttcatctcccctaagggtttagggtttaggtggtttcattatatgtggcatcccgtcatcccgaacatcatcaaggctgccagttgtggctagagcttgaagaaggacttgatcacctttttcatactcactctatcccataatataaggtgtgcaaatattctaagattcaactttaaaaacatttggccaacaattattactccatccatcaacttttaataggcatatttccaaaactggaaaatttatttttataggcatatttcaatccaacaatatattctcttaatgactttctcggatttaatgcgtaaatctccattggtccacacaaaattggctatatagacatcgagaaatacaaatattaatgaatcgcttgtttaataactagtaacatgtttaaatagactagtaatcatgcacgtagcggcatgagaaattaaaaaatatatattgcctataatcaaacatattgtttccttatatggcaaatctaacatcaatttgcggaagcaattatacttccaagaggtaaataagtaagatggcgtaggaacttcatatatattacaaactttacctcatgaatcaaacttatatggtttagtaatatgaaatgttagaaatagattcactctaaagaaataagcaattgtcaagcttcgaaatccacacggcaatcggcaaccaccagacatttggtgttaactcaaaagataaagatatggtagcacaatcttgaattatcggtaagatgaaaaaaagaagagaacttctaaagtcaatcttgaatggcagcacaatccattcgcctcactcgcacttgccattccactccaactctcctctacctgcagcgagctgccattcccctccaactcccctctacctgcagcggacacaaacacacaaccataaaagaccaagaacccaaaacaaaccattccgacactaaacctagtgcttgcatataaatggagaccatactaatga

SEQ ID NO: 67625 - DNA, 4675 bp, Oryza sativa
  unsure (1)..(4675): unsure at all n locations
ctgatcaagtttggttttttcttcatgcacaagctgccgattagcttggattgtggcctcaatctctttgcgatcacggcgttcggctagtcttagcttggctttttccagcttggactgatattgctcgagataagcggctggagttagaacatcggccagatcttcgggaatcagagcttgaacttcatgcagtcgtgtcctaattgacccacagtcaactaccaaactgtcaaaagaagaggcttctagccgatgagagatgtcttcaagtgtttttctcacatcatcggataggggagctagggctttgcttgaagtgtcttcttctgcctcatcaaggtaatctctaatgtcaaaagagaagagatcggctagagcctgcagagacaatttcggaaagaataagagctgggtaaattatagctgatctaattgttgagacaaagggaaacttactgggatagcaggagcagttggttgttcttcctcttcgacatgatgactccccacagcggatggagtctgatcacttgacgattgctgtacaggtggagaaggagggggaggctgcgaaatagacaagtgttatatagaatcagttgagattgattaagtaaaagaattaaggacatcttactggtggagccgatttaacaattgttgctgctgtttttttcttcatagcagttttcttcttctgtaaccacaaagtctatgggtaattagccgaagagtgaggtgatttcagaaaaagtcagagagaggtacttactcttgtaaaatgaacggggacagaaggagttggaggcgtttgcttgggtgaagccgatggtgttatttctgtgtcactcatttcggctatagcttggtcaacatcttcaccatttcctcttcatctaaagcttgttcatagatggatccaaggcgggcagatcatcagtcgacgtatcagttggttgtggttgagttttcttgaatttggtctttttctttggagccaaggctaaggtactcagggctgatgatctggttttccttttcttgcctgcatcggctggttctctagttaggccgtgaaggagagttgaagtcttggggcatggtagccgatgaaagggggagatagtccacctccattcggaattagaccagaagcaaattcaatgttcttgccactgttactttgatggggaggggaggactctgttgtctgcaaaacaggagcaagaggttagtcaagtaatgaatcggctaactggttatgcaatttagtaatgacaaagtttacctggggcatgacgtcagggaatatatctgttatatacattgaagccgattngatgaaatagnatgcagncttccatttcaccccaccatttctgtcaaaggttttntgctttctaaatccctgccaanctcaatattatcaatgttgcccagagggggtcctggtaggttaagtagccgatccatcattagagtggaagtgatttgtcctcggcactgaatcttgtcggcaaagaataagccgattgggagttggcccaatccaagttgtctagccgagttcattgggtgataaaactcgtaggagacttggatgtttctcccttggtgaatgccaacagggaggatgcatgggttgattgcagctataagaatttctctggatttttggaatttttcatgattaatgtcttcgaatctaaagtctgacggaagttcaaggtctgctgagtcttcgtacggaaaccagattcgtgcatctttcttaaaacctttgtagaagctgcagaaccagtccttgagtagctcagccgatagcttcgctccagcatcggttggtgtggatgcatattctccatatgacatgcatctgcgatgggtgcgctcttctccgtcatcttccacaatcggctctggcaatgggaattcagcttctgccacatagggccgattgacaaccttcatgactatcaggtttaaccaagtttgcagcagccaccatggtccacctgctccaactattgagccgacggctattttagccaatgcattgttcaacatctagtacagatagccgagaaggattttgcccaaaggaaattctttccttgattctaaggcttcggctacgaattgccagttggttgtagggccacaactggatccacagaagagaaacttttgcagccacatgagcaagaaagctacatgctctcgaggggtaacagacccttggcccatatatgccgccacatagccaaaccagccacctatgcttttagtcttgaagtcgaattggttcttggtgttcatgttcatagggttacccgatgaagttacatctaatccagtaatcatggtgatgtcgattaaagttagagtcatcggctcttggttgaataagaaagcattgatggtgttggaccagaagtaggtggcggcagccatcaagggttcatccttagcagaattggctatggtgagagcgagtgcttggccgattccaatttcatcccagtgaactttcttactagccgatacgcgttagtaccagatagtccagctcttatcagtagtaggtttttctagagatggccaagacttgaaggtattcttccagtgacccaggttagggttggctagtctaaaggggatccggttagtttcaccgatgatgaaatcagtggggtcgagattgccgattgggccaagaaaatagtggtttttgtgtgaaaggctgggaatcgcgactaggttggaaaggtgctgcaaatccaaaggaattgggaagtagaaaacgtgaggtgaaaaggagaaatcgatttcatgcgaggaaaagggatctagctggtgaggacttacctcggcgtactcggccgatggcgcagtagaagggctggtggaagacgacatcgccgcgggtggagatctggtcgagaacgaaatcgcctggggatcgcctgagatgctgaggccacagcctattcttaaaattagtttttgacacgatttatttttaaaacaagttttttaaaagggtcaatttgttaaaattacggaatttttggggaaacctccctgcatgagtgtacaaattaacaaagtcgaagataccgccggccagttgcagacgtgtactcgtccaacagttctgaaacttgacgctctagtcaattcacagtatgccttaagccgagtttagtttcaaactttttcttcaaacttttaactttttcatcacatcaaaattttcctacacacctaaatatctaacttttctgttacatcatttcaattttaaccaaacttctaattttgatgtgaactaaacacaccctcagttacagcagtgaaccagtgtgcctttcacggagttttagcacgcgcctgctctcctccgcgtgcttttctgtgatgttgacacggcaaatctggaaaatgacgtctttatactacctccgtcccaaaataagtgcagttttacactattcatctccaaagtttgatcgttcgtcttatttgaaaattttttatgattactatttttattgttattacatgataaaacatgaatagtattttatgtgtgactaatttttttaaaaattttcataaatttttcaaataagacggacggttaaacgttggacacggattttcacggctgcacttattttgaaacggaggtagcagaagactgtcgatcaaccggtaccgtacgagtattacatcgaattgtcagtattaccataacaatgatgaaaattgtttccggtggctagccgccgagccagcttcactctacaaagactgtgtttagttcacgctaaaattataagcttagttaaaattgaaatggtgtgatggaaaagttagaagtttacgtgtgtagaaaaattttgatacgatgaaaaaaatagaagtttgaaactaaactcagccaaaaacccacaaatcctgagggaaagaagcagccaagccagatcaggccgtcgatgagatgggagtaggaaacgagaaatgcttaccggatgcttgcgttgcgtgcacgccttcctataaagttgagcgtgtcaaatcagtcctgcctcctggaggacagcgctgaggagtactcctactcaacttccgatataggctagggattgggtcattgggactttgggaggcaacctggctttgcttgcaaggttgtgcttccggttccggctgaatttttcgattggttgtccggcccccgttcgccgccgtatgtcgaaaatggcttttctccttcagatgtccgcggcagatacaacagtggtaaagcagtaatgcttccgtcatgtatgatgaacaagaaccagcaggcagtagagtgcacgagtgcggctcgatctggtgatgaggccgcacgtgaaacgagcccaccagcgaaggcatgcgatgtgagccaatgcggtgatgacaggtccccggcagtgtgatgaaacgacgaccagtagagactagagagtcgctggctctgcctcgcggtctgcagaactgtatcgttgggcagcgtgccacgaaaaattgacgaaaagaaatgagccctacagtaatcctgtagtagcggtgtactccctccgtcccacaatataagggattttcagtttttgcttgtaacgtttgaccactcgtctta

SEQ ID NO: 67626 - DNA, 642 bp, Oryza sativa
aatcgtcgccgccactgccagccaccagccatcaacatcgaacgtgacgcatgggccctatcagtcagtcacccaccctcctagggtctcctcctttgtcaggcccatgaggctactacgcggtgcccctgttccccagcacagagctttgagtggcggcgacaaccaaaaaggactgaacgcgaagaagaatgatgccacacggagcttcccgtcgctatcaccatcgagctccttcgtgtcgtgcctgagggaggtaggcggcaactctttagaggatgagcggcggagacggcatcctgatctgccccagcaccttggcgacgaggagggggacggtggatggcggcacactgaagagtagggaggcggtgtgaacaagaggcggcggttggaagccccgagctctgtcggcctatgccacccaaatccgcaccgcttcgagctccattggccaactccacttcaatgttcaaaatagctggctatggcttttaccggctgggatctgtagaggctaagaaaggctatagcgggctatagcgccgctatcccatttaaccggtttgaaattgcctgacagaaatcaggcaagaattattgcatataaacatggaatcaggaaaaaatcatgaactaaca

SEQ ID NO: 67627 - DNA, 2338 bp, Oryza sativa
cgcgccatccgctcctccgccgccatgcgcgtccgccgccacgctcctccgccgccgcggtcctaagctcaaaatcccttatattatgggacggagggagtacgaagtaggatgccgtcttgttgctgagaaatcgcgagtatatagaattgaagccaccggtggcgggggaagcttcaattctcagcggctgctaacctgccataagcggcggcgcactattggtcgccttgtattacctgcgtcgaattccgtccaccagcgaatcacaccaattctccatccctcctcccatgctgcggcggacacagccaacccaacctcatcttctaccgcggctaagggctggaaaaggctgtgactaggtacggcccatattacttgggccggaacatgtgctatcatagttgggctggaagggattgcgcacggattcgtagctgagccgacggatcgctctcggtcgcagtgacgatggtggccgcctgtcaccgtgttcgccccagaaaggtcctcctcgccggcgacccttccagctgccagatgcgcagcaagtgcatgcatgaattaaagaacaatggcctaaaaatgaaacacgctttaagttctaggagatgctcgtaaaacaagaagatctcgcatcgtctcggttcgcaaggaggaacttggaagttggaggcgacgttctatatactccctccattccaaaatatttaacgccgttgactttttaaaaaatatttaacagttcgtcttattcaaaaaatttaagtaattattaattcttttcttatcatttgatttattgttaagtatacttttacgtatacatatagttttacacatttcacaaaagtttttgaataagacgaacggtcaaacatgtttaaaaaagtcaacggcgttaaacatttaggaaagaagggagtaatagttacttccaagcaagaatctgaatcagagaaacaggtgaatgctggtaattaatcagaaatgcagcggaatcatatacatatcgatgtcaaatatctttgtccaatattgtaatcatactactaacttcctaaaattggtacttaagtaactcatgcacacgatgagtccaaatccatggagcgtcgcccccgccgtcgctgcctgattaagatgatcacgccgagaagtcgacgtggtagaccgcgctcatgtccgggtggaacaggccgaagttctgctccacgccctcgggcttctggttctcgttgaacatggcgaagatgtacgtctccacggccttcccgggccgccgcggcgtgccgcgcccgacgtggcgcaccaggttgttgctgtacgccgccgcgttctccacgctggcgccggccccgccgccgcccgacggccacccggtctccgacaccaccacctccaggccctgcccgcccgccttctccagcgccgcgtacaccgcgtccaggatggcgtcgaacatgttggtgtacgtgacaccgccgtccgtcacggccgccgacgtcgacggcgacagcagcgcgtagtcgagccgcaccgacgacgggtcggcggagtaggcgaagtacgggtacacgttcaccagcaggggcgtcccgctcgacgccaggaaggagacgatcggcgccaccgtcggcagcgcggcctcggagaacgcgccctgcgacggcgggtacgaggagcccagcaccgacgtcgcgacgaccgtcgtgaccggcacgccgagccccgcggcgcgcagcgccgactggaggttcctcatggccgggaggacgctcgccgcctcgtccccagggatgacctcgttgccggcgttgatgtagcggaagcggacggcgccggcgaagggctgcacgtacgactggacccacgacgccgcgaacgaggcgtcggtggcgaggcgtgccaggtcctcgttgagcgtgccgagcacgacgccgaggcccgagccgcggagcgcggcgagcacggtggtgtccgggtggaagaggcggatgtcggtgatgttgctggctctgtacagggcgatgaccttgtccggcgacgggaggttgttgccgatcatgccatagttcacaccgataccttccactcctgcacgatcaatacacacgccatacacgtactggtaaacaagcaaagaaactactcaacctagcttgtactactacattaccatttcatctttccacagattcactagttaattaacggcattttgatgaaagatttcttactaactatcgctgcaaaggtgcatatatgcgcatatgattacattacccttttcatgaaaggaacactcattttgaaattggaaagggcaagctag

SEQ ID NO: 67628 - DNA, 1050 bp, Oryza sativa
gcaccagccattctgatttgtactcagtttgcttacgttttaaatttcgaagaatcaactggtgggctgtaataagccctgttcattgtatacttgctgtacattgcaaaagtttcagcatatatgccgcgtttttgtgacatcttattattaccaaacattacagtcacatctcactgtatctctcgccagaaccccaatcttcaggctccggagggaaatcaattcaccttgttgtcatccttcagtatttttactgtttgtattctgtcttcctacatatatgcacatcagcacacatgcaactttaattagccttcgactaaatttagatgtctcaatcacaggctcacagccccaacagaatatagtaaacaattgtcacaggaagtgatataaatatcccaagaataaccctgcaaggcacaaaaagaaatccaaaatgatcagtcagatgggcacttgcattaatcagaagagaattgaaatacttctgaaccttaacagtatttggttaagaaacaaaccctgtgctcatgatgtctgcgtggaccttgtactcttcagcgtacacaaatgatgtcactgccagggggagagccgcctgcatgcatgtgaaaaattgtggtcagagaaatactcctgtactccaaccaaaataagttggctagatttcttaaattgtgttactactcgtattaattgatcacatcaaacgagggtgccgaaatactcctgtactccaaccaaaataagttggctagatttctgaaattgtgttactactcgtattaattgatcacatcaaactagaaagtactactctacatgaatactactcccttcgtctgctatattttaaaatggaggaagtacagctttgcaactaacttttccttcttggacgtacgtctcctcacttctacaagcgtgaacaatcatctttcactatgccattttccgttatctgcaactgaaatggcggctaggacaatccgtcaagaaaaaataaccctttttcgcgtaggcgtcctcactttgaagcatatt

SEQ ID NO: 67629 - DNA, 14365 bp, Oryza sativa
  unsure (1)..(14365): unsure at all n locations
cataggaaccacatcacaatcaacagaatctgcatatgagccaatgaaaacaaaaccctgcaaacctgagttacctttgctcttccagaatcgtttaaccactgaatatggtaaggatgtggatgtgtacgtgtggtcaagccaagcttcttgaccaaatcaaaactcaccaagttgttgcagctacctccatcaatgatcacacgtgcacgacgattgtggatgatgaagaaaatctgaaacaaattatggcattgcaacctctcagactgctgcacctgcgtgctgagcacccgctgcacaatgatggtcctgtaggccattgtgtcatcacgaccaaagacttcgccatcctcatcctcaacttctttttcctcctcttcctcttccacatcggaggtggtgatgtagccatcttctgtaacaacatatgcccgttgactagggcaatctttctgcacatgcccaaacccttggcaacggtggcactgaatgcgtcccgtcgaggcaacagatgaggcactcttggcgggtacctgcgaagaacttttacctgactctgctggtcgtggtggagatggttttggtgttgcagaagctccgaatgcagctggtcgcttgctcactggctgggacagcgcccgaaaagagacggccttgggcagtcccacagatggcgtcgtgcacagagtgtacatgctcgccttgttcttgccctgctgctcacgcccctgcaattccttctctgcaagtatagcaaactgaaacaactggttgacagagttaaattccttacaatcaacaatgttctgaatttcctccctcaaaccagaataaaaacgacaaatagcatcctcgaccccctccactatgccacagcgtctgacacccttttgtagctcaccatagtaatcctgtacagatttatccccttgttccaaacgcatcaatttcttgcgtaagtctctatgataagatggaggaacaaacctatcgcgcatagctaccttaagttcttcccaagtagtaggtagtaccccctcatcagataacccagcccaccacatgatagtaaaatccttgaactcactactgacttgtctaactctatgttgctcaggtacaaggtgggcattaaacttttgttctactgtcatctcccaatcaagttatttctcagcatcataatatcctgaaaatgatggtattttaaacttaaccttagcataaggatcatcgggcacacgattattattaccttgttggtggcgagtgccacccatacctgtgcggtttgtgcctaggcgacgtcgtagccgtgcttgccttgtagctggtccgtcaatatagccactcgaatcatacaccgtgtcttcaggatgagcatcgtcgtcaccactcacttcctcattggaaggtgtctccaacgcggcaacccgatcagttagcgtggatatccgcttgtccaacctctccatgtggttcaggaaaccgattttagtgaaggcatcttggacagactttgcaacggcctccgtgatacccttttgagtattttcttggagagttcgtagttgctcttgactgacacagtcagcaaaatcctggggactcttctcaccttcgttacctgccatttaaacaccaaaacagcaacaaacggtgaaggttatccctaataatctactacgcaggtgtagtggtgcctctcaacgattctcagcaatatggagtacccaaccaagctcttataaggttcttaccagcaaagcaaaggatacctggaaggcgtagtcagcgattgcagggatcaagaacttgtgctgtccagaagtaatatgtggagcatggaaggccaaatatatgtatctgagtggtacacaatccaatgacagatagtaatgctgaataaaaatcccaagtcacttgcccttagttgctggtctactcgtgtcctagacagtagtggtaacaataatggctcaaggaaaatgacactagtaaacagcaaagaaggacttgcaggcaagcttcggcgagtttcagcaaaaacaacaaaaccgaactggcagataagctcaacggagcgcgtcgtgagctcaatgcactagtggaaatcaacttttcttttttatttattttattttattgattttttttctttttccagaacacgaaaataggcacacctccaagttacagctcaatcggagttgatatatagcctatggaattttctgaaaccactataaacaaagtgtaggaacttgtgagctcgaacagacaattttgcaagccaaattttggaattttggattcgccaaacccgccaaaggggggagaaacggatgtaaattttttttctcttatctgaaaagttaaaatttgcctgattccgagtctgtatgcaaaagttatggctgtttgaagtttcggcttccggctaggttttccagaggggatataacctaatctattttgcggtggaattgggatatggtggcagcggagtttgtagggtgttctggtgatgcgtggtgatctggatgggtgtttatgatggcggaaatggctctcaaaagatgaactctaacacacggtgaaaggtggcggctagggttacaaaggaaaaacacacgactagactaaaacaagcactagaccagcaacaggaacttaaactaggactcaaactcaacactacggactctgaaaaagaatcatgcaaaacccaaaaaacctaaagatggcggcggtactaatatataaagtttagggtcatgcaaccccctctcgacgcaaccttaatgggttccaacacaatacacggcccaaaggcccaaatacggtgacacagcaccgggacagattctgggcgtcaacttgttcggtcgattcctattgactcagaaagaatttggacgtgggaccaaaaattggaaaggttatcttcttagctttccatccatataaagaacgtcccaattcgagcacgtatgcgacctgggcggccgttttagtgcagactggtcctggactccgaattgcacccgaggtcgaattggtttgggcctccaccttgacttggacgtcctcgatgatcctccatggctctaagtccttctccaagtgtctccttgtcccctccattgttcctaatcacaatataatcattaggtagcaatctattctcgaattcatacaaagaagaacataggaacgagctcacctctaaattcaattgtcgcgcacgagctcttgttatcggtccttgaatgaccgttggaggattgttgtgtgtatctgaggtagtgatgtctgcatcacccaggcacgaccaaggcacgcccgaccaactcgccgtgcccgcccatggaccgcacctatggcccatgcatgatccaataaggctcgggccatgctgtgtcggctcgaaggcacgatcaatccaccgtgctcgtccttgagtaagtttattttgcttccctcgtctctttgggcagtgctttatatgcctagaataagtctatttgcctccctcatctctttaggcaatgcttcatatggctgttttaagtctattttgcctctttatatctttgggcctactgatcgttgggccgtgtcatgccggaccggcatgacgtgccgaggaagagacccaagcatgatctaacggtttggccggattagcatgggcccgacaacactcgggccataccgtgcctggaccgagccaaatctccatgccgtggaccagggcgtcgggttatgggtctttttggccaactataccttaagacttcatcatcgcaaaagccagcacgctcgcgtgttcgcacatggcacgaatacacaaacacgcatatcagtaggatttctaatactgggaggactttttttaagccacataaaaaaagggttaattggatccatgccactacaaatgtgtcaaatcagaaaaatgcgatatccacttggtgccactgaaattttgtaaaattgtaaccatgccatctccatccacttttctgtcatccccgttagatccacatcctatcctccgtttttggcgtgcgcctcgtcaacctcatcggcttcgactccggtgccgatgccgaccggtagctctgcgcccgcgccctcaagcggtggcgcacggctcggtctcctccctcgtttggcgtttaaggagcggtggcggttaccaccagcgggcgacagtggtgaccaccagctcattagcttgtggaagaaagaagcagaggttgccgccgccgcctgtagagaacgccgccgcatggaggccgggagcacgaagtagagcagtccagcaacacctcctcgtcgtatctcatcgctgccactgcgcccccatgatctagctcgggatgcacgtcccgctcgccaccgccctcgccaaggagctctcctcctatcctgccctttccctatccgtcgtcgtgccctcctcctcctccggcgcaggcttgctgcttggtgtgtccatgcacggtgtctatgccgtagatcattgggatgctgagccgtgtcgagagggaccccttttggaagtcgctcaccatgctcactcactccgccgtcgtcacctacttccttagcacgctcccaccaccgctaagcattgggagatgaagacgagaaggagatgaaggtagcgtgacagaaaatgtgacggagacaacggaaatcgtgatggagtggcatggttctaattttagaagattgcagtggcatctacgtagtggcatttttttaatatgacatatttacgatgacatggatccaattaacctaaaaaaaaagcttggacaaacattactactcttgtaggcattggatttgaactcggctatactacaagaagttgctttctccggaaaatacttttcattgaccagtttacctagaaacaaaaaagtgtagaatacagtatgaaagcattgttgatgacatgaaaggtacagatgagaaactagttgctggactagctgttggtacactttagtgttgtttacattatatatgacaagttagttgtcaacaatggtccattgcgcacttagtaacaactttacaagattgctccaagtttcttaatctacgtcacatacattaacaccggtgacccaaaaagcaggatgaggtccgttctgacctctttctttaatttgctatcaaatgtttgatacccaatcttggagaagtttggtgctgacttgtggcaaatgctaggtcacaaaaaaaatgacttgtacgtagtttttgttctttagcagttccgcggcgaacggcgtccacagataccgtagcaatgccaaagcgtgttgaagctagctatagcgagttatcttaattaatcagatcgatcgatgaggtcgtaattaataaacagagaaagtactaaatattaattagcagctgcgtcgtcatgggtagcaggagcatgcgttcccacctcgatctgacaaatgaggagaaattgcaacgaacaaacataggagtacatcctagtgattgatcaatcatgcaaatgcgtctgactgatgacgtatcaagtggaaggaaaacgcggcgaaatttccacgcggtacatcgtcctgtcctacggagtagaatcctagtataccaccgttgattgatctttctctgtttaattttatttgtcgttaaaggggtgtttaggttcagggacgtaaattttggcgtatcacatcggctattatatagggtgtcgcatagggtgtttgggcactaataaaaaaatataattacagaatccgtcagtaaaccgcgagatgaatttattaagcataattaattcgttattagcaaatgtttactgtaaaatcatattgtcaaatcatggagtaattaggcttaaaagatccgtctcgtaaattagtcgtaatctgtgcaattagttttttttagcctatatttaatatttcatgcatgtgttaaatattcgatgtgacatggtgtaaaattttggggtgggatcgaaacaccccctaagcagatgttacactgagatagaaggtgagacatacttcctctgttccaaagtaagcaaacgtcgtactgtgtaaacacaacgaatctactagtatatgtcatatcatgttggtttattctaggacggggattattaattactacggagaatatccgtccttggaatattatatttttttctacacgaatccaaacaaacaactatacaaattcacgtaaaaacttaatgttttttttgttgcaacttgtaaaatttaaatttgaccttgcatatttgtggaataatttatcacatattaatatatcttgttaatatttttttaaaaaatttcatatccatttgaatgatattcaaataacgagagaatattctcacacgagtttaaaatagttttgttttaagactaaggctgcgtttgtttgggatggttgggaaccaaactcctccacacggaaaacggagcaatccattagcacgtgattaattaagtattagctaattttttttcaaaaatagaacaatatgattttttaaggaaaaagtacgaattaccccccgaaagtattgggtgagtacgaattaccccctaaacctggaaaccagtcatttttcaccctcaactatcgataccggacgaaaccccccccccccccgagcagcttcgcaagctgttttggtctacgtggcagtccagtcagcaattattttctttttaaattagtgggccccacatgtcagtctctcaccctctcttttacaccacacctctctatctctctccaaaattctctctcttctccctccctcacctcgaggacgacggcgggtagagcacggggcgacgaaggggacggcggagctcgagggggcggaggggacggcgtaggacggagcttgggggtggcgagaggaggggacagtggaggggaggctagcgagacaggctgggatgccggcgagcgcccgcggaggggatgcggcgagcgcgccgagaggaggaggcgggcggtgcttctctcctctcccccgccgtcgcgccgcgccgcgcggcgctcctctccccgaacgagctcgaacgcgaggggcgtagggaggctgagagatgaggaggccggactcccccgcggccgctgcctccagccagatcccagcgagcaggtgtcggggaagagtagcagggcacagcggtcgtcgtcgggccagaggtggtcgtcgcagaaacgacgatggttgggctggtgctactccnccgggtagtaagacgccacaccangaggggggggcggggggggatgactccgacgactctcccggcctcaccgccccctcgccggcctcctcccttctcggctcgctccctggcctcctcacctcctctctctctggcctcccccgctccggccgccctgctattgccggcatgcttcggccgttgccgctccgcccgtcccgctctaccactgctgcttcgcccccccgttctgcctacggcttgccaccacagctgctccacctgtggcttgccaccaccaccgctctggccatcgctctgccgtctcagggaggccaaggaggtgcccgctgccgccggcgcgcgagccgcagccgcctgcatctaacgggagagagagagaagggggtgagagggaaagagatagagagagttgatatatctgacaggtgggccctacccttttttcattaaaaaaacttgctgatcggactgccacgtagaccaaaaccgcttacaaagctgctggggggttcattcggtatcgataattgagggtgaagaatgactggttttcaggtttaggggggtaatttgtactcacccaatacttcagggggtaattcgtactttttcttttttttaaacaactttcgaatagaaactttttgcaaaaaaagcgcaccaaaatagtagtttgaaaagcgtgcacgcaaaaaacgagaaaaggggagttgggaaaaggggaaactaactgagcctaaggtagtatagtatgactgcattgataaatgttaccaagtaaaaaaaaaatactttaatacgagaacgataataatttaaatgctaaaacgacaattgaattgaaactaaaaccgacattctccctctgtcgcaaaatgtaacaacttatagcaaggtttgtatcaaaatataataatttttttcaccaacattcttttctcaatcaataacaactctccaccatttaattttttttacctacctccacttctgaatcaattgtagtttttttttctatttaattttatctatttctcatacggatggagggagtatatacgaatctaccgaagcggaagtaggattgaaaaaaaagatggtctctcgcttgagggtgcgtggagcctagagagaagaccgtgggttgacctcggcaagcgaacatgccgcgttgccatgtgatgtgtgtgatgcgaagccgaagcctgtgctctgctctaccggctgctctccctccgtggacgtggacttggtccggtcttccttcccttcccgggcggcctcgccagaaaagactccactccagcagtccagctcctgcgcccggtgggcccactagacttggctgatcgggaccgggacccacccagacgtggacgcgctcactggagtcctcgactctagtctgactgtgagttgtgtgactcggactcgctctctcacccgacccaactcatcagtcgtcgctttcagaaatctttcattagaaaaaaataaaattcatcagtcgtctcctcagtcttcactatactattcctattactaataacaatctcaaggaatattttgtttttctctatactattaggagtactatatataagggagcacagttgcagttagcctcggcagctcagctcgatcgagtagtgctcatccatctgcagattgcatcgatcgatcgacgatggaggggaaggccgccgtcgtcgccagcgccgctctgctctccacgctaatcatcccgctcctcctcctctcgcagcaccagccgcgcgccatcgccgaccatctctccgccggcgccaccgccgcaacgctgttcgacgccttggcgcgactcctcggcctgctcagcccgaggaaccacatgatcctgctctgcaacgccatcctcctcctcgtcctcagggacgccggcctcctcgcctgccccgcaccacctgcgcctgcgcctccgcctcgccaccacgccgccgccgacgacgacgcctcaccacctgtcgccgcgagttctgctgcttcctctcgccgccggccccaacgaccgaggagcagcgccgccgtcgtcgtctggcgcccgagcaagctcgccgtggtagacgtgctgcacgttgacgacgaggacgacggcagcgatggcgataggcggcggcgacgtcgtccagcacagcgccacgagccggccatggcgacgacgatggcgccgccgccaatcgcgctaccgccggcgggggaggagaaacagagctacgacggcctcgtcgacgacgacgatcatgtttccgcgggagcgatcgtcgtggtggatgatgatgccaacaagatcagctcccctgtccccgactccgatcaccatcgctactccggcgaggacacaaacggacgagccgacgacgaagaggaagccttcgaccagtgcggcggcggcgacgacgacgacgatgtggacgacatgaacaggaggttcgaggagttcatcgccaacacaaagaggaagatgcagatggagagcctccagctacagctagtcatgatgaaggtttagaacaataaataaaaaaaactttttttcttttttccctctctttccagggagaaaaaaaaaagaattgtaggagaaactaatagtgcttgtacttgtacagtactaccggctgcatgatcactgtacaaactttttggattttgttcactgatgaaattaaaaccaaaccgcctagtttgggaatggccgaatgagaacttggtcccaattttgatctcctatgattagagacaaattaattggcaataacgaacagagcatcccaagcaaaatacacaaagcaagtaaattcactgtcatgagaaacaaaaaatactatgaataacaaagtggcatttaaaagtgagtgaactcacatcttatttcacattaattgcctttttctttttagtatcacttcatgtgggattgtccagcaagagtccatatatgattaattgcacacagtccatttgctgtttgataatacaggaatcaatcgattcgttgtagaccttaaaacggcactaaataacatgatatcacatcaacgtgagacacaatcatgacagtttttcaaactttgcggtatgctaaaccacaaatatagctatattttttatttatcttttatcagcagatgaaaaataaactagcacgcgagctcttatttacatccatggatgtacccaacattgacaatacaaacatatctatggtcctacatgtgtacgaccgatggtttatatgagcaagaattaccgttagcttaaaaaacgtgcacaatagaaaatgagaaagttgtattttggagttaaagaagaagaaatgagatcatatggtttaattggctagagggcgacataaatctttttttttagaactacacaaatctaacttcaataattattttctaaactaggaagtgaggtttttttttgttagattacctttttttcttctaagttcaactagcatggtgacccgcacagattacgcggctagcatcattatgttttctcttatataatagtatatgtattttcttaatttattattaaaatatacttttattctaatatttcttatttttttaatttggaatgtctattatttcttaattgtactccctccgtcccagtatagtggacttcctaggagtatttcattatggaaggtatactcttcttctaatattatttatttttaattccgatttcagttatttctaaattgtatttctataatgactctataatcttcttttaatatttttttaattccaatttttcgttatttccaaattgtatttatatatgaactctaacctaattttaattttcttattttttaattctgatttttcattaattctaaattttatatcggcatggactctagtctcatcttacaatattccttattttctaattctgaattccagctatttctaaattgtctatatggactatagtctccttttctaatattccttattttttaattctaaatttcagttatttctaaattgtatttctatatggactctatttttctttttctctgatcaatatgagaatttctagaccgtgaaagcgaacgtggatgcttattttttctatcactttaataagttaatagatggggatgcaaacaatccctgcctgaattttcaattacatgtaatgcaacgcgaggcctaactcgatggtacttgaagggacgatgtgaagcattccttggaacatttttcttttcctttctttcttttaggatttcaatcatatgcaaaaataaatcatttgaccctttaggaacaaaagagtgacactactaaactcccaggttatttctatagattgcctcaatttatatgaattttggagggtttttaacacaaggtccaactttatgaaaacttgtttcatatcttttctcactccgaattcctttactctttcccttaattattatccaaacaacatatttgaaatcaatcatatgttttatgaataataaggatccgataagctatggcacctcaatctttttttaatttattcctgttttttatacgttccaaaaggaaatagttatacattatgcccagcgaattagacaaaaaaaaaacaatcgaattgcaaaaaccactgttcgagattcgagaaagacatagccaaccctaaaagatatatactggagtagtcgtgtgtgttttagcacatttacacgtggtcgatttcctagttaatttttttctctgtcttttgttaggaggaggaaaaaaatcgatatagctaagtagcgtcgacttgggttgactttgatgaacctgaccatacagatgtttggtgcatttgcatcattgcatgtatccaaggagaccatggatacacatgcctggtgcagatcgatacaaagatttgggctgaattctaaggaataattaattatttgttactcttataaataatgataaaggatttaccattgaacccatatgtcatagacgcatcttaaagtgacaaaaagttaaatgtttcgaattctaaacataagttcgcctatttttttatttatcgtgagcacacgtgtttcgtgtttaaaaattttctttaaaaacaataaataaatctaattttaagtttataatattttatatttaaatatacacatttcgttctccgtgcctcaagtttcgaacaaagctactaggaatttgtcctcttgattcgattggcaatgtagttctaggaatttgctgctcgcctgctcggggccacagagggttacgggctgggctgggctatgtctgggagcatagcagacaaggctgcaggaaccaagcagcacagcatcaacagcaggttggcaggcagcccatacacagcctggcaaattaagtcgcaattccgtcctctcgacctgtttccgagagcacccaaaattccatccctaaaatttatttttttaatcctaaacataattttagatgtgaaaatattaatctctccaaaagatattttaaaattaacttaaaaaagacccacccattagtatcaacagaaacacaaaaagaaatcgctccaccataccttccctacgcacgatctcttctcacgtgtcatcctcttcctttgctgtgcaaaaattgtgaacgagtgcctcctcacttatgaagaacgagaaagaaggagaaggggattccaattttgagacacatataaggaaacgattggagcaaggttttttttttaagaaaaaaagcccaaatttttggattgggcttcaattagggtttgattgaggccgttcatattaaatttgagttgtttcatacaagatttgttcttaaaaaaaacatgctcactcaagacactaataagtgatgttttagacgtcattaacacataattgggaaaaaatatgtggtagaaactatatatatattgaaaacctgaaaactaccattagataaaaatagacatatgagatttgtccatgtcatcacgagtaaaaattttactcgtagatttactctcatgatgatatggacgaatcttagacatccatttttcttagtttttcactacatattttttccccatataatttgaaccattaactatatcttatagatctgaatagtttcataaacaaaccataatattacaaaagctttggttacaacatttttggtcatgttattttcatatgcctaaaacccatgttaaaaatataattacagtcaaagttatctcctattaacggtatggagtttaaatgatgtatttatttgtaactgaagggagtacttgaaatatataggggtagttcaaagtagtaacctgtttgttttaaaagtttttacagtcattgagaagttattggaaggtatcatattttctaatgtaaactccggtactagaaggttccatatttaggtacctcttgttatccctcgaagactgtaaaaatttttatttgttctaggaaagtggcatggcggcgtgtttgttattaatttgcgatttttacaaaatcttttcttattaactagataatgctttaaatccattttaactttttaatagtccatcgattggtttgtgcccttgaataattctcacaaatacttcatacaatcagcattccgtttcattagcacaaaagaacactcttttaaataaaacattgtacaaagtcaaaatctgatacagctttaaattaaaagaaaccctgattgcatacttgttttcatcatcataaatacaccaagttgaaaacattacattacacagtaactctacacacatggtactcagctagcattctcttgttcaaatttacacatgatgatataaacgaaccgatcatgcatacacataaatttttttccttttttttcctttttcacacaagaagactcgtggcctcatcggttttggttcgtcacgtcacatgacgctgcagccggccggctcctcgtcgtagtacggcggctggtacgggctccggccgccgtacccgtacgccggcggcg

SEQ ID NO: 67630 - DNA, 998 bp, Oryza sativa
tctactataccacgaaaaacaagattttctttaactgccttttcaatgctgctacgtactccactctctgctagtactaatctctgccggtttggacgccggtttcgcaacagttttgacgcagtttcagagcatgcaatgcgatggcatgcgatgcaagcatggagatcgcttcagcagttcagctaagccatgtgagagccggctgcagccgagctgacgacgagagagagccgaacaacaaccatacatactctagtccaaatggtcgacatgattgcgcggcgcggggaagaaggggatgatcattagtaattcagaagaccaaaacgctgttcttctgcgtcgtcgctgatgatctgaatttctgaatatctgatcaatgctgtttgtctgtcgtctgttcgcctgcgtctcccgtctccgctgccggcggtggtggtaaatgaaagccggagccatcggagagcgctctcgatcgatcgatcggctggtcggagctgaggacgaagacgttttacttcgtcatcgatggcttcgcttcatgccaatatcgatcgtcgatgcccgatatgctgccatgccatgcatgcatgacaccatatgcaatgcgcagagtctgtctaagagaccattgtttcatcatccgctgaacagttttgagatctgcagtataagaacatgagttcttggctggtgcccgtcgttttcgttggagcatgttggttgttcgtacaagttcaaggcttttcacaatgctaccacaatgatggttatggaaaataaattatatgtatggcaggactaactacgattaattgatatcatatcttaagactcctttgaaacgcagaaattcaaaaattagtttgtttcctacgaaattcctctaaaatgcctccatgccaaaaggggacgtaatttctcgagttatgtcaaccttacaattcctatcgtcgaaccatataccctccaatatattaatcctcaactcaaat

SEQ ID NO: 67631 - DNA, 1640 bp, Oryza sativa
acattggcacagcgttcgttcgtaagccaggtcgatccggtggtttttcttgtccatggttttggatcatggaaaaagacaggtttttcgtcccagggaggagagaaactggaaaggcataagctggccggccctttctatgtatgtaacgcattacgcagagatggaatcgtagtttttcccgtacgttaatggtggtgacgcactgacgccacttgggatctgcaagcgcaacaaaagcgcgagttgtcttggtgctggagacactagcgcaggcgcggctagctctcgctgtgctagctagctgtactgctgtatgtacacatgatgagctatacgtcgtacagctctacagattaattttttcactggctggattccctttttttgcatacagataatcaatgcgatgcattttgctccgcgcgcgtgcatgttattatggcaaaagtattttctacccctaagtgccatggcatcacctaggtgtatgcatgcaatttaaaaagttatataaaaattttataaaatttgataagatagattatgataatataagacactatacaaacatgcaagtctaaattcgatcaacaacatatgaagaaacaaaaacaacaaattttatctacgctgtatgggtactattcactgtctgattttattatttttgtttctctagttgtaaatcaaatttagtcatacatggttatgtatagacttatatcatcacaatcgatgctactaaatttttttaatttttttctataactatttgagtcacatataattgatggataccacagtacttaggtgtaaaaaatccttgtccggaaggtcacctaaatccttgtccggaaggttaggcacaaatgcgtgcaccgtgcatcgatcgatcatcagtagcaagtgccaggtggtggaaaaaaagtcataggaggacaatctgttcgtccttaggcttttacgtaagagtatttgctttcgtattttcagctcatggtccgatgaatcatacgtttgatccgtagccacatgcacgcgcgtgttgtcgtccgtcgttgagtggtgaatcgcatggtcttcgcgaaaatcacatggaatggaaatgcatgggaacacatctaaaaactagccagcgattttcccatgggctttgctcagttttggttgtaattttgcaggacgatttagctatatgaatgtagtagtacagtgttacgacgatgaacgtacgtgaacgtgtacgcttccgtagctagcggccaagtttgacgaggaggagtcctttactataaccgcaccaaatgtgcgacctcaaaaggtcgcaatgcacgcgtgcatgcaactcgctgtgccatgttagaccaaaaattaattctgaactaaagtttttctgtcacgaccagaattaatcccagtaagagctggaagaagctagtatgacgtttcgctcaattgggtcaattctgttttctctcccttttttgtccaacgagactgtaaaaagtcactacaggagtattctactgcttcctggctgctgcgtcgcttgctgctagtggtgaaaatgcgttggggcgtcacttgctgctagtcgctaggtctgcacttcaaaaaagcacaccaagctagcagcg

SEQ ID NO: 67632 - DNA, 4983 bp, Oryza sativa
agctttttcagcgtgtacctggttgaggttgtagggattcttgcgtccgtgtcgccgctgctcatcatcccaaaacaacagtagaaaaatcatggtgaatttggatggatgtcagtaacttcttcagaaatggaccgatgacatcgatcatgatgaacaaagagcagagtaatcagaatcacatgtttgacttggcagatcaatgttaagagttcccctagtacttagaatgttcatggccattacaggaataacatttcttgatgacagaaacttcacctgtaaatccatatccggagccctgattgagtgagtttcttgacgattggaaggacagtcatgtcagagtcgttccatgctcggttgatagaattactgccaaaatttgtcacatgaacaatgttcagacaccacaattgcatccctgatcgcaatataaagcatatttttgagcagagataagagattactggcaaagggagtatgctccagggatattggcatgcagagctttctgaacatctttacggttgaaatattcagtcgcgtacgtttgcgagcatggatcatagcccattggtatcttcaggaaatcaaacttttgcacatgaaaatattaaaaaacatacagacacacattgatcaacgatcgtacacatgatatgcagagagaaaatgactcagaaattttttgcttagctattactgaagtcaaggttgcttacacggctgctggtccgtccgatttgtgctgcaaacgacgagttgaagtttgggtatccgagctcgcatcgaggggtgtaaaggctgtagatatctatgatgctgtagagagcgttgaactgatcgattgcagcgttgcactctttagacagatcaaccaaactgaagttgcagaacttctgaaagtcactgtaaagtttgtctgagatgagtgcgtgatgccatgcagaatcaacaattcctagcaaatccgtgtcaccatccatgtaagcatttcctatctggaataagcacaaggcaaatgatgaaattaatataacaaatcaattgttagtttagttttttctttttctgaaaaaaaagaccaattgctagatgcagccatgcagggatattgcaattggggaataccatgatgcctttcaagtttatataattttctttaggtgcaatcttgttctgatccacaatcacattagcaagctggggaacgtaatgtcctgcatggtggcaagaaatgttagttaaacatacaaagattagtacacatccatgagcaaattaatcatgatttagtataatgagcaagtttggtagacctgcatagctctctccagctatgtagaactccttcattttgtgctgagggaacctctggaaccacctgatcaggaaagtgtatgaaccatatgctgcaaatcattcataaaactcatctgttatggagtacttctttttctgaatgtgagtacgccattatacagtttatgtttttataagataatagaaatggtttatatctcgggtctgtgtattactagttatgtgattgtcaaatacataccggtggaattgtctcctggtggatcttttccaaaggatgtgttggtgtaagaaaacccaacaccagcaggagagtccaggaacagcaaattggcaactgaaaaagtcaaaaagatcatcaagtaaacttcacaaaactaaagataattttactaaactatcacaaaactatagaaggtgttgtatcacaaatctacagatttagcgacacgtttatcataaaactacaaatttaaagttaagtatcacaaaactacatatttaatattaaagttatcacaaagctacagattttagagtttaaatatctagcactactatgctagagttgtaaatgttacagttttgtgattaaattgatactaaacctatagttttgtgataaatttgctaactaatcttcatttattgatactccatcttaaatctgtagttttgttaaagtatctgtagttttgttaaatttactcaaaattattatatagctagtgagccagccccatttccaccactgtgttttgatcaagaaaagattgactgtgacatgttactactggtttaactactgtaattaccttggttccatgcgtatggattcagctcaagttcagccacatctttcttcaccagaaatggccctagctcctgtgcctgtccaaacccaatggaagaacatccaggtcctacaaaatgcaatttcaaacagcacaaggttacacttttaagctaaaattctctcttcaaatttcagcagttagttttattaaccagaattcccagctgtcattaattagagatagatgcacttggtaattaacctccatttagccacaagacgagtggcttctcgtcaggcttgtcagtggcctccaagaaccagtagaagagtgccttgccaaggtactcgtcagtggtgacatagccggagtattgcctgaattccggcgagtaggccggctgcccgggcagcgacatcacgcggtcgagctcctgcaactccatggccgccgtggctgatgcatcgaggctgcccgtttcaggccgtgcagaagcagctgggccacacagtgtcagtgtaaccagtgcaagagagccaagtaggagtagcaagcaaggtgacgaagtctgaaccttcattgctgaaacctgaatgtttctttcacttgggttttgcaagacagtgtggcataggaactgtatatttataagtgtgcagccggcctgtcagagttgctatgtactccctccatccctaaatgtttgacgccgttgactttcatatttcaccgttcgtcttattcaaaaaatttaagtaattattaattctttttctatcatttgattcattgttaaatatatttttatgtatacatatagttttacatattttacaaaagtttttgaatggttaaatatatttaaaaaagtcaacagcatcaaacatttagggaatgagggagtatgttcgtgtgtggagacaagtaggtcgagccatcggccggctacaaggagtattatttccgggcttcattatcatgaggtgcattatgtagtaatacgtatttatctctcgaaacaaagaaaaatctgtatctttcagcggctttgaaggtaccggtattttacagtattaccaattcagagaaggtgagcatatgaattgaagaacaaaagtatatgctttagttctcaatcagatcctagaatgcaaagaaacctgacgaatgaaaaacgtgtttgtttctttttcaataatggaattcattccgacttttgtttcacataagttttagctaattattatagagattacaaactgaacgattacgggttataaaattacagtttaattaattgaaaaaagaaactacttgtaataaggatagagaaactgcttcgattaaaaacgattttgttgcatcattttgtgggctgagctgtatatgcctccccctttgggcctatgtttgccggctgctgcatcttggacaggcgtgcttgcaactgtccaattttttctcttcatcgtcgtcgcttcctcatgtacattttttcaccctcttacgttgtcattgtttgattgtttgatgtatgactaataagccgtgaaaatataaagaaaaaaaaactaatttataaaaaaaacttgtatatatgtgtgttcttattagcgattttaaaagcgaatgttagaaaataaattaagattaaaaacctcaaaattaactgaaattaagtttcagaacctaaattttggttgtggtcaataagccaaaagcctttgaggataattgtcccaatgagccgagttattaccctgtctgataggcttagtagttaaggatgatgagaaaaaaaaatgtagtgtccatcgttaaattatgggtggttgggaagtggaaggatgatagggagtaagtttgggtaaaatttactttgggatactttagatttgcgacatttggggtagaacaatttagttctagagtgattttatattccttgagaagatatcaggagttaacacattttttaatgtaaaatttaataccttcttggtactaggtagtatgaaaaattgcacaaaaatttttactcaaggataagttctaaattttaaaacaacttttgatttcggtaattaaggataagttctaaatattgcaaaatatgttcaaattcagccaatatttattcaaaattaaatcttgcacaattgctcaagggtaaatatgtctttttgaatgttttatcctatattagaaaagaaaaataatgattcgggtatctttaggcaagtgatcacaaaactaatctagagtgttgttgacgaccaaaattggtaagttgtgaactaggttcggcatagggatcgaggcagattcaacaaggagatggattcgaagaacagagtatgcatcggctacgaaggcatcggctgaagtatgcatcggctgagatggatcggacagaggacagccaatacagccgatagaggtgatgcagccgattccgatgacaatggtttcagagatgcttctagaatcagttggtgtgcttcatgaggattgccataatggagataaagctctcggataggcaattgtatctattaattagaatattttgtataatttccttatatatatgtttggcaaaagtctgccgcaaagatttatgatatcttagagtttgttagagataagtgtcgtgtccggcaagggcatatcttgtatctcgggtataaatagagcccgaacccatgtaatcaattaacacagttcaatacatctcggcgcatcgccaccctttttactttcgttttatttcgacgagttcttactttcgggttgaactgcatcgattcgatcttcaaccagaggtaaactgttatggcggcttgcgttctcggggtta

SEQ ID NO: 67633 - DNA, 746 bp, Oryza sativa
tctgaccggccttctgtcggcgatctgaccggcctatacacggcggtcagaccggcctaattagaggaaaaccggcagactttcaaactttggcaattttctctattttatttctaggtgttaaatttgggtgtaaacactaacctcactttagtttcaagatgacatgaatcgagcggtcaagtgtaagcaggcaaatccgcaaacatatttataatacaaataagcgggtagtataagtatgtttgttggtctgcctacttgcaccattgagccatgtcacaggctcacagcataagctattatgaatctatgaaacatgagtagattttgttggaaatatagtcattaatcggcatattttaatccaaaaagttaaagcaatgatcatggcataagcagtgtagggtgatcttaacataaccagtagcatactatgcgcatcatgaatgtcaggaacaggaacataccagtaacgcaataacatgctagaggcatcatgtagaacaggaacaagaacatagcgcacatagtatagcgatagcgctaacaatgggaacaagaatagcgctaacaacagtaggcaggaggagaagagtataccccgagaatggccctccgctggatggtgaggcaaaattgcctccgttgttgttgtcgttcacggcacctcctggcgcaccagctccggatccagctcctgtcggcggcgtaccacctccgccagcagtagcggcggcaactcc

SEQ ID NO: 67634 - DNA, 6139 bp, Oryza sativa
cccttggtaaactgatctgccagatttctagccgtttggacatagtccaatgctatcactccggagtttttctgctttctgacagatttcagtcttctcatgatgtgtctagatgacttcatgttgtcctttgaattgttcactttaataatcactgtttaattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacttatccacttgtggcttttatctcatcagcattagatatccagtttgagtcactatacccttctagtacttttggatacccggtatagtgaattccatagctcatagtgccctttagatagcgcattactctttccagagcctgccaatgatcatctcccggattttagacaaaccggctcagcttgcttacagcaaatgagatgtcaggtctcgttgcgctagccaagtacatcaatgaaccaatgatttgagagtatctcagttgatcccttactattcttcggtttttccttaatagcacgctgggatcataaggagtaggagctggcttgcagtcactatatccaaagcgacttaaaaccttgtccacatagtgggattgcacaagtgtaatcccaccctcatctcctcgttgtagtttgatgttaagaataacatcagcctctgtcacaccctgaaaattcaaaatttataaattgttgtttaaatggaatttttagaaataaatttaaaagcctagaagagaagatctaatttttaattaataaattccaatataaaaaggggccagataaaatttcattaaatactttgcttaattctataattcctagatttttctgggatttatttgagctaagaaagtatttttaataaatggaattacatttaagaaataatttaaattgaaaaaggttttaaaaaaagtcttttttggctttgggccgaaagtcggcccaaaacccctctctctctcctcggcccagccggcccagtccgcagccgccgcgcgcgcgcccttgctcgctgacaggtggggcccgcttgtcggatccatcgtcttcgtcgcgccgccgccgccgtctccttccaaaattcggtcgatcctttccttctccggccgaatcaatagaggggaaacaatctccgggatctcctctaccttttctcttttggaatcatcctctacttcggtttggaaatcgatggattcgagtttgtttcggattcgttcttcccgaagtttccttcgccgtcgccggccgccgtgggcctttgccgccgctcgctagcccctttaaaaggacccccggtgtctcctctacccgccgccaccctcgccttcgcctctcgtcgccggaagagctctagcgccgtgcaatctagcgccgccgtcgccgccgtcgctccagccgtgcgccgccgccgtctcggtcgtcgtcgtcgctcgggaaggccaccgtcgtgatcgccaagttgtcgccgtccttgtccgctccttcgccgccaccgaagaccgccggagcaccgtcgccgtcgtcgacccgaaggccgccgccgcttcttcctcgtcgccggcgccgtccgttgcccttccgccgtggttttggtcaccggtgagttcgtcgcgccgcgctctacgtcctggtgccctccgttcgcgtcctcgcgccgtcgttcgccggcgggcttgcgccgcccgagccgccgccggtgatgacgtcaccgttgacgtcatcggggccgtctgccgtgagccggtcgtgggccgaccgatctcggccgtccgttttggatagggttgatctcggccgtccgttcgcgtgaaccgccgccgtgtgcccggtccaccgaaaccctagcccgctgacgcaataaatcctcttttccttttcaaaaataattcattattgcgtcataattcaattaaaatcaaaataagtgttttaatccgattaaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcctatttaaagctattgtttccattcaactattgcatttattttcgaatgtcactgggtggaattaacctattgtttgttatagcccttttgttcttgattaccttattccttgataccttgggttattataatttgactagttgagctttatttatattggttcaactagatattagatataattgcttagccctgcttagaaacattagctcactattgggataacttatgactcactatgatttaatgagggcttaatgatagttcacgatggtcaatcgtgattggttaattaattaatgtgccaactaaaaccggataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacctctcaccatagtaaatgatgctataattggtaataaattgattagctcctggtttggaatggtacattcctggtttggagatagaactgtgcagccgggatggttgttcagaatggttgggcctatacaacagggtatgttgtatagcgttggattaatattgtttaattacttaactgtttttttaaattctcaaatgtttgctaaatgctgtttatgcaaatggaaccatattatgccatcctttgttatcctgtgcacttgcatatttactgcgtggcttgctgagtatgtcatatactcaccttgcaatcattcatcagaagaagagttctacaatgaggctgatggtgtggaggattaggtgtagccttggtcaagctgcctgtggagtggagccgtctgtgccgtttattttattttccgctgcttagatttttattgattgagaggaactatctcctctgtaaagacattttattcgcttattaattagagtaataattgtactctattatcaatttgttattgtgtgtctcggctgattcctggacgagggttcacacacatgtaagcgtttggaattttggatagaaattccgggcgtgacagcctctcccaaatccttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgatcacaacaaagcctgcagatgtaagcgtggtgtcaaacttttcatgccattgcttaggtgcttgcttgaggccatacaaggatttcaatagtttacacaccattccctcctgaccttctagtacatacccgtccggttgatccatatagatcttctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatctacgaggtatacaatgtagtcatctccaaaggattttgcaaccctttgtctcttactcttgcgagcatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctggactcaaaaattgtaccagcatgcatgtcgggtactccagagtttactattaagaatctataacccacactgtggatagcataaccaagaaacacacaatcaacagtttttggtccaagtttccgccttttggctataggtacatttaccttggccaaacagccccatgttcgtaggtatgagagatttaacttcttcctttcccattcctcgaatggtgttacttccttatgcttcattggaattttattcaggatatgacacgcagtcaaaactgcctcaccccacaattccttggaaagccccgcagtgtctaacatggcattcaccatctcagttagagtacggttctttctttcggccaccccatttgataggggtgaatagggaggcgtcatctcatgaataattccaaactcttggcaaaaggatgcaaactcattggaaaaatactccccacctctatcagacctcaacagtttgattttcctttgaagttggttttctacctcagctttatagattttaaagtaatgcaatgtctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagacgccttgtgaggcttgcgaggttgtttcgattgaacataagtatggcacttggaacctttgaccaaagtgaattttggaattaaactcatgttagctaagcgcgtcatacacccgaaattcacatgacagagtcgcgaatgccacacattagactcatcattctcgctaatatggttcacagcattatgattattatacatgtcattcaaagaaaagcggaacaagcctccgctgtcataaccttttccaacaaaagtcccatatttagaaacgacacatttattggactcaaacacaagtctaaaaccttctctacacaatagagagcagctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctctgccctcgctaatgaccatgttggtagacttcctgtctttgcgctcaggacagtccttggcccaatgcccagacttgccacacacaaagcaatctccctttgcctttcccttgcctttcttcttaaaattggttgcagccttgggtttgacatcaggcttgactttctt

SEQ ID NO: 67635 - DNA, 4301 bp, Oryza sativa
gccgccatggccatgctcggcgcctcggcgcggcgggccctccatccgcgcgagggcgccggcggcgtggttggtggtcgtcaccaccttcggcttcctgttgtcgtggtggtggtggtggcggccgtcgtccatgtcgtccgccatctcgaacttgacgtgcttcttgatcatctccggctttcttccgccgcagccgccgccgccgcctgcgctgccgtccttcccggccggcttgttggcgtgcgccttggcgccaccgccgccgccgcctggcatgggtttggcaccaccgacgacgcgaatgtcggtgatgaccttgccggcgctggagcagagcctgtccgagacctcgtcggcgtcgaacggccccgccaccgtcaccgtgttgttcttctcgtcgtacgagatggccttgatgctcgccttatctacatacacacagtgattaattaggccagttcatggatcaagaaattacagtgtgattaatttgggaactaaccttggagcttgcagaggacccttctgatcttcctgtagcatctgtcacattcaagatccaccatcatcacaattgtagacatctgaggtgagatcaacaaagcagagatacaacttgttagtatgacgacacaaacatatgtgggtgattaatcactgtaacaagaacactagaccatcatgtccaatgagaagtagagaacaacagtaggcaatgctaactaagatacaatttaattagcccttttaacctgtctgaaagtatagagttctatgatggtactactattctttaagataagtagaagaatttttttttggaaggttagaaaagcagaggagtttctttttccctttctttgaaggttatagaagcagaggagtagacatcactacatcagtgagcattaatcctagctatagctaactcaaaactgattgaggattacagctgatttgcattgcacgagccacacatatccattcccctgatgtgcagttaggttgttggtcaatttatctttaaagcgcagcacaaacagagggagaaagaaagaaaaaaaagtgtcggtttgcttgctctctacttcacttgccattatcctttaagctgtcccgacaaaaaagcactcacacggtcatacatacagtacttcaaactgaacctgatactctagttgtggaatcagaagttgataactgccggaattcccaaccaagatgagtcgatcgaatcgaaatacaaaacacacaagagatttaattaattatatattggacgagaggttgtacgtcttcactctgcctcagctgtaagtatgctactgtatatcatctatccatggaagaacaagaagatgaactgggcaagtactactggcacacagagccgccattgcagagctgaatttggaacgcacaaaccgatcgatcgatagacgacagtgcaaatttgcagcaaattaaatcaagaaatccacaagaggaaggcaaccaccaactcataataatatacatcagggagttaacttgcaggtacctaccttgcctgccatggattattctcccaagctagcttctctcagtcacctcgctgttggtgagacgagggaggaagaagagatgaggaggatgacaagaagagagagaggaaatggtagggctcgctttttaagctgaagagaaatggcagcacagcgcagcggatgcacgcggcggcgcagttgcaagcatcattgcgcatgattagtttacgctaaaccaccctataaagcgtaaatttcagaggccacgtgtacacggagacagatcaagataggccatcgccttcgtctcgcccgttacatacaaccagctgcgtgtacgtacgtagtacgagccggagctttatacatgtcggctacggctcttttgggtgttttttttttcttttgaacgatcagacacaattcgaactactgcctccgtttcaggttataaaactttctagcattgtccacatttatatactccttccgtttctaaatatttgacactgttaattttttagcacatgtttaaccgtctgtcttatttaaagacttttatatgtatacatataaatatatttaacaataaattaaatgataggaaaagaattaataattacataaattttttaaataagacgaacggttaaacatatttaaaaaagtcaacggcgtcaaatatttagaaacggatagagtatatggtaacgaatcatagacatatatgtgtgtctagattcattaacatctatataaatgtggataataattgaaagtcttgtaatatgaaacggaaaacggaggaagtatatatgttgtatatccaccgtacgatgccgaaattaatatgtccccatggctaggatgtaccgtaagttatccatgtaggcttcaatacaagagctcgttctaaacagaggcgggaaatggctaattagccaatagccacacatgaaatgagaaatatatgataaatttaatatgactccattataaagaattaaaaaatgtatttgtttaattttttaagcaacttctatagaaggttttcgcacgaaatataccgtttaacagtttaaaaaaacatgctaatgaaaatcttgaaaataaaatttaaattatagagcttgattttagagttaattttaaggtttctgtttatttttcaacttttaaacaactagaacatatataaattaaagttttactattaatggttgcataattcctttttcccacggctatatcaaccgttgatgaaatgatcagagcataattggttgaacccttaattagacataatcgaataagataagattggatcaaacgcgggttatggagacaaaaatgccgagatacaggaaaagcatgtacacgcaatcatctgttcatctgccaccctgaattaaagtaactgccattgagcaacccatcaagctgacaaattaaattatgataagcactactccaaaatctttgtagtgggcactgacgtcaatggaccaattctactactagtgttgacctgtggagtggatgctagtagctagtaggattaggaagataaccaccagaacatcaatagaagaataaaattacgaaaaagaatgggagaattatttaagagaaaattggttccatgatagtaagtactacctccgtcccaaaataagcgcagccgtagatatccgtgcccaacctttgaccgtccgtcttatttgaaaaatttatgaaaaatttaaaatatttagtcacacataaagtattattcatgttttatcatctaatagcaataaaaatactaattataaaaaaatttcaaataagacgaacggtcaaacgttgaatataaataatataaaactgcacttattttgagacggaggagtattaattaaagattggagtggtgcaggagccagtaggcatgcagctttcatggggagcggtctgggggtgtgtgttgttgggttgttgggcactaattattatctttaagcctaacataccaatctatctttgtcgttacgattaattaattaactttgctctatgcctagtgcatatttatgcaggagtacataattacagatcggtgcatttgttctactactagctagctattgttagtgtcaaagcctgacgtagcatcgatttgatgtgccggtgccgtttcgctctcggatgaagacatacatgaattctgcaaattttaccgttgatgcggcctctcctttgaaaaagctaggaactttttaaaatttgagagcaagtttaaatggttttcaaaaattgccacaaaattggagtgaaatttctgcgtgtgtgtaccacacaaaagcaccagaccatcaacagcctgcatgatgaaaagcttcaaccaaactgtacgaatctcgcacttgtagcagcagccaacaaacctatgcatgtagctggactgtgtatagtacccaaaaacctttgcttacaagcgagcgatccaacacgtcttgtgcgttgctcaacgaccgctgcttttgtatggtgtagtatgtacacccatctctgatgctatcacacctatgcaaagcagcaaaggttacagcttctaacatgattgtagcagctgtgcttggggcttaattaatcacctctaatgtgcttcaatagtggggtaacagcggattagctttcacatagcaaatatatttgtttacgagtacaataaaacgttttagcagacgatactacattcatgctgccgaatatgctgagttggtaaaaaaa

SEQ ID NO: 67636 - DNA, 24410 bp, Oryza sativa
  unsure (1)..(24410): unsure at all n locations
tatcaattatttttgcaaagccgcaaaatattatctaactctacttttcatgggaatatctaactattgttcctgtgagatctgatgtctaaaagggcatttaggtacaattgaaacggcgataataaatattgtaagagcaatttcaaatgtgtttatgttggtgactttaaaacgtgccattggctatagcctaggacaatgagatggattagttgtgtttgtccaacattatgtcagtccacatcaaggaatctttggatgagttgacatacagttccttgtattacttgttacttcttggctagaaacttggaatctgtgccactgtgccataccattcaagtaatgtatagtttagtcctttctaatgtgcctcattatggcttctattgtcacgggctagtataatagatgaggaaacgcaacataaactatatttgaagctggttacaagatgtggccctggacctcgatggcgtggcggagccatcataggcactgcgtggaagaggcaggacgcaagctcagcataacctaatctccaagctaagcaaaataggccgattttcagcttatacaatgctgttgccagccacattattctcaactgaaaactaacaagcccagaaagataaaactaactcaatctaatcctgaatttgtggtgcctcattgttgccacatttgatctggtgcagacgataaaggagtcctcacctgacatctgtatacacgccgtcatgaccatagcttaactattgagctcactaacataaatttcagttcccctatcctagatatgaaactgcaataatgaatatcatatattacaccatttattattcctgggcaattcatctagtcatcattgctcttgtcattctttcttaatcatgactgactagctggtgtggtttctactgcatcaaatatcaaaagcagcattaacatttttataatttataatgtaacccaaaaatttaggtttcagatgtgcagctcaaccattttcaaggtaaaacctgcaaaacttatcaaacgaaaccactcaagacacatgaaaccatttttagttctttacaagagatctttgacctgtgtccccagcaacatggattgatagagcatacgtcactctttggtctgagtaattatttgatgaacctggtttggagagaaactagaagatacaaagtctggcacaattggaagaccatgcttgattttttctgttcgtggagctatgattttgataaagaactacaactagcaatttcagtgataactatactccaaactttgtcacatagtaactagagatgccacaccaatattttcttttgactcagacatcactgaatgttttttttcttaccgaggttcagttaaatttatctccactacagtatataaaaaggacctagtggtggtggcggtgagtctgtcatccccctaccacctcatgagttgcctttttcctaagagaaatagtctttccaatgtagaactatttgtctactatgatatgaattagtttcttttttaaaattcatgccatcagtttgtttaggtctttggtttttccactacattagtgtagtttcctcacatgaatctgtaaggcacaatagtgacaggaaggagagagatggagcagattggcactgaataatgagcaggtaaatgagcaatgacatggagaagaaacagttcgatggatagacagaaagttggattctattgatattagatggggatgagatgagagatgaaaatgataaaaaaataatacatatgcagattaattgcagtttaagaataaaatgaaaaattcatagttttagatcaagttattgaaaaaactatcacgcaagaggtagtgagaaaaaaatgctcaatggaatcacaacaaaggcagctataaattaaaggtcaccaacattagtgtagtttttttctttgcgaaaatcaagcctatgtaagattccgtactgtctgcaatggctataaaaaacagagaacagaacatcaacaaagaattagctgaaacatcaattttattgttaccaataagtctaaattatcctaatggactgtatgggtgagagggtttttctttagagttagttcaaatttgaatccaaatccccctatccaaaacaggactaaagaatgagttgatgataaagcatcatagttctttactgctaactcttttttttgttgacctttctgacctatcatggtcttcaagattacttagagtgggtatatatcaaggtataatcatgaaaagtactttgacaacaaattaagtgatacaaatctcatacaacaaatctaaataactttaaacatgtctgtaactagaatggctgacagctcagattatagactgcgaagtaaaaaatagaggtatagcagatgactaaaaaaagctcccaaacctttttcacccgtttatcattgtagtcgcaatttagattctattaaacagctattcataatttaggttctattaaacagctattcgtaactcaacagagccactgcattacctacaattaagtttaaataggagtaattccttatcggcactatgaacaattagtaataattacctacaatcacctacgggtacttgcatatctagtcgttgaagctaaaactgttaaccaaatctcgccatctctaattggtaattactagttatggctgtctgatttgattgagccccatggcaccacaaacacagcacagactaaatcacacctctagttcttccacatccctaaaacacccgcgcatcaagattacaagcctagataaaggtttaaacaacagggagaaagaacgagagagagatggccgccgcgggtgacggggactcggggaggggagagtgtgttttgggggcgcgttaccccagtcgtcgtcggcggcggcagcgtcatcggcggtggggcggttcaggtgatgcggatccatgagatgcaaacggacatcgaactccggacgcctcagggcgtgagagcccgagctgcgaagcttcttcccctcaggtaccggcggccggggaggaggaggaggagggcggcctggtgtgtaggctctgcctgccgggtgccggccgccggcgtggaagaaggccggtgccggctgcagcggcggattggcggcggatgggatgggagtagatggtagtgaggaggggaggggaagcaagatgagatgggaagagagactgctggaatttggaaaccgtgggtcgtttccgatttctacccctggctttgttttttctgttctttgcggattcaatttttaaatgaattttagctataatttacagcccgttcacctgccttgaggacttatttcaagtacatatcatattatatcggatgtttggatattaaatttaaagtattaaacactaattacaaaacccattccataacattggactaattcgcgagacgaatattttgaatctaattacaccatgattttgacaatgtgatgctacagtaaacttttgataattatagattaattaggtttaaaaaattcgtctcgcggattagctctcatttataaaattagtttttttattagtctatgtttaatattccaaattagcgtctaaatatccgatgttacatgggctaaaaagttttagtcccatctaaacaccccctaaggttattattatctactctcctcgcaaaaaaaaacaaatctagaattgatggttgtattaaaatatattatatccagttatctaattttatgtttatttttctagatagagagagtgcgctggtaatgttacccttcatcgggaaaattgattttgcaatgacatacatccaattaatcacgtgaataatcctagtaaacgtgacatctctttttatccatgtctcttcacttgcttatgttgctcatgtgagataaaggatagagtggacaagcgtgtccaccagcaacgctcgggaaaatgctcacacccgaacgaccggcggggtggagaaaaatcggacgctgtgccactgcagctgcagcatgtaaagaatcttttcttttcttatttcttcaaaagattttttatcgtaaactatttatctaatctacgatctgattgcaccactaaattcgttacaattaaatctttacaacaagaccacacatgattatatttcaaaaatatattttaattttttattgatttttttaatgttgcatgcggtctcttttgatgtttcaaccagtagttttacaatgtttcagctagtgtactcatgatgtttcactgtgtatggatcaaatgttgcagtggaacacgccgttgcaataaatcacccacatattttggaaaccctctattaagggaatttggtttattttttgttccgcaaaaaatgtttcacctagtgcactcacaatattccactatgtatagatctaatgttgtagtgaactgaaatatttcattgcaacaaaaaacccacatattttggaaacctcctattaagagaattcgtttcatttttttgtttcaccaaaaaatgttccacctagtgtacttataatgtttcactatgtatagatctaatgttgcagtgaactgaaacattatttcgctatttgctgaaacattgtttttaaataaggtgaaacaacaccagattaaaacgagtgaaatatttttgatctacttagtgaaacaattctgatatacctggtggaacatcgtgcaacatttaaaaataattcaataataagctatttttttcaccggaatatatccatgtgtggtcttgttttgaagatttaattacaaagaatttaatggtgtaatcgaatcatgatttggataagaaatttaagagaaaaatcaatttaaaagtagttttgcacgtaaatcggacgctgacgtnntgctnacntnnncgtcnnatnnntncctnnnacatcggacgtccgacgcgtagttctctcccaacggtcgacgtctaacggtctaagagaagccagcactttcccttgctcctccttcgctcccactccatctccctatgtcttttatcttttctcgtggtcgtccctcctccctcccagcaccacttctcctccttatccgaggacggttagccatgagataaataagaagtggtgccgataaggagaagtagcgctagacggatctatttttagaggagtttgagacctgctaactatcaacgtgtaggaggatccgtggggtagccatcacaaaggaggagccatcactgccgctcaccatcgagaggagtcgcgggggatcttcagactagtggttgtcacttagtcatgtacgcttgaggagaccgatggagctcaggagataggggtgagcgtggtcaggtccggtaacggaagataaagatggtggcagtataggctagtgttaatgccaaaatttggtacgattctttagtggattcagttaaggaaaagaaatcgattggtagatggacatatatatagataaagctaattttaaggaggaatcgtgaagatcatggcaagatagtttcatatgtttgatatatctttttaaataggtaggattagttatttcccttttcttattaggaaatcttatatcgtatctgatttggtcttgtcctaacccgagggtataaatatatatgcctgtgatctttataatatatctatatatcaatacaattatattttggtacatcgccaatctttcaatgggttcttgttttcgagcagggttacgtcggttaagtttgatctccgttgagaaatcaaatttgctcatcaagtctcattgacatgaagattcaatgaaagattgcatacaagattccttccttcactagcctctagctattttcccagcttcaacccacagggttcagacctgacaactcgcaactcgtttggtttgggggaatcgtttccagggaatgagagttttgaggagcatggtttttaagtatgttgtttggatggtggacgtgcgagtttttatgagagactagaaaggggaatttaagaacaatccactttttcaatatctgagtaggataggtaattgagagaaaattcattcttaagcacatcgggataaatatgggatgtacatcatcacttaaattttatttctcacccaaactcccctactactccctccatttcactatattaagagcaagaataataatgggctaaacttattatgtggaagagagatacgaagaaaagtgaggtgtattggctttagggtttaccttttttgttttctaggtaaaaaccattccccgccgatttactgaaaataaaccaataattttctgtcaataccgtacaaaaaccaattaataccagccgggtttccacaagccgatggtcgattttctgccaacacctggatcagctccaataccgtccactgcctctgtttttttctttagctcagcacgcctctgtttgttctccagcttcagcacatgcatcggagatcggactaactggagttagtcagaggggttgattcggttggaaagtcaatcagactaggctgtattctttgccatatgtgttatgttccaacttcctttccttattattttttaggtgcacgtttttcaaactactaaatgatactccctccgtcccaaaaaaacaaaaagataaaccgtgggttcccgtgccaatgtttgactgtccgttttatatgaaatttttttataattagtattttcattgttgttagatgataaaacataattaatactttatgcgtgacttatctttttaatttttttcataattttttcaaataagacagacagtcaaacgttggacacggaaaccagagtttgtttttttaggacggagggagtacgtgttttgtaaaaaatttatatatgaaagctgctttaaaaaatcatattaatctatttttcaagttttttaaaactaatacttaattaattatgtgctaataagctttgtggggagaaaaaaatttccaaccatacataacaaacacagccttataaaacaaaaaaaaaaacgatccatccgctttgcaacctggcatggcatagatcacgcccgcaacgagcaaaaatgaataagttcactttgactccgacaactatagcttcaatatgattcatatctattagatatctcgactctccaactattaaaactagagcaatttaactccctaagtagttttgtagagtggtttcgctgatgcggcgctttgacttagtttgacagactaactccacgtgtggaacccacatggcagtgattcctcctttttttttttccttttctttcttctctctctcactcctttcttcgctaacaggaggcgccatcgctccgcctcatggcaggtcgctgcggctccgctcgaggccggttcgccaccatgcatcggggttgcccaaccgcggctcctcctaggcaatcttttcgtggcgcccggctcacacctctctctttcccatcttgctcccttccggccgcggccactgcccacctcaccgttgccgctgcggccatggcctgcagtgccacccatgacacggagcggggacgaggagcggtggctctccccatctcctccgacgcctcctgttgagccatctccatctctaccaccggaattgtcccacctgctagcgccccactgtgcaatgtgcaggaggtgggcaccatcgcagcgcccggctcgctcctcccctgccgccaccgcccacctccccaactgctgtactgtggagaaaacatggggtagagagaagggaaggatggtaagatatgtaggccccatatgtcagtaggtcccacaatattttttcgtgaatgacaaatgtgttccacatattttttttattctaataccacgtaagcaccacgttggacgaataccaggtcaacaccaccacgtatgagccacgtcagtgaaaccgccgaaagagttaaaattacaccgattttaatagttagggtcgagataaccggtattacagtttaaggatacgaatcagattcggccactggttaggggagtcaaaagtggacttactgcagtagaaaaggagaggcccagttaaccgggccgaaattgccacctaaagtttgggcctaactcagcccactcaatacggagtaacttaccgactacgaatcaaatttttttcatttttagattttttaaaaaatatttacagaaataatctatcagccaaaaaaaattataaaaatagaccctgccgcccaccacttgggcggcaagctgacgtggcaaatgggggagggacgggcgatgacggagggagggttttttttgcaggaaaacccttgccgccctctgttggagcggcaaggggccccaatgcaaaaaagctagccggggccggccattttgcaggcggccccttgccgccctctggccgggcggcaggcctcgctgcctataaaaggcatgccgcccagcccccagccctcattcctccccccacaaatccagtaaaaaaaagaagaaaggggaagagaagagaagaaggggcgaagccctgccggattcacacgctgatttcaggtaatattcatagatcgtatatgtgactattgagttaaatactgtatattttttaaaactttgtttgaataaatgcattatatttttagggttttagttgtactaatctagaagtgcgtattgtagatatcggtaactacgtagatctgctagtttggaatcagtactttaccgttgcattggcatatacaagaagatattacgttgtaggtgtttattgcatgaaagaataatatgatctaattattttgttgacagatatatcgaacaaacaaatattccaagtttaccatggcccaagaaacgtccgttacgggccaactggggtagatatgtcagaatttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatgtggaaaatgcattgcaacgcgggtggcctctaactatggttccatttgttcacccaaaggatccaggtgtgcagatgaacatggatgatggcgagggaccaagtgctgaagtaaatgagacttctgtggaagaggtcaacgcacgagaggacgggggcgtagtagctctagtgggcattcaaccaggtggagtggccgacgagggggagactgtcggtgccattgtggatgaaatggagagggaggattctgacaacgagcgtgtagaggaaggtgattcgtcagatgatgagacggatattaatctagcagaatgggctagtgaggatttttttggtttggtcgtctctgaagaggatagtgtgagatgggagtacaaagaaaatgaggttattcagggagcgatttatactagagcagaagatatgaaggaggcggtaaaacattttttagtgtcacttcgtagagatttttgggttgccaagtccaactggttgcaatatgaagttcggtgtgttaaggaaaaagatggttgtccctggagagtgcacgcttataagggaaaatggaaggattattggacagtgtcagttgttaccaagcatacatgttttctacctggtgttcagaaataccataggaacattacatgtgcatttgttgcatctgagatgtatgcgcatgtcatcgataatctcacatatgaaccaaggtcaataatgcgacacatcgaagagacatacaagtatactattagctatgccaaggcgtggagggccaaacaaaaaataatagagatgagatttggaacttacgaagcctcgtatgacaatttgccatgcctgcttggtgttatcgaagaaagaaaccctgggagctcttacgcggtgaagaaattcccctcaattgaacatcctggcaagagtgtgctgcaaagggtgttcttagctctacatgcatgcaagatggcattcgtgaactgtcgtcctgttctctgcattgatgggacattcttgactggaaagtatcggggccagatactaacagcaataggggtagatgggaacaatcaggtattgcccttggcatttgcttttgttgagagtgagaataccgacagctggtactggttcctgaaattggttaaaacaaaagttattggtatgaggccaaatgtgtacctgatacatgataggcacgctggcattctgcgagcgatagaagagttgcagtttgggagtatggaacgaggataccttggtgagtggaaagatgtacagagtaggtggtgcatgcatcatatgggagctgatttcttcaagcaattcaagaacaaggagctcatgaacatattcaagaggctatgcaatcagaaccaggagaaaaaattcaatgagctttggaagagattagatgagttgtgtcacaccctgaagttctttcccaagcctaaattgaagttgtaaatggtctcaagaaaatactggtgtaaaagcaagagtaaaccataataaatcaatgcaaataataatcggaattggcatgtggaattttttcttgagttctacatgtcgaaatacgctaacaagatttttagtggaattttcagagctctagaaataattttaatcaattaaaaattgagcacaagcaatatttaatcccaggaaaattcatttccttatttttcttttttcttttccctttttctctttcgaatgggccgtcggcccattctctcttctctccccctccccactaggctggccgaaggccacggcccagccagccgccggagccccctcctctctcctagggtggcggacaggtggggtccaccagtggggccggtctcccacctccagcgggcgccaccgcgccccgctcccgagtctcccgggccacgtggccctcacgccagggtcccccgggcccactccccctctctcccgcccgcgcccgcggctgagacggccggaattcaatttttgaatcgtgcctctctctcctccccacccctccccactccgcgggggaaatcgcggtctccccggccacgatggaccctcgtgggtctatataaagcacccccgttccctcctctctctttttcattttgcaatggcccgctcccgtgcactccaccgccctagcgttgttgtcctcctttttgccgccgccgccgtcgctccggttgccggtaaccgccgtgccgaaccgcgccgttgacgtcatcacgtttgccgtcgtgcgggccgtcccgtccacccctcctccgtagcaatccgccgccggaaccccgtttgtgccgcgcgccggtgagcttcgccgtggccggcgccttcggtcgctgccttagccatccatggtttccctctccctcactaactcatcccttttgatcccttaggtggtcccggagctcgtctcgccgtcgccatcgccctccgtcgctcgccgtcgtcgatcgtcgtcagtgaggcccctcctcccctttctccctctctcccgtgccgcttagccaccgcgccgccgcctagccgcttagacgccgctatcgccgcccgcgtcgccggaacgccgccgcctccgccgccgatcggtcgccactggtcgccgcctcacgtcgccgctgcgtgcgcgccgcgctgccacgcgccatggccgccgggccggcttgagccgtgcccgcgcgcaccggccgcgagccgcatccaccgtccgatctaccgggcggtagatcggggccgtccaacccggcctcccgcgtggctgccgcgtggccgccgcgtcggcgccacgtcagcgccacgtggtgcaccgcccctttcccagtccatggacccgatccaccatggaccagcgcccgcagccactgccatgtggggcccacatgtcggcaccgcccctctctctcccgggatttatttgttgcgcaataaatcaattaaggatttttctatttttagtaaaaacacagtgaatcttctaaaattcatatctaattcatccgagctccgtttaagcccattcaagtctcagtaaatcaagaaaaatgcatagaatctattaaaaatggttttgttctctgtttcagtagtcttatagcctgtttgtattgtttgctttgtatgtcgcttagattgcggctctcccgacgctccggtgtactttgaaatagttgccgaggttcctccagcagcagagcaaggcaagtcatgcttgtcacttgaacatgttgatcctatattgcaaatgctccattgttttccttcaaatactgcattgttttataatattaccatgggatgtttacctactattatagccatgctattttgtaccatgttcctttgttagtttggactagggattgcttagccatgcttagttcaactagcacacaatggagaaaattatattaatgtatagacttcaggatctagtgttgatgttggattagagccaccgtcctggtgtcgcttcattaaaatatgttaaatggtgggctgtgggtgcatggttttgctagtcgcgcccatggcacttaaggaccagttcgcgggaaaccctggaagaattcctcgtacttaccacaagccagcgtgggcaacggctgggcttgtagtgtagctttcctctagctaacgcatccaggcaagggtgggcgtgatggagtttggatgggccctgcgacggcctatgcggctttcagattcacctaggcacgagaggggactgcccgctgccttgcgaggagtgggggtgaaacctgaggtgtggtgtgcttggttagagggggttatgcgaagggtcctgtcacggcctctatccggtatgtcgtggtggcatgtcggcgcacggaaacatgttgtggggctgtgtcttgtgggtacagttgtaaacctcttatcagagtaaaactatttgaatagccatgcccgcggttatgggcggtcaaccagattcaccgtgattagtttcaccctagtctagtctaatggaattgaatagtataggtgggtggttgggcctgttgcaacgtggtatagcgttggacagtggatgattaatattgattaattattataattgttttactactttcaactactgtttataaatgctcgctttatgcaaacgaacctctatagctatcccttgataattccctgcatcatacccctattccggtatgacttgctgagtacagtgggtagtactcagtcttgctctattttccccaaaccccagagtttgagtatgcgtcaaatggtggcttctccgaggagtaggcttcgtccgtgccgtcgatgatgcctgtggagtggtgatcccgctgcggtccaagtcaaggcttagctccagttatcttttaattttccgctgtatttatgtaagactttatgatgtttgtaagacgtggatctgtatgtcaactttatcgtttgtgtaccccggccggtcctggacgggggttttaatacacattctgcttggaatcctattcgggaatttctgggcgtgacaagttgatagccaaatgcagtaatcagcgtgcagcggctccatcgaccaccgttgctgaccctcctcaatctcttggacctctcccaacggatagtccaacattggttagaagaactggagtggagattcggaaattttctcagtggattctgcatgaaccaaaagagaaatgggccaaggcgtatgacacaggtgatgctagatatggaataatgataacaaatttggcagaagtttacaactgggtgatgcacggtgtccgtggactcccactagttggcatagtggagttcattttacaagggacatgcaggtattttagggatcggttccaggcagttcttccctctatgccgaacaacagcattttattcggaactttcatgcagaaaaagctagaggagttgcgtaaaaaggccatgaaacatcgagctctagtgcaaggtacccaacagcacaggtttgagatactttgtcaagataaggcaggcaggggtatctaccgtaagagagtgaagcaggaatgtgttctcaaagccgacggcacatgtcattgctcttgtgcaaagccgaagctgctccacaggccatgcacccatgtcattgctgccgcaacggagtgtggcataccatatgcagtatatgtgtcacagtacttcagtaagcaagcagtatatcatacatggagtggcgagatttatgggttcggcatagctggggagttcacagagactaacaatgaagtactaaatattcctgacccatcgaagctccgaggcaaagctggaaggaggaagactcgtcgcatccgcaatgatatggacgagtcggaggctggcagggtgaagcgttgcagcaaatgcaatgaatgtgggcacacctacaagcattgtcctaaagacaaggagaaaccaaatgcggcggaggcaggactatcaggatcagcagcaaatggagctcgccctacgggtgaaggcactacctcaactcgactacgtcctaggcgtcgtcgtgccacgtctggctacgtggtgtagttcttgtgttctatgttggcatgtggctttgcttgtaatttgtttcgaacttaccgatgtgtttatgtttcgtcgtgtaatgtcagacttcggcatgtcatgtatttaggtctcgtgatgtaacgtcagacttaggcacctaatgtctttaggtatgctgatgtaatgtcggacttcggcatgtaatgttatgttattttatgttatattatcgaactctacatatatgttaaattgcacgtcatcgttatgtacccttagtaacatttgctatatttaaatagcctgtactcttgttgtacataataattcttatgattttattactttttcataattttacaagttatcttttgttctacattactactttttgaattgttctaacataaaacactatatttttcagagatagcacgtcatgatacacctaatttttataatgacatattaatttgttcttgcaggttgcgtgaggccggcctcctaccgatgtgtcggctggtggaggctgcagccggccacgcggacccggccaaacgctggaatgtggaccggtccctcctagcagctttggtcgaccgatggaggccagagacgcacacttttcacttgccatgcggtgaggtagcccctaccctacaggacgtatcgtacttgttggggctaccgctcgcgggagacgctgttgggccagtgaccacgggtgtggactggaaggatgatctgacggcacgtttcacaccagtacatcgcgcaccacatctcccactccagccgttggcacaccaccgcaacaccggacctacgaagaggtggctacttcagttcatcgtgagtgtttttgtaccgaaatgacaagcgtactacatatttagtcgtaaggtaaggtgcctaacattttatcgaacgcttacaggtcgagcagctacaggcggaggccgacgagtactcctacagccgttgtttggaggcgtacttgctcttactttttggctgggtgatgttctgtggcggtcacgggcacgcgttcgacaagggactcgtgcactacgccaggagcatcgccgacgccgtggtaggcgaggtgcctcagtggagctagggttccgcgttgttggtggctcagtaccgtggcctttgtgaggcttgcacgaagtcggatcccagcacgacctttggtgggtgccctctctttctttctatctgggcagctgagaggattacgatcggccaccctgaggtggaccagcatgcgtacgaggagtcactgtacgcggagcgaccggaggtcgactaccctacgatgggtactctgtggtgccgtcgtcaggtacgttgcatcgatcttctcttattgttaagttcattgctaagttcattgtacatcacatcgatcatctcgtattgcagcgccgatgggctcacgtccaggttaggcggtcgtatcctgagttcgttatggagttcgaccgccttctgccgactgacgtcgtgtgggagccctacagtgccgcggctacccaggctcgtgcgccgttgggtctgtccacactctgcacaagggaccacgcgtactggacgactacggttccgatggtcttcgatatctatgttgagcctcacgcccctttccacgtgatgcggcagtttggcttccgtcaaccttttccagtaccgtttccgacgaccgtcccagctgctgttcaccggtaagatctttcactacgctttgatttgttgcattaaaatctacctctccacaataatttgcaacatctgttgattcacactaatatgatacattaattcgcaggtactcgcacaagggtcagcagtcagctggcgactagcccgccaagttggggacttttgttgagaactggttgctcgcaaccaaggaggtcgtggagcacgagggagagccacacaccgaggaggcgtaccaggcctacctacgctggtaccagccacgcacccgtactagggtcaccttcgctcccttggagcagcagacccacgttgcgatcactagagacctctacgccaggcaccgtgactaggacttcgcttgtgctgtgagtaccctgcatcgcaccattcctttatgttttattcctttctcttcgtcaaattttacgaatatttacgaacaaattaaccatgcaggtcatcgacatcaacagggtcgtcgttgacggttcaacgacgatccaacgtttaggcgcggggattccgatacctgtagaggagcacctgacgacgtacacactgatggtggagtcgatgcgctcgattctccgagtgctcacctgtcgtgcagacgacgttgctcgggcagacgcagcaccacagcggccacccgtaccgactggtccccgtccaactgcgcacgttcctaggccgactccccctccgcacgaaggtaagtatttttaaggatttttttgtacatgcctagcacatctatgtgagccgattcatccgattgcttcagggtttcgtgcaccgttcagcaccccgcctttcttggctaggccttctgttgtgccccccacaggtacttaaaaaaacaacagtacttcgacaattaatttacatgcattttatgtcttagcttacaagagtcccgttgtcgatgtgtaggtttcgcccagttcgctatgacacaggccgcccacttctcccaggctgcagggtcagcgtctcaggcagctgcgtcgacttcgcactcagcgcagttctggcagtacatcgggacttcatcacacgcagctggcacgtcgagtcagggtccaccactagaccatgttgggacctcatcggaccacttggtggcttccgccttgctcttcgacatcactgacttcgacttcgcttcaggctcgacagaggacgtcatcggcccctcacagctaagaggcgcactgccggtgcagacgcaggaccaggcgcatgccactccgccgccagacactcgtgctacccatgctgtgccaccggatcgtttcacctactcccaggaccacatgcgagcacaggcccggaggaccaagcgtggtcgcggcgcggggcagggccagtagagcagacttctctttgtttatttgcttcgcatgctagtactgtatgcttgtgtaatgaatgcgttgttgttatatgtgcatgatacctttcggcgcatgcacgatacctttcggcgcatgcacgactactttctgccgcaccgatgcagcctcctttattcgcgtgctatacgagtatttgcccgccatttgccgcatacgaccaatgtaactttcggcgccaatcaggcgtacccaccatgccccgccacgttcacatgtcagggatatcactcgatttttggtgcctatataagtcgccttaacgagcgaggcctcacgatctttcagaactcagtcacattcagtactctcttccccacttgcttcattacaaatcctaccggctttcgtcaatggctagacgcctgggcgttgaggatccgaactagcgtagcgatccttatgtatacctactaccaccttggtgccggcgtcctctctgcctatgcagtgatcgatgccaactaatggcttcgaggaatcctgatatttgaggaaggcgcttttttaggtgccctaactatgaccgtgaggtattttattatctgcatatgcttattcattccgtatgggcaatcgttttattcttcgtaacactactctattcggcagacccgcactacggcttgcgcatacatcgagtgggtcgatacagaaaatcccgttctcgacctaaccacttgtttaaaagaaggtcgctggtatttcgcatccgaaagtactgagcaatacttgcatagaaaagcagcttacgaacgacaatgtcgtgaacaacagtgcgactggtgggtgctaactacgacactccctccatgggaagcccgtccaagatgcaggtgtggtaatcgttgtcaggttcttcgttccataaagcctacaacattgggtcgaaggttctttgtttgtccaaatattcttgtcgacgatttcatggtaagaatattttgattacatgaatccttattttctcacaacatttactaactttgctcgcttcacatctattctttcctcccaggaacgaccaaggagatgtcaatacagagaatggatagacactagaagagttctaactccacctagccgtgttgtgcagcttgaactaccagagcaatacatggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcaaatctaatatcatctatgtaaccgcaatggaaatagttgtatcatgttcaaattatactactatttcttcatgttacataattctccttgtttaagtccatataatgtttctacgaccgagactgcgataggcctatatcaattctctgagtactaatacatcgaataagttacaaaataataccttacttaatatatgaaattgcgaaacaaccaatttcaatacatttttataacaatattaacaagttttaccaataaatacttctttaattattattaacataacatagaaaaatcatttggcgatactttttgcatccgggtaccttggggcggcaaggggcccaaatgcaaaaagtacgaaccccaagctcttttggccgacaaggggcggcaaggggctaaatgcaattttggccgacgtcgtgtgccacgtcagcttgctgcccaccactggggcggcagggtctatttttgtaatttttttggccgatagattatttctgtaaaatttttaaaaaaaatctaaaaatgaaaaaaattcctacgaatccaatgcggagtccgactacgtatcgaatacggagaccgtatcgacagtaaatcaaatacggatacctatcgattccgtattctcctctgttccgctctctcttccccaatccgattagggttttacgcttccccgtctccgcctccacctcgaatccttctctctcgccgtctccatctccgcctcgaatccttccctctccccgcctccgatcaagcttctccggcttccgattctccctgacgccactcccttcaccactcttcacgcccgctgtcatggcgtacagggcgcctactctccggccgcagctcgcggcgtctccggcgagccgagttccgctatctgattctcgtcggccgccagtatattccggaagtaacggcttctggagcggcagaggcagatcgggtcgcgcttcgaccagctcgagtagggttgaggacaaggtactccgacgacgaggtttggatggtgaccaaacttcagtccgcgttttctcaaccccaaaaaaaggggcaaattggatgggcagtagtcccgcttcctctagcagcagcagtagtagccatgcttcctcctcgagcgaaagttggattagagataagctgtccggtgtccgtccgtcatcgctcgccgggcgggcaccgaccaccggcaccaagaggcagtgcagcagtcctccgccatcagctgatcgttcagagaagaaggcgaaagaagatctggcgatggaggagcctccggaggctctggcaatggaggagcagcaggatgcacttgcaactaaggagcaagctctggcaatggaggaggagcagggtgcccctgcaactaagggggagcaggaggtgttgcccgagatggaggaggagcaactggtgatggaggaggagcaggagtcgttggcgatggataagatggagtcggggatggaggagcagccagggatagaggaggaggtgttgccggagatggaggagcaactgatgatagaggaggagcaggagttgtcggcgatggataagatggagtcggggatggaggagcagccagggatagaggaggaggtgttgccggagatggaggagcaactgatgatagaggaggagcaggagttgtcggcgatggataagatggagtcggggatggaggagcagccagggatagaggaggaggtgttgccggagatggaggagcaactgatgatagaggaggagcaggagttgtcggcgatggataagatggagtcggggatggaggagcagcctgggatagaggaggagcaaccggcgacggaggaggtgccggcgatggagacaccagtgctggagaaggaatctgtgccgtactttgctgggccgtcgttcaacttcgcaccacatccgagcgaactcccttttccatctttacttattcacttaattcattctcactgatccctttcttacattgtgttttatgatgcgaattccttactgtttttttacctaactaagtgtctttattctattttccttaacaggacgaacgtggagaggtgaggacaagatgaatgttgattcgatgcactgtcggcggtcagcttacccagcagtcactgcctcagctcagccatccaggccactgccttcatgagacatgctccaactagaacatgtagttatttgttttcttcccctctccctatcaggcttcagggcttgatcagttacttttttttcttcttcctccctccctattaggcttgatgtcaatacgttttgtaacttgctcaatcttaactaaatggatgcaatcgttgcccctaagattatgtaaatggctcaatcttaatggaataaataaatggcaatctttaccctcccttgtaaatttgcagctgtgtgttgtgtctgtgtgttctccatatgagaggaaatgcttggggataatggtctttgcagtagaaagagttagagggaataagctgttctgggcttgaaaaaccagctgctatgccttcatctacatcctcctaatttaggtaatatatcatattttactgacatcgtttccatttaatataatgctgatcatgtcccgtggatatttctctaagttaaaagagtttctatgcacgataaggttgtttttgtatggctgcagttgggcgccgatgatgcgctccctagtgcgaatactcatctggatctggtctcctcccatctccgcgatgatggcaactggctcactgtgatgtcctctttatgccatcccagcaggggttggtgcctctgggctatctttgggtcgcacgcttttgccattgacaccaccgcggacgcagacattttgacattggatttggctggtattgttgccttgaccttttgtttttgctaatttttgatgttgcatgatatatatgtgctcgatgaaatggggcccgcatgcaatacttgttcttatttcagtagatggttataccatttgcagtgtattttcaccctaagtactactatttggttacaacatcgtgtttctgttcatgtgaagtgagccagagggttataacatcagctttaattcacttttttattttgctttaatagctacggttgggtctgaaacttaattgttgagatatatgtgcagctccattttgcactagtaataatagtttgttaggatggtctgtcgtaacaatttactgttacttctgtgacatttgttcaatcaaaatttgatgcatttgtgatatttgctgtttaggactgaaagaaactacttcttgccctagagcaaaaggtaataatgtaaagcactgtggcactgtaagtttataaccatagcagaaagtgcaaaatgcatgactcagttaggagaaaacaggaacaggctgagaagaagatgtgtaatacccaggaaactttcagcagcaaaatataattcagtaactatgcaaaatcactacttggacctaatgggctattaatgtgaaattgaattttcaggttatagatggtgtagtgaggttaaatatatagggtctgataaggtgcaaacactgctagtgctggccttgaggttggaggattagtaagattctgcttctctctgtttttttgggcacacacaggagagctgcgcatcatcatggatcaagccaggaattctgcaaggttagggcttgtttcctatagctagggtcgcggtgccatagatctttgtttaatctgaaagatattgctcttgtttggctctgtatgtgatgtagctattggtctacgtttcgtattatatcttggatcgttttgattttgttctaccactgcatgtttgttcaaaaatctgaaaccgctcttctttgcgggtcttttgttgaacctaggcgttggcgtttcagtattggttgctgtgctcttctaaagaaaatggcaaacatttgaggccaaggcaatttgggcgtctcctttgtgcatgcatgagctttgtgtcatgaccggcaatggtgacactgagaaagaggtttaactgtgaatgatagtgtgtgtgttttgggctagactttatcaaatagaatgcggcctgcgtgccttaaatcatttgggccaacggtccatgtaatcaggagataaatactcaagagagagaatggctgtggccagcctggcaaaaagaaatcgaatctatctctctccaaactgtctctcctctgcctcagctctgtttctcttcgtccccaactccgatctcgtctaaatatctctctctctcgtcggcggtgagtttcgcggtggcgtagtgttacagtggtatcagagacaggttgtgggcgtcgccgtgcgttggattcttcctgattcgccacggcgcccacaaaactttcagcccctttgaagccaggtatggactccatggagtcaaaatcttggagaagttggaaggcatcacaaagtggatgcacgagattgatcagcggctggattcccaaagtggcagtctcgagaaggtgactaccaaggtggatctcgccatggattccgtcggcaaggtgcagcaagagtgtgctgagttggcccgttcgatgaagcgggtggccagctgctctgatcaggccgggattttgggttcgcctttcgggatctcgcaggttagtgcaagtggttccgcgactcctccgccgttgaatccacttgttcctcctgtgttggatggggttgatttgggtcatggttttggtgatgggatttatcggcgtcatcagccacttcctaaaatggattttcctcgtttcgatggttctgatgtgcggatttggttggatatgtgtgagacttattttgacatgtaccaaatcactcaaaatttcaaagtctctgctgctgtgttgcatatgtcgggaaatgcggctcaatggtatcattcttataagttagtgaatgaggttaactcttgggatcagtttagaatggcagtcgcaacagaatttgagtgtgttgtggaacgtgagaaaatgtctgcactagatactctgactcaaactggtacaatgactgagtataaacaacaatttgattctcttgtctatcagatcagagtgtttgatccatctatggggggtaaaatgttagtgactcattttatgaatggtcttactgaagaaattcgagctgctgttgttattcaattgcctgacactgtacagcaagcat

SEQ ID NO: 67637 - DNA, 6100 bp, Oryza sativa
tcagggaacgttccgacccgacagatagaaggacgagctgtcactcgccctgcagattcccgagcatccaggacgaacacgagggaaaggcgtggttccttgaaatattggattcaagaaggacatccacatgtacaggagtcggatgaggagcaagagagataccgaggcaaagattgcagatcttgattatagggtatcgagctacgagctcagcatgcaagagaaggtggcaaggaaagtggatgaacgcatggccgcacatcggtgccacgatccccagccgtacattcctcatgtaataatcagcccctgaggcaatcgtagcagctgtgcctctgtcacacccagaaattcacgaaccaaaatttctaagctgaatgtgcattaaacgacaattgttgacatacagatccacgtcttacaaaaatataaaagtttacaaatgcagcggaaaagaaagaaaaaaaacgagctaagcctgaagacttgacttctgcagcgggcgactccattccacaggcatccttgacggcagcgacgaaaccaacttcttcgagacatcttcaactgaaaagaacttcaactctagggtgggggaaaagagagcaagactgagtactacccactgtactcaacaagtcataccagaagagaaggtatgatgcaggatatatccaaggaggctaaaggttcttttgcataaagctagcatttaaaagcggtagttgaaagcagtaacacagttgtagcaattaatcaatattaaccaatcactgtccaacgctataccacgttgcaacaggcccaaccaaccacctgaactacaccagttcattagctaactaggggtgagactaatcacggtgaatctggtcgaccgcccataaccgcgggcacggctattcgaatagttttactctgatcagaggtgtacaactgtacccacaagacacagccacacgacacgttcccatgcgccgacatgccaccacgacatactggaaagaggccgtgacagaacccttcgcataaccccctctaaccgatcgcaccacaccttagggttcgcccccgtccccagcaggcaacgggcagcccccctttcgtgccgcggtgaatccggaagccgataaaccggacaccccggccgacccaactccatcactcccaccctcgcctgggtacgtcggctagaggaaagctacactacaagcccagccgttgcccacgctggcttgtggtaagtacggtaagttcttccagggcatcccgcgaaccagtccttaattgccatgggcacaactagcaaaaccatgcacccacagcccaccatgtagtgtattttaattaaccaacaccattgcggtggcactaatccaaagctatgccaataatcaaagtctatgcttgaatgtaattccccttttgtgtactagttgaactaagcatggctaagcatttcctaagccaacatctaatcattttgataccccagttatcaatgacataaggtaaacaatatatggctgagtagcaggacccatcccacatgacattgtaaaacaatgcaacatttaatagaaatgcgggacatttataaattgggtacaatatgatcaatcgtaatgcatgacttgccttgctctcgtactgatggaaccacagcaatgtcttcgaggaaccacggatcgacgaaacggccgaaatctacgcgacaaacaaagcacacaagcaaaacaagctataagtctactgaaacaggaaacaaaaccatttttaatggattctatgcatttgtatgaatttactgagacttgaatggacttaatcggagctcagatgaattagttatgatttttagaagattctctgtgtttattactataaaagaaaagccttaatgagttttattgcgcaataaaggatcccagggctgaagttatccgggaggggcggcgccgacaagcgggcccaacgggtcagtgacacaagaggaggaggaggtgacctggcgggtgggtcccaccaggcagtggctcaggggaaggggtggcaccggccggtctcggctcggcttcaagccggccggcccccatggcgagcggcgatgacgcggacgggaggcgggaaacaacggcggtgaccggcgcaaaggcggcggtgcacatgggagagaggggaaaagggaggagaggggatcatcagcggcgagcacggcggccggcccgaaggatgaaggcggcggcgatgacccgacgagcggaggggcagacgggcggcggttgcacctacggaggaaaatggagaggagttaggggttgggaggaagcccacggcggctagcgtggccagccggagatgggaagggcggcgaaactcaccggtgcacggagagagaggcgttccggcagcgggattggatggggatgcggcggccgaggtagctttggcggcggagaagctaacggcggcggtggctctagcggtggcggcgtgcggccggagcacggcggcgagcggcggcgctagaggagatcggcgcgggtgcggtagagggcgtgcgagagcgcggtgaaaaggggaaaagggagagggggatgcggggaagctttataggggctcgggaggggcggacacggccgggaaacccccccgattcggccggcgacgtgggggggagagagagagagagacggattcaaaaccgaatcccgccctctcgggccgcgcgcgcggggcgggaaggcgtggggaagggggcggcgacgtgggcttgacgacgtggggcgagtggaggaggtggggcaccggcggtgcgggcggttggagctgcggctccaacgaccggaggtaggagacgaccgacaggtgggccccacctgtcagcgcccgaaggagagaggagggagggaggacttcggggaagggaggagaagcgggctggtgtgggaaggaatggaccgacggcccaagaaaaggaaaaaggagggaaaagaaaagataaaaaggaaaaaggattttcccagggatttaatattgcactttgcttattttaattggttaaaattatttctaaggctctgaaaattctactaaaattcctgttagcatattttgacatgtagaatccaagaaaaattccacatgccgattctgattattatttgcatttattagtttagggattcaactctaggttaaattaaacaatttcttcggacgatttattttatgaatttttaagcaaggaggggaactttagggcgtgacagcctcaacggggcaggtaggatcacagagcatggactccatgcaaactcaggatgaaaccacttgccccgttgatgagatcacgtagcggacaccatgtgagctacatatttccttcaagaacttatcagtcaaggtatgctcatagttttatgatttttgacttgtacattccgcaagttgctgcttcggttgattactaatagataacctctcatcacgtgaaggtggcatcaggaatggccatcccaactgacccttcagggacttaccactgcaggccgattccagcaggatactcgagggtcgaagttgagctggtggaagacgcttacgaggacctcgagttggactaccctggaggagacggtgagacgcatctacgagactcaagccacgccattatactatggcgcaagcggtacatcatccaccctgggcgacaagcagcgtctcgtgcaccatctcctccggctccgccatctcctccgctacctcctcctgcaccatctcctctggctcctccgtcacctcctcctgtaccatctcctccggctcctccggctcctccgcctcctccacctccaccatgtccgcctgcacctcccaagacaaggtctcgtcaagctccaccgcctgcccgcacaagggcaacgaagaaggcaaaagttgacgccaccaaaaacaaggagccgctgtacaattgcagtcaagaggagcttgacgcttatgtggcagcaaaagtgaagaggcaattcaagcctcggagtcttgaaaagaagatacctattgacccgagcgtgaagaacttcttcaagaaaatgtccacaacaaacaaggaggccttaaagctatcggactatgaccgaacacttaagaaagcctattacaagaagtccaaaccagttcctcagcttggagaacaacctaaccaagaggtcgagccgttggtgtcggcaaagaaattggcataacataattcatttctgacaccggtctaactgtggaacagttgattagaggcgcaccaatcccgaagacggaagtggcatacaagtttgaactcggtaaaccgcttgtcacgcctgagcagctgcagtccctaccgacacagatgtacaaattccatgaatggtacatggaaatgaacgccaagggtagagagatgttcggagcgaggataagaaactccgacttcttgcaaggagaaaatgttctctggatccatttcaaggatgtcttcgaactataccatctgaacgccctgaacgtctctcttctgagcgcatggattttgtaagtatcgttgagttcgatttgtttcgttcaataattagctccttgcatatatgtaaacaataataatttccttttatcgttgtagaatgaagattcaaaagacccgacggcggggggtttgcgatactgggttcatcgaccctcagaaaatcaacgtcgaaatgatcgacaagtacgagaaagacacagaggacaatctcgtccatctcctgacgcagcagcatttcaagacgttcatagtactgccgtacaacacagagtgagtttttactatcgttcgaacaaacttcgttcccatacatataacatgtacattttcatatatcatctcacgcatgttgcagattccactgggtcctgttacttttcgacttggatgcatgcagagtcaatgtgtatgactcaatgaataaagagaagacttttgacaaggttttccaacttatagataggtaatataatgccatctattccaaagccgcatggatttttcctattgctattatgcggatctcggataataaataatcatagcttgcaactgcatgtagggcttgggatcggttccgtcaattgttccgcgggacttggaaagaaaaacttggacggagctttaattttccaatcagtacatgcatgctccgaaattatattgaattgaatctctaattacagttaatataagtgtatattaaatctcttgtcctttcttatgtagtgtgcaaagcgggaccagggaactaacttgtgcggctactacgtatacgagtatgcccactgcctatcaacccaaatctacaccacacgagagctcgatgtacgtatatataaaccattcaaaatttcattgcgtatcgatttgttgtttattaatttcatatattcatatgtcattatttttcgaatgatagcgtattcacatgagggacaatctctcacacaaggattttatcacggctgttcaagtccttaatcccaagggtgaattctactacgacggatcgacaattcataacgtcggtccttcttcttttgacataacgcccgcgtcgaagtcgtagctaaatagtgagcaaatgaattgtactatacatgcatgtatatgtttatagatgtacacatttactttagtgtaaatatatattttggtaatatatatgcacataaaatgttaagtgctttaaattatacatgtgtaatatatgtatttatacatatgcatatatatatatatatatatatatatatatatatatatatatatatatatatatatatatatatgtatcccatatatatatgtgcgtaatatatatgtaatatatatagggtaagacaattctacacccggggtatagaataactattctatacccccctccctcttaagggccacacccacctccccctcctttccaaggcttaaaaaccacctctcacctcggtcaaacgctggtcaaagccccctcccgccggtcaaagctcagccaaaaccacctactaactcccctcaccacccaccttttct

SEQ ID NO: 67638 - DNA, 584 bp, Oryza sativa
tctattccataccccatgctaatgcttgcctctggacgagcacggttacaaacatacttcttcagaacgcccatgtacctctcgaaaggaaacatgttgtgtaggtgatgtgcactagggttcccgatcttccgaaaggttctgataaacaatgatttggacggagtcgcgacacaaatcgatccggcttcttgaacgcgcacgctcttgagccccgcaatcgcagcaccacgtctcctctggttatcacccgtgtcgaaacgcggatgacctcgctgagaaggctattccctgtttgccaatcaaagaacacaaacaagaatgagatagaaaaacaaccaaaattgcagatgaatgattaaaaaaaaaagttggggtcttactaaccgatctaacaaaaaaactgttatcgacagattaatctaagcaaaacccaaaaacctaaagatggcggcgggtactgatatatagagtttagggtcatgcaaacccctctcgacgcaaccctaatgggttccaacacgatacacgggccaaaggcccaaatacggtgacgcagaaccgggacagattctggatatcac

SEQ ID NO: 67639 - DNA, 3258 bp, Oryza sativa
tagtctcctctaggttagttcgataagcagcacggtttggcaatcctgggggtatctcggctggaaagacatcctcatactcctgtaaaaggttagtaacaacaagatgtatcgaactagcaatatcatctaaagaaaccaaggcttgtttgcatatcaagaaatagcacatatcatcatctgaattttcagcaatgtcacatttcgttgcaagcataacaccacccttcgacttaattcccttagccttagaactaggtgaaagattatcctttttaggtggaaaaacagttttagccacttgctgattttcagattcatcaagtttcaaactagcagctcgctctttatcagcttctacaatttcagcaggggtcaaaggtagcaaagtaatttgcgtcccattatgcacaaaagcgtatttattactcctaccatggtgtgaagcatcattatcatgttcccaaggacggcccaacaaaagtgaacaagcttgcataggaaccacatcgcaatcaacagaatctgcatatgagccaatggaaaacgaaatcctacaaacttgtgttacctttgctcttccggaatcgtttaaccactgaatatggtaagggtgtggatgtgtacgtgtagtcaagccaagcttcttgaccaaatcagaactcacgaagttgttgcagcttcctccatcaatgatcacacgtgcacgacggttgttgatgacaaagaaaatctgaaacaaattatggcgttgcaacctgtcatgctgctgtacctgcgtgctgagcacccgctgcacaatgatggttctgtagtccgttgtgtcatcacgaccaaagcttcgccatcctcatcctcaacttcttcttcctcctcttcctcttccacgtcggaggtggtgatgtagccatcttctgtagcaacataggcccgttgactagggcaatctttctgcacatgcccaaacccttagcaacggtggcactgaatgcgtcccgtcgaggcgacatatgaggcactcttggcgggtacctgcgaggatcctttacctgactctgctggtcgtggtggtggagatggttttggtgccgcagaagctccggatgctgctggtcgcttgcccgctggctgggaggatgcccgaaacgagatggccttgggcagtcccgcagatggcgtcgtgcgcggagtgtatgtgcttgccttgctcttgccctgatggtcgcacccctgtaattccttctctgcaagcataacaaatcgaaacaactggttgacagagttaaattccttataatcaacaatgttctgaatttcctccctcaaaccagaatagaaacgacaaatagcatcctcgaccccctccactatgccacagcgtctcacacccttttgtagctcaccatagtaatcctgtacagatttatccccttgttccaaacgcatcagtttcttgcgtaaatctctatgataagatggaggaacaaacctatcgcgcatagctaccttaagttcttcccaagcagtaggtagtaccccctcatcagataacccagcccaccacataatagcaaaatccttgaactcactactggcttgtctaactctatgttgctcgggtacaaggtgggcattaaacttttgttctaccgtcatctcccaatcaaggtatttctcagcatcataatatcccgaaaaagatggtattttaaacttaaccttagcataaggatcatcgggcacatgattattattattaccttgttggtggcgagtgccacccatacctgtgcggtttgtgcgtaggcgatgtcgtagccatgcttgccttgtagccagtgcatcaatatagccactggaatcatacaccgtgtcttcaggatgagcatcgtcgtcaccactcaccacttcctcattggaaggtgtctccaacgcggcgacctgatcagatagcgtggatatccgcttgtccaacctctccatgtggttcaggaaaccgattttagtgaaggcatcttgaacagactttgcaacggcctccgtgatgtccttttgagtattttgttggagagttcgtagttgctcttggctgacacagtcagcaaaatcctagggactcttctcaccttcgttacctgacattgaaacaccaaaacataaacaaaatggtgaaggttatccctaataatctactacgcaggtgtagtggtgcctctcaacgattctaagcaatatggagttcctaaccaagctcttataaggttcttaccagcaaagcaaaggatacctagaaggcgtagtcagcgattgcagggatcaagaacctgtgctgtgcagaagtaatatgtggagctaggaaggccaaatatatgtatatgagtggtacacaatccaatgacagatagtaatgctgaataaaaatcccaagtcacttgcccatagttgctagtctactcatgtcctagacagtagtgataacaaagatggctcaaagaatatgacactagtaaacagcaaagaaggactggcaggcaagcttcggcgagtttcagcaaaaactacaaaaccgaactggcaaataagctcaacggagcgcgtcatgagctcaatgcactagtggaaatcaacttttctttttttttcttttatttttttgatatttttttcttttttcagaacacaaaaataggcagacctccaagttacagcttaatcggagtaggtatgtggcctatggatttttctgaaaccactataaacaaggtgcaggaacttgtgagctcgaacagacaattttgcaagccaattttcggaattttggattcgccaaacccgccgaaaattttgcaagccgatttttggaatttttgagaaaatttttttctcttatctgaaaagttaaattttgcctgattccgagtccgtatgcaaaagttatggccgtttgaagtttcggcttctggctaggttttccaaaggggatataacctagtctattttgcggtggaattggggatatggtggcagcggagttgtagggtgttctggtggtgatctggatgggtgtttatgatggcggaaacggctctcaaaggatgaaccctagcacacggtgaaaggtagcggctagggttacgaaaggacaaacacacgactagactaaaacacgcattagaccagcaataggaatttagactaggactcaaactcaacactacggactctgaaaaggaatcatgcaaaggctaaacatggtct

SEQ ID NO: 67640 - DNA, 18992 bp, Oryza sativa
tgaactaaacacagccttaataaattttgatataagagcctctcatttccagcagtttttttaatgtatcatcatacggattcgttgtttttctttccattcttattctgctcttattctacaagtattttttaatgtatcatcttacccccatcttaataaattatgcatctgttctttttttttctggtttagctcgagcttgcaaacaagcataaccgagtcggccttttagcttgttaaaataacgcacgagccagctcgatatccacctccgtgtgtaaagccttttctcatatgatgtcatgtatggtgagcgcgtggccggatatattactccttcttatggaagaatatcatgccttgtttaatttccattcggtaaaatttagtgagaacagactaatgatgagaaacgtgtgcatagatagctcaggttgtatggcatgtggtgctgtttcatgaaaacttgcgaggctaccgttgcttaatactccctccagtttatattatataagtcatttgacttttttcttagttaaacttctttaaatttgatcaagtttgtagaaaaatatagtagtattttcaacataaaacaaatacattattaaaatacattcaatgttaattaaatttaatgaaactaattcgatattttagatgttgctaaatttttctataaatttagttaaatataacagagtttgactagaaaaaagtcaaacgacttataatataagacggatggagtatttaagatagatactgaaaactagcaaatccaatacaacaaatacacaatcattaaggtccaaatgagttttttccttgaaaaattccagcactcgtttctttttgttggggtctctaaacttatgatttttagtattgattcaagaatatattgttgtttaagtaaaaaattaagatttgttatttttgtctctatcacaatgaaatatatttcttcccatgaacggtcatccgcagggggagaagactttaatttggaaaatcaaacacacacacacgagaaaatggagagcgtggtgcaactctggagtgactgggaaatccagttgctaatgctccttagcttcacactgcagatgctgctattcttcagcggaggcttgcggcggtgtagcaccaaggcactagttaggttttgcctgtggatagcatacttgggggcagatatggtagcactttatgcccttggttatctctcacgacaccaagatgtcatcattggagggagcacattgagggaggttcacccactgtctttcctttgggcaccattccttctcatgcatcttggtgggcaggatactatcactgcatttgccattgaggataacaacatgtggctgagacatttgttaaatctgggagtccaagttgctttgaccctatatgtcttttggaagtcagtggatcgccataatgtacatatcctaattcctggcatctttttatttgttgctggcatcatcaagtatggagagagaacattggcactcatgcagtgaagacaaggcaagttttccaaaagtagatggagacgaggttgactattttggccttgtttcttttgtcttgcactcagtgccaggcattcgagagctctttgcaggacataccttgcaccagatggaacaagatcatcgggaagtattgacatcaaaaattaatgaagtgcatttgcccaagttattggagatagagttgtgtctgatgtatgatgatctgtatactaaggctttggtgcttaggacaaggaggggcataattctccggtgtgtatcccaggtatctctagtagttgctttcattatctttcaagtaataagcaacacaaagagatatagtggagcagatgttacagtgacttatgtgttatttgctggaagctttcttctggaagtttgtggagtatttacctttattatgtcaccatggacctgggcatggtccaaggctaagaaatgcaatggagttaatcacatttctgaatttcttttctccagcaatagtggatggccgaaggaaaggccgttgtggtctaattccatggggcagtacaattttctgagctacttgggttgtgacgagtcaaggctgtccaagctagtgaaaaaagtaataaggaagatggggagcctagttggcgctggagaggaagcaggaacgtccttgtggatgagcaagctgttagacaccaagtatgttacggtggataaggagatcatgcaatgtgtcatacacttgatctataattatagtccatttggacctgcaagcacggatgatcaacgctggccaaatcttggtccgctgaaaaagttactactggactcatatgaattttggctatgctattgtgtactttcatatatttacagaggtgcacctatcgaactattatcttcatgaggtattggccagtgtgtgccggaaactatccaactacatgctctaccttttggtgagacaccctgaaatgttgccggtcagtggcactgctgaacctaccttgaaattctttcttggcagcattacttacagaaatgaccactacaagaatagaaccctaaaaagggcgagagatcggctgcaaattcaagaacctgcagatatgggcataaagacattagaggagatcagagacatgtgggcgatgcttctcatctactctgcaggcaagtccaaggcaaacatgcacgcagcgcagctgagcaaaggcggggagctccttacctttgcttggttgcttatggcccatctacagcttggagacgttggcgagcaatttgaattcctttttggcagcgtccctggtccggagagcaaagaggacaacagagacttgcagtggcggagccaggatctcacgacgcctagggctcaaattgaaggaactatccatgataattcatacgctgaagtacaaagtacagataaaaaaaactgcaagactgaaataacagagcaaaatcaagcctaattcaattaagagataacccattggaaaaacttgtgactatcactttttaccatctttacaacaaggttaccaaggtaagagcagcttgagaaatccaaatcaaatctcatgtcacaaataaatgtgtcaagttggtctctaaggactgtacaaacaaataatcccttctacctaatgtttacatccaattgttcaattggtgtgagcagcccggtcaacaacaatcacatttggagcaagcacaacattattttgcccattgttactatcctcagttccggctgtttctagtgttgtgatgtactcaatcagtttctgttgtttctggggttgggtggacagaaatgatattaatgtttagcacctcttcatccaggaaatcaaaccaatttctaattgactaattactatcaaatgcaaaataagaatgcagatccaagattagagaggagactcaattggattttgggaaccaagattttctggctgctgtcgtcggccgctggctcgccgtgggcccgtggctgaggaagccaggaaggtgaagtgccgccggctgttggctgctgtcgtcgggccatcgccggctcaccgcctatgtgcgcccgctgtcgcggccgatgcgcgcggacgccgctgcggagacgcaccgccgtcgctggctcgtcgccgatgcgcgccggggacgcccccttccgccgatgtgcatcggcgccgctgctgttatctggtgaggagagaggagaggagaggacgagcggcgtgatgcaacgctcctctgtgatgcgtgtgaatcgtgatgggtggcaggggaagaggagaggatgcgggagggtagggttggctttttttgggctgtgacctgtgatgggctgcctaatgggctggccaccaggggctgtgaaagtctatgtgtggggctgggccagacgagtagggctgggccatgggatttcggaaaatctggaaaatatatgggtactagtccactaaaaatttttgcacgagtaggacttgggcccaagctgccctaggcccagttccgcccctgtcagatagcatggtaaaaaaggaaacttcgtctcgtttaaggtaaactctaccgctcacccgcttgcccctcctaatgaaggtttagacgattttgattggaaatcggatgactagagttccggttgggcatagtggattctaatccctcgaggggatatcccctctgtacctttttcttctaaattcgatgcaaatagttgtgaaaaattctaaaaaaattgacaatgtagagtataatgatacctactagtccaccaaaattcatgatcaaattcgatctacacatcgagaaacaaaaaagacaaatttagatataaacagtacactactattcatacgctgaatttgtcttttttatatctcgacgtgtgagttgagtttggacttaagattttgtgaagttgtatatatgttttgtatgaatgttgtcaaatttttccagaatttttcataaccgtttagatggtttttgagcaaacgagagaacatcccctcgacagattagaatagtttccccatatctatctcctagaagtattcctacctttgatgggtttatgcaggggcggagtcaggattccaatgttcttatcatatatttttacagaagaaggacaagagacataggagtatttcttaatgctaatttaactctagatttgttttcaatatgagtaaaaaaatgatgcccgataatgctaacattatttggccattcaaagttatcaacttttaacttttaacttttatgatttagcgctaagcaaatagaatgtaccttatataatgtatggagttgactgcatatatagtccatagcctatctatgagaagggatgcaggtgtacagtcctattacccatataaaaacttgcttgctagttcattaatttctcatatagtaacacaaaatttagagaaaaattgaattagaagtgggataagcgggcgagaaaaactcgcttgccgccacttgcatccctatctgtgagcataggttctaaaatcgcatagttatttgttatatagtacaacgcaaatgtgcatatatatggttgagaattggttgtatttaaaaaattcattttcttttctacttaggcacattaatcaaacatgatgtgggtcgatccatgtatatagtagttcttttttcgttgaaagatatttgtttatttgtaatgctaattagattaggataagagagatttttgtttcctcatgcaaagatcagtactagtagttgcttatttgtactgctaatggattttattatgcttggtaggccgcacgttatacaccattagcccataattaacacatcaacaaccaagcgaacagttttactgctctagcacctgctctttggctgacgtaccttatattgcacttgtggtaaaatattgagcattagcttatattggctgggtgtcatcggggtcagatgacaacagtatatgtactgtgatccgcccctacggtttatgtaacatactgttaacgaccaaatttagtaaatcatgagccaggttcggctttagaatcgaagtggatttggcgaagagttagattcgaagaacagagtatgcatcggttgcgacgacatcggctggagtctgcatcggctgagatggatcgaacaggggacagccgatatagctgatacaaccgatacagccgattctgatgaagatggttctgagattgcttctagaatcgatctacgtacttcaaaaagattgccacgatagagataaactcttagaaaggcagttgtatctattaattaggatatgttgtgtaattttcttagagatatgtttgggcaaaaatctgccgcaaagacttatggtatcttagagtttgttagagataagagtcgtgtccggcaaggacatattttatatctcgggtataaatacgacccaaacctgtgtaatcaaacaacaatagttcaacaacactttcggcgcatcgccaccctgtcggagctcaaaactaattacttggatccaactctaattaatgtatcaatccctggatcagtagatattgatatatacaatataaccagttcttcattgcatacgttaaagtttacaacgctaggggttttacaagggtaggtacttacctaattagacataagtactaatattacacagcggaagttttagtacattctgactaggaaggtataacctttaggggttttctaaattatcgaggtcatcgtagtaatagtcataggggtcctcttgacccaaatctgaaaaaagggttatgagagcaagaatgagtattcgcaatactcagcaagttatcatgaaaatatgttatgcattggcatatagtggggttctttgcaaaaagcagtaataaacaatctggaagaattacagcaggaatttataaacatatagactttagatttctaaccagggtaccatatgagtcccggtactcaactccatgagtacggctattcgaatagtttcaaagatattctactgcagcagatgtatgctttacccgcagtccacgacttgctgataatcatcggctttagtcatggcccagtattaagtcattaacaattgtggcacctgttccatgaacttatatcctcatatgctctgaacgtattgttaacagcagcaagaagagttctggcgttcccgaggtatttaaggggaactgatcgtatgacaccacatcatctcgatcagggtttagaaatataccatatagtttatactcgagtatcacaaaccatttacctgtacatggtaatggttaaagttgcccttcgcagcaatagttgcctcctgcgcgaggacttaaataagaaccactatacagaggtgccatattgctaattaacataataactaggcctgtccccattttagaaactgcggtcgtacccgttcgttcgacataagtacctagtaaaacttatatcgatcgagacagtagtagccacccgaaaatcaaccaaatcttacgtactgtcccaatctaagtataaggtattttaaccagattgtaagcaaaataagcgatactaaattatctgggtttctatggttgaattatgcatataaaatagaatattgaatagaaggctataaataaataatttgtaaaatataggattaaatgatcaaaaggtatatggtaacttgccttgctcgatgtcctgagattgattgatattatctattgagtcagaagaatcctcaagacctagggttagacatataaaattcaaatccaaaaggaattcaaattaaatccaaaaaataagaaaaatagagaaaataaaataaaatgcaaaaatagcaaaaaggggcttaaaagatagagaatgattttagaagaatattggtccaagtttcactggaattggatctatattttaaaagatatgggcttctaaagtttgaaaatcaaataaaagtgaaatggcactgtgtgcgggtcccacttgtcagtctctctctctctctctctctcttctcttcttctacctccggccgttccccaaaagcggccagcggcgctagggttggcgattgcggcagcgatggagggaaaaaggggttgcggccaaggaggggagggagctagggttctccggcgacagcgagcggcggcggaggggttaatttgatatgtggacggcctagcggctagggcggcggtgacatagttaagccatgaaggcgattgggatggtgtgagttagacatggctcggagagggattctagagaatctacggagtgcctagatggattccgacagcttgccgacctttggcaaggcgcggagaatacttgccgacgagcacctcccttggcggcggccgtgctcacgtcggcagcccaaagggtgtcatggtagtgcaaagggattgctaaaatggaatctagggagtacgtagatggttgaaacggaagaactcaccgagatatgccgagatgaaggattgcggccggaaaaacttctcggcggcgaagaacagagcaacgcgggggcggcggtgctcagcttggtgcggcgaggtaaaactcgatgcaggacttcggttagggtctaatatactagaacatagttgatataaggtgttctaaggggtatttagggtggaggatggatggaggggtgtggagtcgatcgcgcacaaggtgttcgaccgacgggtgatggtggttgatgagatggattggtgaagcagagctttggggttgtggggctattggtgttgatgatcgatgatggacaaggaagggattggggtcctatttatagggctaggaggagcggatgagctcggacaccgtcatcgccatggatgagctcgatctttggatatggctggggcagcagaggctgtgagagggcggccaagatgaatttgagtggcgggaggccacgtttgaatacttactagcgaaggattggcttgaccgtgtgtgaattcggctggcgacgtagttgaattttttttattttaagtcatttttttgtcccaaaatgtaattttaaaattaaaatttcaaaatctataaacatgcaccaatattttgggaccctaaacagttttaattcaaaaacttttcatctacaaagttttaggtcgcgtcgagagctacaattttaatataaagtttgtcttcattaaagttcacatgaaaaaagttttgaattatttttaaatataaagtctttagaccgtcctatttgacccagatgatattcaaatccaagtttagggaccgggatgacacaactgaacaagttggaggatctaaatgagtgttctgcaagtttagggaccgggatgacacagtcgaacaagtttgaggacctgaacagtcgatttgcgagtttagggaccgggatgacacagcggtacaagtttagggaccggtgatggactttactcttttattattttacgcttgtatagttgagtttatgtatgaatttactctatccgttctgtttcatactttcatactccctccatctcataatataatatgcgcacgtattttaagattaaacctttaaaatatttaaccaattcttagtatgatatgtaatgaattttatttgttaaatattatatcattagattgagatttaaatttactttcttatggttataattttgttgctacaaaccatatagtatacgagaaattataagctaaatattagttttcgagaccgtaccaactttgaccacgctttatattataagataaaggaagtattataagttgtttgacttttttagttaatttttttaagtttaatcaaatttatgaagaaaaatatagtagtattttcaacacaaaacaaacatattatcaaaatatatattgttagaattaatggaactaatttgatattttagatattttagatgttgctaaatgtttttataaacttaacaaattttgactaaaaaatatcaaatgatttataatatgaaacgaatgaagtatttaattacggtcacgcaagctcatccacctataagttcatatctactcgagctatcgagaggtagacgaagacgaagacgccatgagcatgataacggtgaaggtgaagacgctgacggggaaggaggtggaggtgagcatcgaggcgacggagacggtggcgaggatcaaggagcaggtggaggcggcggaggggatcccgccgccgcagcagacgctgatctacggcggcaggcagctcgccgacgacatgaccgccgagatgtgcgacctcaggcatggctccgagctgcacctcgttcttgctctcaggggtggactactttgatcgatcagatcgtttgctcctgatcagctgctaatactctgtttctattgataaacttcattaattacggtcgatgttagtttgtgtgtgcgttgcaataaagtgcagctgattaatcgtcttgtagtatgcgataattttctgtgcttaatttgcattcctcttctcttttttttataaaaaaaattttggcagagctttgcttttcattcaatcagggaaatctgaaaattacagaggaaaaacgaatcggcagacctgaaaattaaaaaaaaaactgaatttgactatattgcatttgcatctaggctcaagcaagcacgaaccaccatttgactttgataatttcgaaggaaaatatccacatatttcttttcttatatatatttcagtggtccaccatttaccgttataaaggttatatagtaatagcttgtttgaaacttttgtggttgtattgataaacagcaactgtgtgctagatcagaacatggatcagcctttgtttcggtgaatttggtcaaagacgttgggctagttcttattttaccctactactttccttatcttgaattgtcacttagatttttataaacactgattccgctggttcttgaatcaactttaatattttttattgaataatttcaagtatattcccttcgtttcaatttactgggtcaaagacacatttcagttttatcctaacccaaacaattataacaacatgttactatatatgaatatattataaaagcatttctcattgtgatttaaaaacacaaaccttcctcgctgaagaaaaaaaaagaatgaaaagaatatggagcatggtagccacctggctggcttaccagcagctcgaccctgggcattgggggatgacccaaactgtcaaagattggtgggagactctagctaacacggcatgggttcgtaggagaggtttgcgcacccttatcctattcatagtttgagagatatggaagtaaaggaaccaacgaatcttgcagcacaaggaggccacgtcatctttgctcttcgtcaagataaaggaagaggcgcggacttggacgatggcaggagtaaagcatctgcgggaccttctgctcctccatgtacaatatttaaagtgtataaagtttttcacttttcttgtccctagggattgtttttccttccgctatattcaatgaaaaggcacaatctagtgttgttttccccttaaaaaaaagcatgaaccttatgacaataatctatagaaattttcaaaaactgatagtcaaagttagtaatataatacttgatttgaggcaaagctaaaatgataagtgatttacaactaagggaatttaacatttagatgtggtgtaatataagagcttcaaaattttattattataggtataattttcattgagagtgccagacatggatttttctcattttcagcatcatggtgttacttttaaaacccaaaaataaattatgacatattaagtgcacaaatattggcagaaatcagctgctactctgtttcagttgataaactataattagttactgtcgatgttaattcagtttgtttgcaataaagtgcagctgattaatcgtcttgtacgataattctgtgactccatagtcctatagatacttctctcttttaccttcaaaaaatttttgttttttctctttctctttttttttttggaaaattggtaggagctttgcttttcattgaagcagggcgaatgaaagtaaaagagagaataaaaaacaaaagctccaacttatttttgagggtgagatacaatagaataagtaattgtgtgcttatactgaattgcgatcgtgtcctggtaggagtagatcagaacaggtatccgtgtttcagtgaatttggtaaaaggcatcggaccactgcttattttaccgaatttatcctgtcgcataacttcaatttgaaattactctaataaaaatccaactctttcccgcaaataaaaaataaaaaataaaaatccaactcttcttctgtttcataaatcaacttgaactcttatcctgtttcccgcggtttttcatccggatatatatctgaccgattttaacttgctcgtcgcggcgatttccaccgatcgatcgatcgatcggtaacctgaccaagacgaagagacaatggagtccgcatggacgaatctccccggcgagatcatggagctcatcgccgacaaggccggcgacgcgctcaccggccgcgccctgtcccgctcggtctgccggtcatggcgcgccgccgtaccggagacgccgcggctcctgctccccgccgcggccgctcgcggcgccggcgacgagtacgcgctcgtgttcccgctgtcgcgcgggtggtcggtcgtcgtcgacgtccgcgacacgtcgtgccgcctctcccacctcgccaccggcgcgacggcgccgctgccgaggctcaacgccgtccgcgccaccgccgggtcccgcgtcgtgcacctcgggtacgagcactccgccgcgcccgcgcccgcgcccgctcccgctcccgctccggccaagacgacggcgaggcgccaccggaaaaacttccgggtaaagcgcaggttccacctggcgcgcggcgacgactggcaccggccgatgcggcggcgctgggaggttcggatgaacccggcgtggaagcggagcttccggctgccagacacggagcacgccggcaccggagacgaacagttctggatcaagatcaagtttctctggtattccatgttcctcgaatccgacctccaattctcacacttgctccgcttcgccgtccatgtcccggcggcggcgagcacggacggcatgctgatcatgatgtaccacccggttctggggacacgggcatggtcttctgccggcccggcgacgccgcctggacgaagctggacaaccccatcgacgacgacaagcatgtctacaacttggtcgagttcgcctacctggacgggaaggtgttcgccatggacaggggcggcaccacggcggtgatcgacgccgccacgctcgaggtgctcgacctcgtcgacgcgccgccggggacgcgcaacgtctcgaacaagctgctcggcaccgccaatggcgacgacaccgtcatgtcgctcgactacctccaccttgtcgcgctgccgagcaagctgctcgtcgtcagggtgcgcgtcaacaagtcgtcgtcggagccggagggcttcgacgtgttcgagctgggacgacaggatcatcgcgacggcgagggcaagctcgcctggcgcgaggtggccggcgacgacgtcggtggcaactacgacctgttcctcgacgaccaccacgccacctttggcggcggcggcggcggcgccggcggcgattccggtagccggatttactacgtgcacgacgggaaggaggcgtactgctacagcaagcggcatggcgagctggaatgcgtgtactcggcgccggagggtagcgaggaacagtgttccaccatgcctagctggtttgttccatagatccatagattaaagttagatgatagagatttactccagcctaacaaaaattatctcgagatatcggtacctcatggtactgtgaggtaccggtacctaaggtactttttgttgggccaaatcaaatctataaatgatataaccccgcacgttgttgtgtgtctgctatgttagaaagtctaacattatgacgatgtcaaattgatcaatactctataagatacttgtcaagattacggataaggtataccctctatccatggatatacgttgtatactgatatggtatacccgcgcgcacacgaatgttttctgtacacgttaaggcaatctatcacgtaatagaaacggagtccaccgatggaaggagtcctactcggacagaactgggtcgttaccatatcgtgtggggtctgatatctccaagttctactgggagatcgactgacccgcggtataaaagggacccccgagcaggacctaaggcatcgaatatcaccgccaacacatccaccacatcctatgaagccggaggctacaggagccaagtcaccgggtgatctagtcgaaccaactcgattacggtctcgtcggtatcatcgagttccatcattccctttgtaatctgtgatttccatcatataatcccataccaactggattagggctattacctatcaaggggtttgaaccagtataatccctgtcttttgttttgctaccccaataccctttatatccggtctacggatatccaccgtcgataatactgtatttaaacaaaatcttctttatatttatggatataaacccttaagcaaaatatcaaagaaaatattttgtatgacagggagcgagatattaaagaaaatattgaatgatgtcttgtattagaaaacaacgttgcttgattcctccaaattgtctttgcccggttatcttttgccataattactttttgtaaaaccaactagatacattgttttgtatggcaacttcaactttcataaaattaaattctcttgtagattcttacattaaaatccaaattcgcattatatataaattttcgcccaaaattacttttttactaaataaagtagtcattttcatttgacgggttatattagctggtcggtaaactgacaaggttttggtgcttatattgaactgcggattgtgtacaagatcagatttcagaacatggattgacgtgtatttcggtgaatttgatcaagcacgtcgggctagagctaattttggccaagtatctttattttgttacaaaagttcatcttgaattacttctgataaaaattctaactcttctcctgtttcctaaatcaaattgaattacttgaacctttactgtttcaaccacgacgagcttaataaattgcgcaaaatttattcacgtagattaagagtccatcacgatcagaagttgcaccgaattgtccgggtacgccacaatttcgcgaagataaataccgacggaaatgagagcaagtttaatagtatagccaactagctccaattcgattatagccaatccaatagctcattcatataataggtatatactacactattaatatctagtcccacttatcatacacacactgtgtcttagagtccgtgctacagctggctacaaatctatagtccgctgctcctctctctctctctccttatttatcagtatgtttacagatgcatgctctgagtaggccacgtaccagaacattcgggcattgccaggtccacggtacgcgtgtcacctcacatgactccgggacgtgtgccgccgcttaagcccgctctttatacgtgccctgcaacggcaatactctaccactgtacagggtagtagatctttcgtacgttggagccggccggatcgacgaccatggggtgcgacgacaagtgcgggtgcgccgtcccgtgccccggcggcacgggctgcaggtacggcgatctggtcgcccttggcatcttggcgaccgtgaaaccaactgaacaattcaagtgtatgtccacgcgtgtgggtgcaggtgcgcgtcttcggcgaggagcggcggcggcgaccacacgacgtgctcgtgcggcgaccactgcgggtgcaacccgtgcaggtgcggccgcgagtcgcagccgacggggagggagaaccggagggccggctgctcctgcggcgactcctgcacctgcgcctcctgcggctccaccaccaccaccgctcccgcggccaccacctgatccatccatccatgcgcccaaaaatgcccaacgagacgtgtttatacgtgtggttaagcgtgtgtacgtgcgccatgcttagtactcatagctgcttagctaaacagcacagctgataaataaaaagggcttgctgcttgagtcgagtcgtatcccgttgtctagttctggctagactcgcgcatcacgcatgcaacggacatggtgatacgcgagggatggagagttcggagttgggagacactgtgtactgcagtaccaggttgataagtgtgtctgtacttgtgtaaatatgttttacatgaataaaaaggttggtaactttgtcatgtttatcaatgcgaggggcaatgcttttcttcttcgggaaacaaaaatgcgaaactcagtatggaaacatacagcacagctgacattgttacctggacaaacatctctttagatgaaatgaactgaactgcaattctgcaaatatcatacacaaacgttcagagtaattcatgaacatttccacgtcaaatctgactgctccattatcgagcacagcctctgaactttaaccagaaaagaaaaaaaatggtgcagtaacctatcatgtatttgccaatagaatcccgagagcagtgcaaatgtcaaatggatagagcaaccaacagagaagacacagcactagcatggcagctgccttgtctagaacaaggccagctaccttaattaccttatgcctagaagaacaaggctgcgttatgatttatgaagataccccaaaacacaagaaggcatcaacatacatcttgaggattgggagccgacaattgcaaaggtagacccatattctatgcggtaagatccgataatttcatatgtatgtacatcaacccaaatagtcaaatacaacacggtaaaaacaaaggcatgacgaccatgtatggaaaagttaatggtgggggtgggatttctttgttttattttctcctgagactgtagacagacgctgcgtttgaacttggaggggctaaaaaacctcttgcaaaagagcggagttggtgacgttatgggcagcgtctggtacgctttagctactggccaagattgccaagaagacgctccaccgcagcattcacattcccagcagttgcgactagcgcctggatgttctctgcagtgtcgatgaaacccatctctcggagctgagtgagctgtgttgcatacagttcttccggtggaactgaatcacaagtgtaaaaccataattagtgatgatacaaaaacatggaagatgataagagttactatacaaaccattggatgtattgggtacacctatgccacctccagcaccaagcccactaagcatgcccatcaaggtgtcgaggctaacatttccccgcatgcctgcattttatttcattggcatttgccacattacttaacaaaaaggtgaaaaaaaatgcatttgtaagaatttaattatcaaatgctcagtactcgaattaccactacacatctaacattgctccacaatttagaaggcagtacagttgactacacaaacaactcgtataatctcttccataccaatatagcacagtcaagcagctaaagagctcagacacgttcaacacataacagattacttaaatggaactatggttgtgactaaaggtgtagggagctctcatccattctccaataatcaaatccacaagcagcattcagtcataggcaacccatttccatttctaagtaaggaaaaaaaatcatacatgtgtcacgcatcaccccaaagaccttgttttgcgatccccaaaacgaggcctggtcgcacggtcgcaccatatcgatcattgatatttctttttttccaatatttcaaggaaactcaaatttagaaattccaatgttatgcaccacaataaggtagtgtcaagaatcaaccactagtaataatcatcataatgtgtttatataatgtaatggccttatggaagaacggaaatcttgaagaactaatacaggtcaaccaagcagtgaaagaaaggcaactattggtgctagaacgaaccaccactaaaagataactcagtacgcactaaaacttatgtaaaacctgacatactaatccatcttaaaacaagaaaagatattagatggtgcatattaaaaaaacaatcaagagaaaatacctgtcgcattgcctccttggctaccatccctgaatcaagaaaatcaaaagataattaacaaacacataatgaaagaaatacagtataaatgagctagatgcaattcaggtactgttgaacaagagttactcactgcctaggttgattttgaccaagctgtgataataatgtctgctggaacgagagtaattgctgccaaaaaagggaaagttaatctagatagagatggagctagccacatacataaaacgtaacatatgttacctgcatagtttctggggatgtaagctggcgaataaattctggattttggaacatttccctcaactgagtgtttgattccatgaggttgcgtgtatttgggttgaagttaagcaactgtggacattttaaattacagaatgatctgaagttatgactctaacatcatcaaagttatataacaaaataagttaagaaataccgtacctggttcatggactgtggatcagacatgatattctgcatcatctgcatcataacagggttttgcaaaatctggctcaaggaagaagaatcaggagaaccaccaagcaaacttcccaaatctgctgaacccaaccctcctagaccaccagtagcaccagttcctgtattaccggcaagaccaccaaataaactgctcagatcagctgaccccaaccctccaaggcccccagtggcaccggttcttgcattgccagtagaacctgcccgtgttgctccttgcgcacctccagctgtcaatttaagtgtgaaaaaacaatagatatatagattatcaaaaacagaataaacaagaggattgagaacataccattggagctccaaggatttggaagtggattagtgtttggagcaggggttcctgttgtagactctgagccagtatttggagcatttgtagcaggatcccttggttggttagaaccctgatttccaagaagagctgagaatgggtttggagctgtgttgccttctccacccattgttgtcgcatttaggaaaggctcctggacagtttcatacatgcgtcggagcatattaaacccttcaggagaagact

SEQ ID NO: 67641 - DNA, 2470 bp, Oryza sativa
gccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaaaaagttaaagcaatgatcatggcataagcagtgtagggtgatcttaacataaccagtagcatactatgcgcatcatgaatgtcaggaacaggaacataccagtaacgcgataacatgctagaggcatcatgtagaacaggaacaagaacatagcgcacatagtatagcgatagcgctaacaatgggaacaggaatagcgctaacaacagtagcaggaggagaagagtataccccgagaatggccctccgctggatggtgaggcagaattgactccgttgttgttgtcgttcacggcacctcctggcgcaccagctccagatccagctcctgtcggcggcgtaccacctccgccagcagtagcggcggcaactccagacatggcgatgagcagtcgtgcgggaggcactccccaaaaacctgatcacccgcctacccggtgcagatctcaggcgaaggtgtggtttcagaggcactgctccttccaatctctcatgcgcgcaagagatcagaagcgaggaagcgagagcaactcaggcgcggagaagaagaaactaacaccgggaaataagctaagaaaacggatcggactcgcaccgggaaagaagctaagaaaacggatcggactcgcggcctccttatctatcaggagaaagaacgtggacgagctgttgcggagggaatcgtgggaacgtgggttagtgcctgcaaaaggatagcgacgtgacgcgcgccgcgacctcgcccacggcccggcgcgcgcgcgcgcgcgtggcattccgacccctacctcaactggtcaacagggagcctccaataactccctatttaggttgagatatttctcgcttaaatcctgaggtggtattattatcctcaacaattattatgggcctttgagatttaatattataagttgggcctagcccaattattctaacagatttctgaatacatagatactaaacaaaatatatgtaagacggcgacttcaggcaaattaatggcactaggtggatccggccagttatatgggcccgtcgtcgggagtatatatactctttatcattttggaacttgggaggataagtggataactgttgcctgtcaggaagataacgggtcaatgaactacggatttgctgaaaaagtgtcgccacattatgtgactgagtacagtcgaattttaacggctgggatacgctgcgctggacatcgtgtgcacgatgcacatccgtttctccacctgtttatccctttgcaatttttttattttatttgttgatccggaattgctatgggtttgtagcagtcaattttgttgttgtaattatgtatttatacaaatttactgtaattaatatgtaattttgggatttatatatgtaattttaggacaatttaataaaaaatatggcattataaatatagctagtaccatgaactatgcatagcagaagaagtagcacattctgttaccttgaatgttacgacacaggcacagagccaacgccaacgcgccgtcggctaccttaacccttcaccagctaatttgtacggacgaggaaatcgcatgggccttgaaaagaaagtacccgcaagaagaagtgcaaacctcgtgacctcgtgttgggcctgacttcaggataagaaatgtggcggttcaaattagccggcttccaacaacattcagttttgaaattactactaatttttattcttgttaaggcattcacaatgggtctccgtggcattcagcctcatcaccacccaaaaacgagtattccttgccacatcatcaatctatgcagcctccttaggaccgcgtagccaactttggctacgggttcctcgtcgcttgtgggaccacactctcactccgtgccgtcaaggatgggaaagaagagagaaaggggatagggggaggcgccgtcgtctgctgctctgctcggcgtcgccatcgttcgcgtctttcacccgccgccccagcgtggagccctgcccgacgccgctgtcgtggtcgccgccccgccaccgcggtcgctacctcgctgtcctcaccgccgcttcgggggaggagaaaggggggggggggggggagt

SEQ ID NO: 67642 - DNA, 2906 bp, Oryza sativa
aacttgcggcacggcagaaacgacacgcgggaagtggacagcgtgttgcctgcgtgggcggtgttgtcccgtcccacaaggctgacatgtcgccatctcccgatccaccaccacgggcgcacgcgcggtcgcgcgggggccgcgaagcgatgcgccggatgcgtaggtgagctgagtcggccagtgcaccctccccctcctcctagtttccccaaaccatcccccgaccggcgaacagctcgccgtccgccccccgtgcctcccgccgcgcgaattcacttccccctacgccgggggctgttcctgttgctattatagcccccaatggcggcggaggctcgggccgagagccccgccgcgcccgtcgtcgtacccgccgcggcctcccccgagaagcgcgtgctctcgggtgacgccgggagggaggaggagcggcccgagccgaagcggcgcagagcgtgcgtcgcggcgctcgacagcgtcccctgcgccgcgccgccgctggttgacggggacggctcgtccttctccttccagcacgcgcgcggcggcttcgtggtgctcgagacgacccccaagttcgggtccttcaacccgcccgccgcggctgccgtcggcccgaagcctgcgccgcctgccggtgccgggcagggctcgccggaggaggaagggggaccggctcgcgaggaggctgaggccaaagacgggaattcgcagttagtggggccgggcgttcaggggcagaagacatgagtgctgactttgttttgacttttgaccagccatgcaaagtttgcttggagcggtagccaactcgtagtttacgtctactttttttttttttgtgtaaattggtcccatttttctcttggtgtcgatgcagttgtgcatcaccattgttgctcatttctgttgcagtcatgggttgttacatttgttatggaatggaaattttcttcaaaaatgctgatgtaacatgtgtaccaaatgagcttctcccgtcggctgcggccatcactcctaacaaacacttcttttgtaaaatccaaacctggtgctttctactcacaggaagtgcaaacagtttttgcagggaggatgtattctgtcatatcaagtgtgtcacttggtatgcccgtaacaagtttctacgacgcatgctgcaaatacacacagtaaacgatcttacctacacttcaaaatcaatgattgatactcctagtcccgttaacaaatttcaaggtggaatggttcttttcctagtggaagtaccattttaaagctaatcacagtgagtgcacacctgtatgttgtatcctgtataaccgcaaaatgagatctaatatagaatccactccctcagtcagaaactgatgctacctccggaggtaaatcttcctcgctagtgattttcgatgagattggttctctgtaccactcgttctcattacgagtgaggaagcaggcctctgcaccaaaaaaaacatggaacgttaaagatgacagccatgatagctactctctctctctctcttgtgtctatttatattttagaactctgggagtgtttggctaatgggatagggaaatgatttcccacccaccaaaatgcatctttaaatcctaaccattcattctccccgttccatttaatccaaacatttcattcatttcccaattccaatcccactcctcatttcccattatctaaacacaccctctagttttgccatatattcagcaattgtaaaaccttgtcacagtactgaaatgaaaacatgaatatagtgatggggaacttaacaaacctgacacaaaagtatccttgtagtcatcatcatcatacacaaatgcaggcggatctggtgaaccaatcccaacaattgtgcttccactgcgtggtacatatacaatattatatcacgtaatttatgattgaacaatgttccataaaacatagatatacttgatatatgcaatatataacctccaccttaaatatgcttacgatgctaaattggtagaatgattaattaaacatcattttttgacttttggcattttcgatataactggtgattacacaaccaaaatttcataactaaagctctaaaataatataatgactaattaaacatcattttttgacttttaacattttagatatcaatgaaaattacacaaccaaaatttcataactgaagctctccagagacactttgaaaatggctacactatgaatgctatgtttgggaatatgattgctttcaaaattgaaaaggaaaaagaataaataaattcatgaactagcttaagcgattgaaaaatgtggcccccttaccttcctgacataaaaacagcatcataatctccccggttagcagcaattatacgtttcttcaacctctttagtgatggcaacacctcaaatgctggaggttctggaaaagatggcaagcacacgtaccatatttcactgaatgttatttttcaggggatgcttactggatgtaattttaaaaacattattgaatataacataagttctggtacgggactagcatacgacaattgctgataccaaattgcatacctagatcattaacacaggcatcctgtgatatcccattttcagtaatttccttgagcaataccaagggatcagtttgacttgtgtgctctaacctgagccgctgcagtgcaagtattttagtaaatgattcatttcaaaattcatgctatgaaaatatgttaccttgtaaacttcagctgttgagcatgcttcaggtggctttactagtaccatcggcaaatttgctggcaatggattccgaatatcttcaacaatcttcatacatttaagtccagagttggagattatgatcagacatttttggagcaaggca

SEQ ID NO: 67643 - DNA, 536 bp, Oryza sativa
  unsure (1)..(536): unsure at all n locations
aattcgccctatagtgagtcgtattacgcgcgctcactggccgtcgttttactaagattgagcaagttacaaaatgtattgacatcaagcctaatagggagggaggaagaagaaaaaaaagtaactgatcaagccctgaaacctgatacgggaacgcccttacaaacagttgctcactctgaatggtgaatggnnnnnnnnnnnnnnnnnnnnnnnnnnnnntgagctgatgcagggactgctgagtaagatgaccgccgacagtgcatcgaatcaacattcatcttgtactcacctctccacgttcgtcctgttaaggaaaatagaataaagacacttagttaggtaaaaaaacagtaaggaattcgcatcataaaacacactgtaagaaagggatcagggacaatgaattaagtgaataagtaaagatggaaaaggaagttcgatcggatgtggtgcgaacttgaactaccgccctacataagtacggtacaaattcctttccagcactggggtctacatcgacggcccctcct

SEQ ID NO: 67644 - DNA, 744 bp, Oryza sativa
tgcttaaaggtcccggttttatgtgttttcagctcgcagagaaggaaaagcactataggtgtcagttttactgttccggcacctatagtatctatagtatctatctctacgtgcttttttaagtagtgtatgcatcgacagtagccatcttgccatctcacctatcaaacattagttgtccagagtctagacgctagatgttatttttttcactactctcatccaaaacatgcaaatacgtattcagtactctaaatgagttcaaatgaagaaaaaaattatcaactaaaaaaatgtagatctcgtcaaactatataattttcatataaggtttgtctccattcataatctttacatattataaaagtttaagatgtttttgccagatgtttcgtgcgtcatctgacttcgattcctgctcggcttgcgcactatcgcccactcgtgcgcatcagaatcgggtccgtgttagtgtccgacttctcccctatacctgcgcatgttcacatcctctctcacgagttgttcgcacgcaccagccggaaaaaaagagcggagcatcgatatgtcagcaaatcgatccgactctaatccaaaccgatacgtcacacaaataataaaatcagcatgagagatatatatagacttatgctgtgttcggcagcccctcttcctaacccatctcccttattttctacacgcacgcttttcaaactgctaaacggtgtttttttttaaaagttt

SEQ ID NO: 67645 - DNA, 3611 bp, Oryza sativa
ttaactgtgaatgatagtgtgtgtgttttgggctaaactttatcaaatagaatgtggcctgcgtgccttaaatcgtttgggccaacggtccatgtaatcaggagataaatactcgagagagagaatggctgtggccaacctggcaaaaagaaatcgaatctatctctctccaaactctgtctctcctctgcctcagctctgtttctcttcgtccccaactccgatctcgtctaaatatctctctctctcgtcggcggcgagtttcgcggtggcgtagtgttacactttgcttatgctgccatgcaggtgagggagatgaacttccggaatgaaattcccacacatgagggctctgagacaattttgtgatgttgatttcatttataccgagagtaacgtgcaaaccagcggtaagtatgcaatattttaactaatcaattctttctaattcaagtatcaattcaattaatatttttctgtcgactttgtgtggattgagaagttatctgttgactctcctgtctgtgaagtagtatcagttactcctctcaaataatcaccatgattctgttctgctatgcacttctctgtctcagctgtcctgattaatagtacttcactaacattcttgtcttgtactcgccatggcacccctgtgccctggttcataatgttcgatctaccctttaaaataaacgatcgagattcattctacttgtagtagaatactgcaagtagaatgcaccagagcgtacccctcaatataattgttaaatctctgcagtaaattaataaagctgataaatgaagccaggttggaatatgactgttcaatatgattgttactttggtggctggaattaatttccaaagtctgtatccattttatattttctctgcgctacaatgtgatattggatttggtatacccaaggtcttcactgttccggcagctaactaattagaggcatcaaaatttcaaaccacatacatccctatcttttttcttttgtttcttaactgtactggcgcactgaattttggggtactgatttggtgtgcttttgtttgatattggttaccttcttctcttgggagaaatgtttagtctctgctcccttgctacacttgcaaccaagtttgtcttctgagaagttaaattagcctccatgcatatggcagtttgctacttgctggtctttgagattgtttgcttgtcaattttgttgggtatgtgcaattaggaaaatagtttctgatggagcaccactaattttgtttaatttccagttcggctagagttggaacagatcgtggattcgtggtgatgattctattcaccaaaatgaggtcaatgaccaatatgaaagtgatactcagcaaattctgattctttcacctgaccaatagtcagccccatcctcttaaagttcaaaatactgctgatcatgttgtagtggatatctatagacatataagattctatagattttaggaggggcatctcagatgctacaagtgtaacagcaccaagtcatggttgttgggtgttcatctgacctcattgttgcttgttggttgctggacgtacagggggcgaaccatcagcacctagttcttagccaggaaagggtcaagctgggcgattgtaagaaagcgttgggccggccgacgacgtagctgccggcggccggcgactgtgctggggacggcaccgccgagccaatggccgcggacgccgtcgttcattgctgcctaccgtggatttgtggttctaattttcattctttggatgtcatgacaagtcacccggcaatctactcgtccaaaaatataagtatttttaaatcctgatacagtattcaagatgctactttgaccagcaatatttataaaagtaaaatgttttaaataaaaagagttgcatattataatagtttatttaataataaatctagtaacaccaattttacatgattgattttttttttgttattaatagtcaaagttaaaaatatttgacttatcactatgctaaacatgcttatatttttggaacggagggaatagatttgtagcaaccaacaggcaacaatgacgtgctttggtccgttgtcagatcattcatatgtctgttcatgtagagctcggtggattttgaggctgaaaatggaccttctagcctttgcagttcctatattggtatcttcgaccgttacaatgtgcttgctttaacttgggtgcttcacatattatcgcatcttcattttttcttttcatgtgcctttcagacctgatgcttggctctgtttacattagtggtcaacagtttttataaaaaaactttcaaatatagtgtaattatattataactattatgtaactactatctaattattatgtaacttgcacaaaagtgcaatggagcaactggttaatggaggttaactagcaaaaaccgttgacttagtctatagcattccttgtttttttttattttttggaactggtaaattcctgaaatttggatcgaacggtggtgagggcacgatgattgcgcagcgtacaagtcaaggccaagtcgtcgggaacgtggacattccgtaacggactttccaaacgccgtcgctgtcgtactactccctcccgcttctcacgccgtcagcgctcgtacaacccgaccagtagtactactcctagtacaacctcgcctacccgctgcaaccataccccacccgacatggacccacctgtctgccagagtagccgacgtggcacgagtaatcttaaccccgcgagccaacccgcagtacaaagtacataaacgaagaggccaactatcattttactatctaaaatcattttaaatgcagtcgtgtgtttctatatccaacgtttgactatcttaaaaaaaattataaaaaaaataaaaaatagtcacacataaagtaacatttatattttatcatataataacaataaaaatattaatcataaaagtttttcaaataagatggatgatcggatataaactgtctttctagaacggaggtagtaattatcagtgacagatgggcccccacgtcagtcttctcccgccttccgtataaaaacggcctcacccgaatcgcgtttccccaccatttggcgcacccgtcatcggtcgaacaccacacctgcgtccatggcgggaggcaggggagcccgcgccagcctccacctccacctcgcctggctctgcgccttcgcgaccaccgcgtgggcgcatggcggtggcggcggcgggggcgattctgacgccgacgccgacggcggcggcgaggggaagccggacctgcgggcgcgggggctggtggcggcgaagctgtggtgcttggcggtggtgttcgccgggacgctggccggcggcgtgtccccctacttcatgcggtggaacgatgcgttcctggcgctgggcacgcagttcgcggggggagtcttcctcggcaccgccatgatgcacttcctcgccgacgccaacgagactttcgccgacctcctccccggcaccgcctaccccttcgcgttcatgctcgcctgcgccggctacgtcctcaccatgctcgccgact

SEQ ID NO: 67646 - DNA, 11436 bp, Oryza sativa
ggtttctggctgcttcaagggtctggcggagaacacttggatcattgagaacatgagcaagatctggattccggtcgatgatatcacgcatttgaggattgttcatgatcatgttacgaattaaatcagggttattcatgagattctgcatcattggcatattcattatttccctcattaagttggggttttggcttaactgctgctgcatttgatccaattctggaaatccagacccaaaaagaccagatggcctggtaccagcagttcctgtaccaccaaggccaggaaacaaacttccaagaccatctgttgggccgctgctaggagcagctgaagcttgggggctggctgcagcaggtgcagctgatccggctgggggaccagcgccacgcaccatatgaatggtatgatctgtttcaacacctacaaaatataaggagtgtgagaagcaagaaaagaattatgcttgataagtcagaaatttgaacagcgggccagcatatctacataaacaaagaatattccaatatctgatgtaatcatatacaagagaattacaaatgaaaacttctaaagaattcacatgtgagagactaaagaagatagtgcatcggatgactatgccataaatcctcatttatggcatgttaacatacttagcgtgcccaatatttcgtattacatgagaattacttggtactctctcataaaaggtaacaattttcccagaagatgtttttcttttttgttaaggcatcattgattcaacgcatttatttagcagcattccaccatgtaaggatgttcagaacatgtcttttgaaagttgttcccttcttttcctcaaatacacatgcacgattggccaattaactaactaacgttttcctcatatggaagtttttgcatagcaagaagctacaatcataatcaatgtaataattagttagcatcattacccgctgaaaataaatatgaaaccatgagctgacataaatacgagttccaaacatatatacacttcctgcgaatcagcaaacgtactaatttattgtaacagtagcactagagaaacagattcacgttttccttttttttcaaaagacagcccactgcttagttccattaaacagaacaattgtttggtttactgttctcggtcactactttgtaatcaacggaaagaaaaggatgattttacatttggtgaacccatttccatagcagggttgtgcacttaaccaaatagtgtttaagaaaaattgttcagttgcattgcaaacaacaaattgaagtatttacttgtatttgcacttcataaactacattcaataataaagtgcactctacccaaagttcacagataaaaataaagcccatatgatgcttcatgagaaaataaattaactttcactacaactccaagaagattctaagatgtcacacattgcgacataataacaacgtatgcgtaactaatacgagcagtagcttacatggccccataagtccataacatttggaactatattcgagtcgcgacaagatgagctgccttcagcttcttcatcatcttatacgctacgtaagagtaaccgttccgttcgcagtatacattatcattaatacactacacactctatactcgcatcacccaatcaccaataactgtgtagagaagcaaagcatatcgacgaatctgtttcgctagcatgcatagggcaccgaagcggattgctgcaccttgtcccccatgaacaggagccccaggtataaacaggcattgcatcgacaaagctaaatcgcggcttcttacaactacacgactgaaatcgagcacgtagcatgtcaattccaacccatcggaccaaaaatcctgacgatttgatgggttttttttctcctcctctacctaacagtcctagacactcaccatagctttctagggtttgctcgtccttgaggatccggcccttgtagatcaggcgctgctgcgccgccggcacgtcgcagctccccgccaccacctccttgaacgcccccaccgtggcgtcgaggtcggcccgcacggtgaacttggacccgttcgcgcaccggatgtgcagcgccgcggcccccgccaccgccgccgccgcagccgcagcaggagaggactcccctccgtcgccgcccccggcctcgcctcctccgccgcccatgccgtcgacctcggcccgatccgctcggagtcggcggcctcgcctccgattcggggtcgcgtcgcgtcgcgtgcgtgtgcgcgtgagctcgagttttttttttctttttcttttcttttttccttttttttctttcttcgggagaggggaagaagaggaggaaggagaaggaaggaatcggctgcgaggcggagactttttaacggcggggagcgacgcggggtggatgcgatggacggcggagatgcgttgcgtgcgggtgtgggtggagtgtgtcactgagcggtggggccacgcgtggaccgacgcggccagtgagtccaggtcggtgtgggggcggggcgcggggagaaggttctaggcgtgcgctacagggaagcttcctcctacgctttcctttttgagtaaacatgtcttcgggattttgaggggtcagaatttgtgttttatatatatatatatatatatatatatatatatatatatatgcgaatatataccagtggaatatgcactgtggctcttgagtcttgatctggatcgtccgatcgagacactgatcaaacaactctttttaacggttatgctgttgagtctacttctaatatagcttgagcaagtgttcaagtgggtggtttgttgtggttgtcatccctgtcgagagaaaccgttttgtcaaacatgatacggacaaaattgttgtactaaatatatttctttcataaaatttagtacatgtgatgtgatatttttctatctatataaaattatccgcgttgcgaaagatgctactctttttttttataacaatagtgtgtgacgatgctagtgaggctattttcatagtttactggagtgcgactttttttttatgtagctgaaatatttttcatcggtgacagggtaaagaattgtagtttgtgaacaatgttgtcccgagggaatgccccaaggcacgttggaaacgcatgacgcatgtgtaggatgggagttggtagttgcattttattaaatgccatatgtctcagcaaaactgaatatcggtgcggaatcaaaacttgcatgagaaacaacaaaacaaagtggaaatcaggcataaaacatggatcaaaacgttaaatgaactcactttatggcccaattacagatagaattgtccaagtccattgggccaaaaaattccaataacagcccaataccaaagtccccgcttgtttatgggccagcaagacctcctggactggactatagtaggccttatcctttagacttgccaatttacatgccttcggcgcttggcccagtgcctgatgtttgcgcaccagaaaaaaaaaagagtttttgtacctctctctaaaaaagttcagtttacgtttaacagaagaaaaacagagttcagtttagtttgtcaaccggaagaacacataagcaacacagagcttagcagtgttagccttagcttacattatgcagcggttcggatttttaattgttaaatatgatcggaatttagacctacaatatatttttattagttttctaataggacttcacatctttttctatcacgtgtctttccttttatctgctacacatacatactcttataagcaatatggaaaaggatgacatccctattattatttttttttgactgaaaaaggtagagagactctaccttataaccattatattaatggtagtcaaggtgttacataaagagatacaaaagaaccggataaagagggaggaagaagagaaaataaggagaaaagaagaagaagaagaagagaaaataagaaggagaaagaagaagaagaagaagaagaaatacaaaaaacaggagaaagcacggaagaactagaaaagctagctacgctagtaagtctatccatctgcatattggaggtcgacattgcggcttgatgtgatttccctataattgtagacattctctgatttgatgtgtcacatttgccgtggtaagatctcgctgctggaatgttctatggttgcgtgctttccataagttgtgtgcgcaggcgccaaagcatattggccatccaggtttgagatgtgagggcgtaactgtcaggacttgctcaacaaagtggagaatgtctgtgctttgagttgccagttcatagatgttgagtttcttccaaacctcagaagccacgtccctattattattttcctacatttgtgttcatttctttatagtgattgttgtcaaagaaaaagccttagcttacactacatgtctacattgctctgcatcttgccgtctctgtccatgccccccaactgcagagatacgtgcgacatggcgcgcgcgtccacgaagccagcgcttgacacgctgtggcgcatgcggttcgccaccgcgcccagagaaaaacgctcgcggaaaccacacgcgcgccgcggcagccgctcacgggcgggtgggagactgggagcggagctgaggcgcccggtgcggtgcggtgggcgcggtgtgaccaagttaagccaaaccaacagctccaagccaaaaaaggatcaacgatcattcaacttcaaggatgggtgtgcgccccatctgctacctaccagtaccaatacctatactatggcatgtcctccgttgattgtgtccgattcaaatgctagccaaggcaaaggatggttcgttgtttggcgtcaacgagattgtttttttgaaggctgagaagattggttgccccaagtcaaagaacaactgcagatcgtcaataacgggaaaaatgagaaatatcgttacgacgcagtggttgacggtcactcatgtatgactccattaatcgttctcattactagcacttaggccataaaaaagtcagaactgggcctggtttagttctaactttttcttcaaacttctaacttttccatcacatcaaaactttcatacaaacataaactttcaacttttccgccatatcgttttaatttcaagagtaaatttcacaaaactacagatactatgaccaaattatcacaaaactacagatttaactcggtgtatcacaaaactacacatttaagatgaagtgtcacaaaactacatatttagtaactaaattactacaaaactacaagtttagaatcaatttaatcacaaagtaattatgtttatagctccaccataacaatggtgctagggatttaaactccaaaagttgtagttttatgataagttcaatattaaatatgcatttttatgatacttaatctaaaatctatagttttgtgataaatttggtgctaaatatgtagttttgtgagacaactccttaaatatgtagttttgtgataattttggtcaaaatacctgtagttttgtgaaatttactctaatttcaattaaacttctaattttgacgtgaactaagcacacccttagagagccaaagtttagcacatggcggtgtttagttccacgccaaaattgaaagtttaaagaaattagaacgatgtgacggaaaagttgaaagtttgtgtgtgtagtaaattttgatgtgacagaaaagttaaaagtttaaaaaaaatttagaatctaaacagggtcacagtaaaattccgaaattggcttagcacatagtacactctactgacgaatgaatatgtccatgtgttctgccctggattctgaacttccttttttcccaaaacaacagcagaggacggctgccatcagagtatacaattccagtgaaaacacttttcgggccgggacagaaacacaaaccactcatttttttaattaatttttgaaaatcaaactacatattaatttttcgacaaaatttattatgattccgcgaaatctgatgattcgatatcgagattgtgaaccctaccttccattcaattgagaatgagactccaatctaacttgattataataattctattttcctccctataattaatgatgattctgatttaaattatacaaggatttcaggttggggtgctagtagtatgcccctgttaggtctggtcattttcgcattaagatacacaagtggcctacagttatgatgggcttttagcatgattgttgattgggaaccatttcaatacgtcattgtcatccataagcacaagccttgggcatcaggtgaacatgaagcaacggcctaacttgttctttaatcagctggatgccaaataaagagctataagagggggaaaatgatctgtacatacaatatttgactatccggttccttattagctcttacactgacacaaaatggaataaacagatactcctatatattctgaatcgagaagaaaacgacggaaatgcggatatcttttggaccgagcttaatcttaagccgctccaagtttggtaagcacacgcctttcacaaccatggcctactcaaactattttggtttgaatcgatgaacacatcgatctgtccattcaaagagcgagtcgtagttatccaaaccgaaacggctatcctggatggaccagaacagtgacgtgtctggatcaagaccgatgtaaacgtaatcaatacacagagatttttgtcccggcggtggcgcagcgcggcgagcccgcgactgacgccgccgccggcacggcgtggacggtggacgtgacatgactggaatgggctcgatccgcgtcatgcaaaagctaagctggtcttatcccctcaaatgatcaaatccaaatcacccaatcccatgtcacacctgcctttctttcccctcaaatccagcgccttttgaaggcataagccttccagggccaaaaagaaaaaaaaatccactaacgatgactcacccagattaattaccctgttaaaacaaatactaataatcaagatgactcagcaggattatcaaatggataaaaccacaattacgcaattaacgaacaaagctctactagtaactgccacgtggggcgagctgtctccccctgcgtcgcacgcgtgtccaggcagtcggtggcgagtcctccagcctctatatccggcacaggtcggcggccgccgtcttcctcccgagcgcgtcgcgtgtccaaaacattctgcatttctttccgcctctctctctcgacccgcggcagcacagcaccaagtattttgtgggggatacgagcggcaaaacaggtgaaagtaactgcaggccttgccgcgtggtggtgtagccgcgtaggggtggtataaagccaaagccgttgtgcgtaagcatcccctcgacttgttctcccaagtaaaccacttcagtttcagagttttcgagcgagcacgttttcgtagcttccgtcgatcgaattcatggccgttcggtgttgctcttccatggcgagcgccagcgttgtcctcttcttcgtcgtcgtcggcatgtcggcgtcgatggtctccggctgcgacaggtgcgtgcgccggtccaaggccggattccgcgactcgtcgatcgcgctgaacggtacgtacggcgagagagagggggggacagagacatccactcgcgtgcgcgctttgtgtgtttttgcttggttgattactgcaagattgtttggttgattttggttgttggattgtgcgtgcgtgcagccggttcttgcgggtacggctccctcgccgcgtccttcaacggcggccacctcgccgccgcgagcccggcgctgttcaggggcggtgtcggctgcggcgcctgcttccaggtattaacagagccacgaacaaactctccaatgcagtgatcgcgtgctgttctgcaatctaattgaggcgaatttgggttcgattaaccgggggaagtggcattattactactgcaggtgcggtgcaaggacggcaagctgtgcagcacggcgggcgccaaggtggtcgtgacggacgaggcgcggtcgacgaaccgcaccgacctcgtgctgagcgccgccgcgtacgccgccatggcccgccccggcatggccgcgcagctcagaacacgccgcgccgttgacgtcgagtacaagaggtaaaaaaaaaaaatcctcttttggtgtcggtggtgtaatcaactcaggtagtgatgatggatggaagctagtagctcatcatccgtagtatagagtaataattggagcacagcgattagccacagttagctgtagtagtacaggtcgcaacgcatttttcggctggatttatgaccgaattttgtacgatattatcgagcagggtaccgtgcgagtacgcagctggtcgcaacctgtcgatacgcgtggaggagaagagccgtccgccgcgcgagctgtccatcaggttcctctaccagggtggccaaaccgacatcgtcgccgtcgacgtcgccacggtaatcaaataaaaccaaaaccaaatcgatcgttctcactcgaattcgaggcaatttttgaaaacgagttcgaacatttttttgtgcaggtcgggtcgtcgaactggaagttcatgacgcgggactacgggccggcgtggagcacggcgcaggcgccggcggggccgctgcagttcagggtggtggtcaccggcgggtacgacgggaagtgggtgtgggccgacggcgaggtcctgccgcggcggtggacggccggacgggtgtacgacgccggcgtgcagatcgccgacgtcgcgcaggaagggtgctacccgtgcgacacgcaggagtggaagtgacacacaccgcattaacatgtacagtttttttgctttcctttcttttttctctcccctttttgggacgcattgagcagctagccatccatcgaattaagagccacagcccacaagaacaacttgccttccgttgcatttgcgttgcattgcccagtggggcttgttttgtctcgtgttgtttactcgactcggggtgcggaggtgcgcacgcggtggccggtgccggacacgatctcactgtgcgcgcatgatggggggttgggttgggttgggtttgggtttggtcgtcgacggcgagtggatttccgctttcgtgcccacgattccgagtgcgcgcatatgccgcggtcgcgaaaacgtaagtgttggcagattcggtggacgcgctttaacgcttctgtagtacggatccaccggtgtaagggccaatatagctggccaattggatgatggatgggctgcaatcttgtaatttccggggcttttcattggaccgtgggctcccaaatagggtgggacaaaattggaatgacaaaattatctgtccttatactgtgtgcagcatggccgaaatggtaaacgtcaagaagtccgacataacaacgattgttttgctgggcctgtacaagtaccattcaccgtgcagcaatagagaaaaagtctaatttggaatccctctcaccattaaaccaagcaaaacgactcatcgtgccgccttggagctccacatcctccaggctccgccctggatgtgagccgttgatgccaccatcgtggattgcggtgagagcaagattggggatcggggaggaagagatggatgggtggggggagagagagagagagagagagagagggggggggggaagaaaggggtgtaatgccacgtcagatgatgaaaactaagtcaatttaacatgtaaataaatacacgtcaacgaaaatcacctccaataccatcggagaagttattttgtacctattttaaaaattgaatgctcaagatatttgcaatagaccacaaagttaaattaaactgaaccacaaagttgacttatttgcaatagagtaggacacaacccgcagttgctacttttggaggccgattcccaatttctgtacctggccgtgtcaggcagccatttgcagttgataaggtagaaatatgtactcccaaacgcaattacgccttaccacttgctggaacgctggccacccaccagaacgtgatcgatcgactgattggcttcgaattggagccggtgcgttgacaccaatctcgcattaatggcgctgacctctctcccccggtctcggacagccactcgcgcagtcagacagtggacttttgctttcttagctacactgcagaagagatgcagcttgttcccgtgaagcggacatagactcggctcttttttaaaaaaaaaaaactcaagtttatttatagattaaagaagggagtttactggagaaaattccccaatgcatcaccgtaattgatacaacgtgcagagcgaaaccatctttttggaaggtaaagccaattaaactaatggaacaaacttcccaaataaaccgaacaacagtaatagatgtgatcgacaagagactatgatattgctctaggattgtatccacaagactctactaataacgtgcattccgcttgacagatcgatgaccctttcgactgcctctacgggaacaacacgattcgggattgatatgtgagtcgtagattttgcttcagcttcaccgaactcaacatcgattgctaaggagttcttcgttaaatatgaggagcgctaattgaaaacctgtcgataagaatcgtacaggaggttttgcactcaacctggacgaagcacttagcattggctacagttgtagattaaaattaggagaaacccctaaagcccaactagccttaatcatgagtcaattaggacagtggcgatagaactattaccttgctacaacccagcagaacctagcgaaggagatgacatgtgaccggggcatgggaggacaacccggtgcacccacaccagtcgattttgagcaccatctagtggattcgatttagagttgctgaggcactaggacatcgccaccatccaatacttgtcgcctgcgtctcagccactagccaccatggggcagcttggactccaaaagaatagagaaaacgggatataacccgagcaacaggaggacctgactacggagtaactctaacctaaacctatactatacttaaaagggaaggaggcccgacccctcctccggccacctctgccataatttttggggaaagggggggggggtaggggaggaaggatttactctgccatcatcatctttcatctatactactttaaatgatgttagtggtggtgtccgagtctgtctccacaccacaagctaatgtatatggccgtgaagtctccacatgtgaataactctagaattgttatctgatttttgcaacacatgtctttagctagtgatagagagtattacggtagtcattag

SEQ ID NO: 67647 - DNA, 2066 bp, Oryza sativa
gatgtgaaaacagaaggtggcttggaattggtaggtgaacttcatcatccatagtcacaaaatgtgccaagaaaactctcctcctatggtttaactgtgcaagttggagaaaagtgccaaaagcacttcaacaactcaagaactaggtgaccttgttccataaaagcttaccgatttagcaaaatcttatgtgagcaagaacaaaactaaagcaaattcatgtaacccctagattattgattagtgatttaatagtcaaaagatcatgtaagtaccaaattcccatgatggccagaagcatgaacatatggacaactatcaccactaaatagcaaaacctcacaagatcgcaattaggacaaaacttcctgcataagtgtttggtgtccaaatgggagaaataacatcagtatatgagagcaggttattcaagaaagtgaacacaagagagttgaaaagtacccaaactcctgaactacgaagcgcatcaagaactcatattgacgaggggaaggctagaattgatggattgtcctcgcaagagaagaagccttctttgccttttccctacacttttcagtccatctcctctccaccaatcttttcttaatgtttgcttgccttctctattattttattttggatatctcagaggtaaggcaactataaaaatagagggaggaaagcattggaaagtgatgttattggaggagtagagaggatagaaagggagagaatcctagttctttgtgactattcatggcatttctttctacacagtgatttaatgttgagattcttttgctattcatttcaaccagcagcatttggcaaggtgggattcagctagtattctagcaacttgacagaattattatcttagaatatgatcccttttgaagcacgcgactattaatgggaatatttcattggacaagaatacagcaggtccaatgacaatttggaagccatgtgcattttcttttcctcctctaattccttgctatcaactgctaacaaggacttaaagaatttgccaatcaattcgttgttaattgaagattttacactgaaggtctcactaacatctgagaagggatacatgcaagtgaggcatgggctagaattctaaaatggcaacaaatgaagtggcaaattctcaaattgactattgattggttatgtgaactatgttagctaattttagttcacatttatacactagacttttatgaatctcgtgatcctaatggctctcctgtgttacttacagagttatagcccgcatggttccatgtaataatataacaaaatacagctaaaatgaaagtgacatgtgacaataacagccagtgggagtgcggcatgctggcacagtaatgcccacggcccaagaacccaaacatagattatatgcagtttggattaggatagagcaataattgaccactttattgtatgtcgtcaacagaagaagtgctgttgaattatcgacatttcacatcatgcggcattagcattagccaaagcgctaggaacacatgagattacttgtaggttctgatattattcctcaacaacatgcaagcaatcacaattcacaatagatgtaacaatatcgaatatataaaaagaatacccatttttttcccaactagtatccaagaaaagctaccaacttctgaatgggacaattgctatgcttctgccaagtgcttttttgtaaaggcgatttcactcgaatttcttactgtgctataggctcgatttcgtcgtgtgttcttctccgtctccgatgacttcttcctccaccgcgaggcttgtcgatccaggcgagcggtgcaccaccggcgcatcgcgcgtcctcatccagcgaagccggcttgccagcgcagccaacgaacaccacacaaccgaagcttgccccctactccggaacgcccccacttgctccaccatagccttttagcctctcttgtttttcgcctttggtagcctttgtttcgcgcctgtcgccattgatcttcgctgccgccaacggaggcgccttaggcagcgagcgaggg

SEQ ID NO: 67648 - DNA, 29060 bp, Oryza sativa
cgccgccgccggtgcaggtgagcagcctactagggttttcacgtgcttgtccgactctgtttttttcacagtagagatatcgtgagctcgcggtggaaaggtggcggatggccgttggattagatgcgactttttcctttattgctgcgttagtacataataccacaccgattgattggttgctattattggttggactggtcagcgaaatgggccaaatttactcctcttgttttacagttttactactacctgatcaaaatcttgtgagtttgtgtgacctaccctaccctgatgctttcagcgagataggaactgatttgtttggttgttcatctttttgttggtgtggcttgtactctactccgtttgcaaatcagttagcagatcaattcaattgtggtgcttagttagttactttatattttttttgtgtctgtctgaatcgataggaacaccttggtgctactaccattttcctatgatcttatctgaatgaaagcatatatagtaggtggtggttattgcctgtactgcatagttcctcttaattactgtcctactcataagttattttgtttagcctgctgctcaaatggccaaaagagaagtatttttgctgctcgcattatctaattaagcattggattatctgcctgtcagggctggaggagggtaagctgagcagcacaaatggcaacgcctctgacccaccagcagctgtaagcacctttccttatgaactcgagtaatttatcctgcgcagcaacagcgcaggttgttgcgtttggtttccaaatggaagaaggctgtgaagtctcaacttgtgtttgtgcaggatgcggcggcgcaagaccactccgtggcgtcgatgctgcggaacgcgagcacgctcggcgacagcgtgctgctcatcgccgcgctctgcttccactccgtcttcgagggcatcgccatcggagtcgccggtaagattattattatttttttgacatagacacgcatggatatactccctccgttgattcttttaaacatatttgacgttcgtcttattaaaaactttttgtgaaatatgtaaaactatatgtatacataaaaatatatttaacaatgaatcaaatgatacgaaaagaattaaaaattacttaaattttctgaataagatgaacggtcaaacatgtttaaaaaagtcaacggcatgacggagagagtatatatatagagagacctcgtgaccttgtccgttagtctcttgtccggttgtccctgcctgctcgacttaattaacactcgctttcagcttggaatttaaatggcccgtacatatgtcttcatgtgactttttatatgaagaacgagttcatatggttaatagttaatggtagttcaggtgtctataggagtaggtgaatctgtccttttttttaaattataagtgaacagatgatcacgtataaacacgacatatggaagtattgacgggcagagcttttgcgcgttcgtgaaaaaaaaatgcttgaaagtatcatttaagcccggggtttcttcctagcttgtttcttgtgaaagtctgatagatcgatgccgctgctaactgattaggacaaattggaatcgtgcgttgttttctcggtcaaaattgcacaagtgcttcactattttctcatagcgaaagctccgtgcgcatgttgaagatagccagaataaatgaaaaaagtcctaggactcggcttatattcaaagccaaacataggcagaataatcaccccgaacccttcatttttattttatttttattttatcttgggttcacgtcttatcgccgtttatcgcaatcaatgtttctgttcactcattgtcacgcatacttttactcgttccagtctagtagaatagatgctctgacctgaatttccctttcatcaacatccatttcgacaacattttagtttgcatcgatctcagcaagctttaccaaaccattcaaatcatgaattcatggatcaccgtagtccatttaaagatggatgcagattgactgacagtggctgtttgagtttcgactgctggaaaatcagaatcagctactcacaacaactagcgtgcagagacgaaggctgacgcatggaaggcgctgtggacgatcagcctgcacaagatcttcgcggccatcgccatgggcatcgcgctgctccggatgctgccggaccggccgttcctctcctgcttcggctacgccttcgccttcgccgtctccagccccgtcggcgtcggcatcggcatcgtcatcgacgccaccacgcagggccgggtggccgactggatcttcgccgtctccatgggcctcgccaccggcatcttcatctacgtctccatcaaccacctcctctccaagggctacaccccgctgaggcccgtcgccgccgacacgccggcggggaggctgctcgccgtcgtcctcggcgtcgccgtcatcgccgtcgtcatgatctgggacacctgatgccgctcatgatttcggacgtttgttggttcttgcaggaatgtgtgtgtgtagtaagttcgtcgtgaaattagcatgtgtaaagtttgtgccactccaaccaaagtttcaggattatttatagctttgaatatatcatcaacgctggggcaccattgtttttgtttccatggattttgggggtaagaaattgaccaaaatttaagttcgaatgcagattgtcaaacacttgagagccacacatgagaagaaaatcgaatgcaaatatgtcaaactttcccctttgctgagctgatagtactgtgttaaaactacgaaatcgatctggccaagctaagaaacctgtttgctcgcctttggcggttggcccagtcagctcgggtcggcccaagaaccaggcaaggctcttttgctgcctaaaaagccgggaaaaaaaatcaaacaagcttgagaaaagttggaaaaatatatttttttttaaaagaaaaaacagcccgaagaagtgccaggcttgccaagcttgggcccgactttttggtcagtttaaggctcaggctttgcatatttctctttcgatcgatcgaccgagtttcgacaggcgtcgatgactactactccaaaagtataactttctccgttagcacgtttatgtacgttttgtgtaaaaattttctatatagaatttttttaaaaatcaaataaatttatttttataatttatgataattaatattcaattaatcaggcgctaatgagatgtcatgttttctgtgctgctgctaatatgctcctccaatgtggaatttcaaatgggttagaatagttttcatgcgtgtttggatgctaatgggatagctaggtgattgagatttgagatctttctcacaccgcatcccaaatactccattcatttcaaaataagttaacctagtatgaaatgtataccattccagaaaggcacacgtacatatgcagatcagtatatagtagatggctagatgcattgcatccatcttaaattactccccccgtcttaaaatataagaatctaggatgggatatgacacatcctaggcttatgaatgctacttatccatattcgtagttttaagatgtgtctcatttaatcatcagttcttatatttttaggacagagggagtagtagattagatggagttagacgtagcagcagtcacgatgccgccgctggcacaactcctcaacgacgtcatctagttcaacatcctctcgtgcctgccttctcggtgctcatgtgcctcgccatcttctgtaggtcctggcgcgacctcatcctccatgacccccgccttcaccatgcaacatgcgcaaatctcttcccggcgatctacgagttccacaacgtcttcttcgaccacactactagaaaaagggttttccttgacggtcatatgagaaatccacctgcggaattttaacaaggggtggagggttcaggaccactagcgaaaatccattttcgctgattttcgctactggttgcttaagaagcccgcttgcaaaaaataaccctatttttattgacgggccacttagctcaccgccagcacgcactaaagagcgacacccttgaaaaaattcacgcacagtagaaaaatcaccgcccattaaaaaaaacgccacccaccactcctcatccacccaccgctccaccacttaccctcctcctcctccatcagcaccctctcctcctccctcccaacaggcggcggctccggtggcggttctcaggtggcggcggtggctccggtagcgatgcacggcggcgacggcgacaggaggcgggctcttcttctccttctcctcctcctccccctctccctcccacggtctcgccgccaacacctcctcgccggtgactgtgattcccaaattcggtggctccactggcaaatccgacggtgacagctacggggtttggtgcgacgggaggagctcggcggcggcggggcttcccacatttgttggctcccccattggatccagctatggcaagaatcagctgctgctcggtcagcgacggcgacgacgacctccttcctttctcctgctgctgattctagcaattctcttcgtgggacgcctcctctcttcgcatgtctcgccacacactatgctcatgccataggacggcctcctcccaaggagaccgccgtatgcgagcaggcgtgtgtagtggtactggcttgtttcctcaaacataccatcgtttgtaagtttttttttctattaagtgatttatattagattgaaaattgtttttgggttaattttgatattttaaaagacattttcagatttgagtaaaactttttaatatgagttttcaactcaaagtttcaattcaaatttgaaaaaagcaataaactttccactgaaaacttgaattttgtgttgggtttagtcccacatcggtaattgatgatgggggaccacgacttaaaaggtggaggcggtcctcacccatcagactaatcttttgggttgtgtaggcccagaatctaaagttgtggcccacggttggtgggccgggctgcgcactctaacaagtgggtatcagagcccaaggtttggaacccggaacaatttccatgggtcacatggtagagaggccaggtaacaagtctccggggtcacataggttgatgtgacgacttaaaaggtggaacccgggtcacatggtggagagaccaggtaacaagtcttcggggtcacataggttgatgtaatggggagattgttgtgtttagtcccacatcggtaattgatgatggtggtaattgatgtaatggggagattgttgggtttagtcccacattggtaattgatgatgggggagcacgacttaaaaggtgggggcggtcctcactcatcagactagtcttttgggttgtgtaggcccagaacctaaagttgtggctccctgtggtggagcaggttcaatgtgacctgggtggcctacggttatcgggccggttatataacatgttgtaactcaaattttgaaacttttaactcaaaatttaaaactttcaaatagagaaagttggtaaagtcaatttgcaacttatatgtggtggagcaggttcaatgtgatctgggtggcctacggttatcgggccggttatataaaatgttgtaactcaaattttgaaacttttaactcaaaatttaaaactttcaaatagagaaagttggtaaagtcaatttgcaacttatattaagcgtacatgcgctcatcccttgcatgttatgtgaatgatcatagtataaattttctgacccttggatcaagatccgaccgtgcacaccatattcctcatccctcatcgaatatttagtcgatccaaacatcaggaccgccgggccgatatgatttagcgaaaccgtttccacttctacatgtccattgcgatccaaaacatacgcaagcgaatctcccgacccgaagagatgacaaagcatcgtttcgtactttcgtatcagtttcgatggagatttttttttccgcaactctccgacgaccttatcgagtgcaacatcctcccgcgcctgcccttccggctgctcctgcgtctaggggtgaaaacggattggataatatctgatccaatccgctccgaattcgtccgaaacgaggatatggtatgggattttagaaatccggcagatacggatacggatgcggatagtataaagcggatgcggatatggtatatctaaaatccggtagatgtggattatccgacattgttgtcaaattatccgataagccgtttgctggataatatgaaattatcaacatatataacactctatctattgcatataacataagttggtatatccaataccctaattcatcaattaacaaagattttttagtctaaggcttttatcgtctcatgtcacactcactagctatatttttttatattatggacatcatgtgttcatgttgtttagcacttaatcatataattattacgacgggtcatttattgattattatattattgttccttggattaataactcgatgttgcattgattgtatatacacgtaacatccgataaatttaatccgtttccgaaccgattccgcaccgaccccgcaccatttccgacatccaaaacaatccgctccgcatccgcattcgtacactatccgcacccgcttcgaatccgctcaaaaaatatggtttaggatatggtatggccactatccgtccgaatccgctctgttttcacccctacctgcgtctccatcggatatcgttcgaagaattgcagatttgagatttttgtaaaaacataaatagtattttgtaataaatatttagacccctaaatgatcacaaataataaaattgtcaataaacaaaactgtagatctcaccgagttttataattttgatatacagtttttcttcatctgagttcgtatgcaaaaattatgtatatatatatatatatatatatatgtgtgtattttccctaaaaattgatccctgtccgcgaatataaaaaaaaatcttggatagtttcttaatttattcatttttatttaaaaaaatctaaatttgtttccgaatccgaaaatatttagaactatccaaccgaacctatccgactccgaaaaaatagtccgaatggacggaaagtatttataccagtttcatccctatgaatacccaacctccaccggatgaggcttgtgactctttgcagtttgcagttgtgccactaacatgtagatgaaagtaaagtggagcccacatataagtagcacagctccataaagttagatgacctgtttctctctccacctttaaccttgtgtttttagggattactccctccctcattataaaaatttgagacttagaatatcattttattaaacttttaagactaagtaaaattctctctctattttttttactcgatgagaccgtattctgttttaggctgagttcttatctccactttcccaactcatatctctatttttccacgcgcacgcttttaaaattgctaaaaacggtgccttttttaaaaaaaatttctaaatgaaagttacttaaaaaaatcatattaatctattttttaaatttattttagttaatacttaattaatcatgcactagcgctgctttgttttgcgtgctagggagtgaggggctttgccacccttgaaactttgcgctcctctattttatcactatttcgttatcattcattccacttttggtagtcaacgtcatttgaacatacgatttagccctcagtctgaaacaagttattagaaattccaaaaaaatacgaaatttagttttcagtactttaagttttgaaaggttgtataaaaattgatggtagaaaaaaattgggttagttagaacggttttagtgcaactttaaacaaaattttcaaaggaaaaatatttctgtgtatacacatataaaatgttttacgtgtaacttggaccttcaactttatattacgtagtagaataaatttatgaaatctagtgagtcaatgatattatgatactattttcctgtttttaaactaagcattttttaaaaaattgatgatcaaagttggtttgagaaacgtcaaaagtttctctctgtgtctctcgctcttactttctactccccccgtccctaaatatttgacaccgttgacttttttttaaacatatttgatcgttcgtcttattaaaaaaataaaaaaattcaagtaattattaattttttcctatcatttgattcattgttaaatatactattactactcaagtttttgaataatattcacaaaagtttttgaataagatgaacggtcaaacatgtttaaataagccaacggcgtcaaatatttatttagggcagagggagtatattacagtttgtttctaggtagactactggaacaaacatacaggtcggttttttcctgttcttgggacctttagaataaaaggatgttctgaaccctttacaatccatacacgtttacacatattaacagctaaagttttctaaggttgacaacaggaactcaaacagccaaacccaacttcctgtatagagcaagtagctgtagttttatatttagatcgaaacccgctaaagcgcagcatgataataaaataattcgctgtattttatcacggcaagcttttgcttacccacgtaccaagataaaatagcgttacagagggcaagagacgcaatttttgcactagatggcacaaatagattgaatgcctgtaatactactacaagggagctcccaattctgcactagctgacgggagtgacggcgcaagatgtctgcaatggatcgtcaggtttaactataaaacattacttcttcaactttggactaccatgttcattacttctagtcttttcttcctgcaaaatgttaattgggaataaggaaatcaaacctaaacatcaaatagatcaagtggctaaattcatattagcaacaatataagattcactgaaatttggcagcaaaatggatcgttctctagaaactaaatcattatgccattgtttctggaagcttgtttcagttgtttgtatcttgctacataatttgttcagctccaaggataattcaagtctgccgacagattcattctattaaatttgcttactgttcttctattgaactaattatatgtttgttgtgtaaagcacagtgtatacaatttacactgcaagacgtgaattagaccaaaagctatgagggattattgatgaaatttaatacaaaatttttaaatatgcttagggaatattcatcaccttaaatcctaaaaaattgtagttttgcagcatgatttttggaaggcgttgttcagaacagttatagatttaaaagttcaaagccatcagatttattaaatgcaaatgtaaacagtttgatacttgcccagatcatttaagccagaatctctcatgaatgagaacaccttgtgttcaaattatcattatctgtttacgttggataaatttatgaatcaactaggtgtgtctcgagtgcaaataaaagtatacatcgtgtttaagtacataagaagagggattggccagcaatgaattctggcatcatcatacctcattcactggctgctccagttcaagcctgtgggctgacattcgagctatctcagagatggctgcatcacggacctgcatatcatcaccagcaagctcttcgtaggcagcctcaaaggcttcctgccagaatcgtggaagtcggacctcatcaccggtgcgtgtgtacatgtcccacattcgacccactaatttttccctctcctccatttcctgcgcacaataacctaccaactcagctgcttatattacacaaagaatttgagaatagatttctgctgcaaatattaatacaaggagtagcacgatagttcttcaataactaggaaatcatagtgcaggaagttttatcggacctccagaaaaagaaatggatttcaatccaagctatatacagataaaaaataataataatcacgctttatacacataaaaacgtcatgctctagggtccacacatactaaagttaaacaatgctgtttaaggtatgtttgcatcttaggctagaggattccaagccttgcctacagcaggagaaaaactagctttgacaagtgagacaacaaacatttacaaacaaataaaaaggcaaatagtcagctggggcaagaaaaccttcacaccaaggcacaacatcatcttctcccatggtgtgtgatcattatcgaccgcattcctagcagcctatggcttatgttccatctcatccatgggccatggcctgagaaaagcccaagctgtcatctgtgcccctagctaatggcagagccctcaaacctcgatgcagacttcggttttgttaccaatcaaccttagtacttgactatgtcgctctgcatgccatatctctgacacgaatcaccaaaagttggctgcagtcataaaactgctgacttctatattgcagatcatgcaagcccgactacatattcaggtttaatctctataatatgttatgtaagagtacgatctcctgattttattctaaatcacatctagggccataggaactacatatgcttgtatcacatatcatacctaatatcagaatataaattactgttcacacatcttgattcttgaatcactatttgttatgtaaatgttatgacagttgaccaaacaaactagctttactcccacgccacagtccaaataagctttttttttttagcctaagctaagcaagttagacaaaagaaccaaatgtacccgtagcatcgatacgcagttccctgtcgtaaacagccccagattagctagtacaaaaatgttgtgaggtcttgaacacgaaaacagtagcatttgcattcagatacaacctttctcacttaattacgacgacagttgtgcaaatattttttcctgcattttcccacacaacagtcaaacagccaaaacaagaacacacttattcagagacctccaagcaataccgatagcaattcacaactgtttcaaattcaattcctactcaaacaaggcattgcgcatatagacgagaccacgcagcaagcagttggcaataagcaaaaggggaagaagaggggagtggagtgggaggtaacgagcgtacgagcgagtcgaggtcgtcgaggaggggcgcgtcgaggtcctcggaggcggtggcggcgaggaggaagcggccggaggaccagcggagggaggcggaggcggcggacatggaccagagcgcgaggagcgcgatggccgccaaggcccacaccttgtaccgccccttcccgaacggcggccccgcctcgccggcccccgccgccgcggagtagtacgggatggtgatctttgtcgccggggatgccgcgctgtcggcggcggagagggccttcattccggcggcggccgcggcgtcggtggcggtggcggcggcgtcgcggcgatgatgagctggtttttttttttccgttccgtttggtttcctccggtttttgtagcgtagtgaggttggccgtgtgggccccgcttccgatacaacgccactagtgatacaagtggtagagagccagagagtgatagtgggaggatactgaactttttttttttcttttggggagaattggaggatactgaactgaaccactaatcggtgtgacaaagatcatcatgcaattgcaacagcatttgaattttttgaatttttagttttgatctcaccaaaaactcaaaggaagatttttttttttattctccctctgtcccaaaaatataagagattttggagggatgtatcacgtcttagtgctactatgaatctggaaagagtaataggatgtgtcacatatgtcggtgatatgggtccgggggtatgcgaagtgagggggagttacctcccgatctagccacgtggccctacagcctggccctccccccgcgcctcggaagacgcaaaggcagccagggggcctcggggtgccacatcacacccctcggaccctcgcgctgcctcgccccgaggccctcaggcagctgccatgtggcgaggggagcgagcaaggaggagacccaggctgggcagccatcattgcgcggcaccccaaccgtccctcaccgcatttaatgcggtaagggcgaacatgcggcgcggcccgtttgactcacgtcaatcaggcgtgaccagactgtgactggcctgtcgccggtcacgtccgatcggacgggcagccgtgcccccacgtttgcccctgtacccagcggggtggaggcaggtatgtcccgtcccatcgaagcatcatccggagctccctccacgtgagaaggaccgccacaagtcttcattcatttaagagggaatgacagggctgtcacccgtgtcaggtggggggcggcgctgggtcccgctcaaggacggattgctgcttagcttccgggcgaaggcacggatcgtggtccggtcaaggtaaagtgggtccccctcacgtgaaaaagtaggtagaagcgatgcatgtagtatccccttagactataaaaggaggaccttgcccaccgagaaaagggacgacgctcagtagacctgaactctaggagggaaagagcgagagtgctctccagagtttaggaatctttgtaacactcgaccataaatcccacacacaggagtagggtattacgctccatagcggcccgaacctgtataatcttggcggccgtacgcgatccagaagcactcagggcgaatacgcgatctcgacaagcgagtttttttcccccggccgaactcacaaaaggggatctcacgatctcccgctagagaggatcacccctcgacaacatctatccaaaatctcttatatttaggaacgggggagtatttatttagtttgacatatgtgaagtgtaaaatctctcctttgtcaacagcccatcagcccatgtgttgggttgggttgggttgcaaactttgcaattggaacacaaaagttgcacacagtctggaatcagctcatgggaaaatctacggagtaataactgatgttttgctgtctaaaggatcatctggtctacactaaacattagcaggaccaatgcattgagaccataggctggcggcatgtaaaaccagatccaaaaaagaagagcaaaaaatcacactcaacgcagagatgttttgctcataggagcgatggcgatgcattcaagtctcgcagatccagcctcctgtcattggagtccttgaactagaaggacggcgaaaatctcaacttcagctccagtttcacaatccttgtaccagcctctgctaatcaaactgtgcctaagtgtttgtttgttagtatcttgtttccagcagggcatcaactagtccaaagtccatggcctagggtaaaaccaaaaaaagaagggggaaataagttataattcacatggcaaatgatgatttactttcttctgatacatttaagagatgaaagttacttcagatgaagacatgaaacgatccctctctgtccactgttgtaccatatccaaggtttgcccagtaaaagcagcaaacatcttatcaactttctgcatccagatttttcagaagctttaatcgcttagagagcagaatcaagagaaattccttaccctcatcaaacatctaattcaaatgtacactgaagaaaatatagaacttgttatctatcacaaaacacttacatcacgagcataaatggtttccccaacctgtcgcctcacctcctccacattaccctgcaaatcatccaatttttagaataaaaaacaaacttcaagtacaacaaacacaaaggcaagcaagtatgtcctagcaagactgtatattgtaagtttcatgtggccagctaaaatgatgatgattattatttactgtagtcacaatgttagaaaatcataatgcacccgctgcagtaactcagaaaggcagaaagccccagaatcatacctctgatacaccttgaggttgatgaatcattactctagcatttggcatggcataacgcattcccttctcaccgccagcaagtataattgctgcctggctagcaacaacaccaaagcacactgttccaactttgggcttgatctgcaataaatggttcatgtgttagtgcagaacaacaaaaaaagattaatattctgggatttatttatcagtaggcgaaattgtagataaagtatttggttatggaaaactggcataacaagtaaaaacacagccaaatctaacaactaacaaggctggtccagctcaaagccagttttagagacaggcatgatttcaggaaatgagatctgttgtctgcagtaccagaccaaacccaattagcacagtctcagcatggcaaatgctcatgtctagtatgtactacaataaaaatataagaatacaaatgttgcaagcactaccattgatatgagatataatttttgcctaaattacattaggctttcctgtaaatgctatatctgtgctatattataaatataaattcactagctaggggcatgcataatgtggaagatacaaaatgttgagatgcatctataatgtgttctcatccaacaatgtaaatattaaattagatgagaataactcagaaagcatccacaagaataaatataggtgaatacaatctctgaaatttgaatgcatgaaggacatggaaaaagtagctcaacatagatggcatacccaggacatgcaatcataaattgctaagatggagtagagacttccgccggggcagttcaggtagatctggcaaaacagaattatacaaaaggagttataagatatagagcaacacacctgtgagctaaaggagcaagccaagggagtgaagttgagcaatcaagagctgctgcagtgaacaatagggtaactgttatgatctgaaaaacacaaaaataaacactaaccagaatatcagcctcttcatcaacagcagcaagtgtgacaagctgtgatattacacgctgtgctacttgcgagttaatatattgaccaatgaagataatgcggttccccaacaatacagttgccagatcaagagcaccagcaggagtcattatggcaggcattaaaggtggattttcattctctgatgctacaattgtatttttcctgtgaaaaaatatttacaatattacgaatgaataaaacaggattctgatacacagcacaaataaaacctagatgagcagtttcaaatcaggcaatgtatcctcattgtatatcaggcatgacagtttcaaatatatcacctcagagaagaatgacaatgtatcctctcgtccaactttgaagaaataccaggtggtacaaattgtggacctaggtgtggaaatttgagtgagaatgcaactcagcacatttgcagcaatatatcatgtgaaagacagatggactaaacagtaaaggaatccaaaaaacatgtccaaagaaaagtttgtgctccgcatatcctgtcattatggcatgttgagttgtgctaatacaccatactgagttactgacaaacacaataacacatatacagtctggaaatctcattcagcagtttgctaaaaggccctaaactaatttcagaatcagaccaaactgaggtgatatgttatatgcaggttatcgtttttatacatatccgttcaaccaagcacatccatttttcgtgtacttagtgagctaatgctgatgcataccagacattggcccaggaaggagttgacactggttcagataaccccaggtcggcatactcttggataatgccgacattcagaggttctatatgctttgcaaaacctaccaatgacgactccataaaaaattggcacagagaaagacaactaggagctgatgggacggctgcccaaatggtcatgttctaatatgtgcaccaccatggacaacatctcagtaaagcttatcaaatcaacgatcaaattccaccaaacagtcctggcctaacgagctgaccaagggaaatggtttgctaaaccaagggttaggaaatctcacctgggagagccacgcctgatttggctccgctccgcctgaagaaagaaggaccagacagagggtgaggggacaagaacgggggaatccatgaagagagaagcgcggggcgagcgagcgagcgaaggaggtggaagttgtagttccgtggagctcacctgcgggagaggaggcgggtcggggaggcgcggagggcgagcggggtggagatggccataggcgccattggaggcggagctggagcgtgggagggagccgagccgaggcgaggactgaggagtgaggaggggagcgaactggggatgaggttggactagtatgggcttgggttgggctgggctgggttagggttttctcatgggcctaagttctagcccatctatgtgtatgggttggaattattattatatttttaggaataagttcaccagaggtcgctcaacttaatagcgagatttttttaagaccccttaaccacaaaaccagaaatgtataccctaaactcatctaaaccgtgcacacaaggtcctacggcagtatatatgggtggtttctttgacgtggcatcatagtcagcaaaaaaaattaaaaaaagtaggagaccacttctcttctctcttatctcttttgtttttcttctcttcagctcttctctcctaggaggccgtcggtcggcggcagataggggcgaggcgatccggcgagagggaggcgaccagccacgtcggcgtgagatgggggagaggagagctgctgcgctcgcccgccgcttgccgcgggatttgaggcttcctctgccgccaccaacaccaagcccatcttcaccggcgtcctcctcccatttttggccccgcccctctgcagggaccccactaacaggggagacggcgcgcccgcgatggccccgctgaggctgccgaggaggctgtatgtatggcctggcatcgagggcttcgcgcgacaaaccggctgacaggatttgaggtcccctccaccgccaacgacgtcgagtccccttcgccggcgtccttctttcacttccgcccccgccccttttgcaggaccccgaccgccacaatcaccctccacgtgcctatactcgactcctgcgaagcagtgacaacagcgatggtgcgaggtgcgaagcatttcttaaatggaccttttcgcaaatttttgctttgtactttcatctaaatttttttattttatttggtcttgtgaatgtgtgttcttgttttggtcttctgattccatgcaaatctttttgtgattaatgccaaaagggggagaatatttgaggatcccacatttgatatgatcgttgatataaagggggaaaatattctaggatcccacattcatttggtgcatgtcttgaaaagaagcataccatcatctaccatagcatccaacatgcaccatatgcacaagcatcacatgcatggatataaatcaattgtcaatttctcatatcatgttgatttatatcattaatttcacctttcatatccaaatgtgattattactaatggatttgtcatcaatcaccaaaaagggaaagattgaaagttcaagtgccattgatttggttttgatgattaatgacaaatccaattatgtgagactaatgtttttataagcatttctttgcctagtctcatgtggatatgaaagtggagtgttggtcacaaggatgaaatgcatggagatcaagctatatgtatcactctttctcttcatgtacatattgatatgtttgtatataatatttcaacgtgattggcatatgcatttgagactaatgttttgtttgagtattatctcttatttagtctatttacattgagaacgtggagatgatgaaggtatgtttttattttaatatctatatttgagaaatgccttctattcttgtataggataagctcttaatgtttaatatcttattatgcatactcttgcctcacataaatattttgtatgcatacatttagggggagcaaatcctatgctttagttatgcatgtaatcgatccaagttattcaccttcatttaattgggatctttacatttgaacatatatttgagtatatgacacttatggtgttgattaatactcatcatttattcatatccttttatacatgcgatcggttggtcaacatgtggaggttgacaacatgatcattgggactaataattttattgagttgaatgaaagaaataggtcccaaggattacaaaggtgttgatgctcaagtgatacaattacacctaataataccaagaatgacaaagtgaagatattgaagatgtgtgatatgaagtggctattatggcaagacggtgaagggcaagcgatactcggtcgcgatggaccatgcggcggtgaagggcaagcaaggggcttggcaccgaagaaccaaatccggtggtgaagggcgagtgacgactttgtcatgatggaccgtgcgagaccatttgaagctacaagtaaccgcatcaatcatttgaagaatatatggtgaaacggtatcggcattggcgtccctcaagacaatgaaagaaagatgaaaaaaaggcattcctaatggtataattatcttcttatttacatttgagtttaggaatgccgtactattaagagggatgtaacgtcgaggtgtttgtgtatgcctcgatgctcaaagtgagctatcatagtactacctcgagagaaacccaagcattaacctatcatttgagtggttttagaccttctttttggttgagttgggtaatcctctgagtgagcttttcatagagtccaagttcatcaaaaagggactcccgggtgaaaagttatagtcgttttactctgtgcttttcgggaagtccgaaaaattaccgtaaactccgaaaatttttcggataactccaaaaattttcggacattccaaaaatggctgcgaatctgagatttgcttctgtaagatttcggacttgttcgaaaagcattttcggaaactccgaaaattacagtcttggcctccaacggctagtttttgagaggctcgggtatataaactcctccaccccacctttgagtggctgctgctcttggggagtattagacacatccaaagccaaatagccatccccatttccctacctttgtggtgcctctttgtgagtgggatttgagaagggaaaagagttgggttgagagagtgaggagttgagagctagtgagcttcactccatcctttgtggtgcctctttgtgagagggatttgagaaggggaaagagttggattgagtgattgagaagttgagagctagtgagcttcactccacactttgagcactcgagttcatagcaagtaaatcttcgattgtgtttgttactcttagggactaaggtctcctagacggctaggcgtcgctggtgagcacccaaggttgtggtgtgccacggaaagtttgtgaaggcttcgatttcacctccgcaagggaagaaatcaagagtgaaaccgaggagtgcatttgtgcaacctcgtgaggaaagggttaaaataggcccggcccttgtggctcctcaatggagacgtaggatccgtggatccgaacttcggaaaacaaatcacgcgtctcctctcttagtttgcccatttgtgcattctctcatattgtgcttgagcttgtttttacccgatctacttgcatgcttaattgatttagttggtgaccttatatcttgtttagataccttatttgtcaccttttgattcatatacattttgtttatttgagctacaagttcatagctagtgttttatttcattatccgctgaacttttcggttgagaccggaacttccaatctcatatcgaaagttcctatttgaactgaaagttctctgaagttgtgatattttttaggaacgcctattcaacccccctaggcaacattaaggtcctttcaattggtatcagagcaaggcaaggtctctcattccgggcttcaccgctgtcacgccctgaagtttccccccttttgcttgctttaaaaattggctaaataaatcgtccgaagaaattatcttaattaacctagagctaattccctaattaataaatgcaaataataatcagaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccgtcgcccgcgctcggcctccccttgtgggccggcccgttcccctttcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgcctcttcccccgcatctcccggcccgcgcgcgcgctaaagagggcgggattcgatttcgaatccacctctctcactctccctccactccccacgtcgccggccaaatcggccacctccccggccacgtccgccccctcccgcacctataaatcgctccccgcgtcttcctctctcgtttttcgcactcgccgcgctctcccgtgcctcctatcgcgctcgcgccgcttgttgctagtgccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctccccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgcctcgccatggccggccggcttgagccgtgccgagcatgtcgccgcccactccctcccccttgagccactgcccgtggggcccgcttgccagccgccccctctcccccccttagtgccgctgatcagtggggcccgcctgtcggcgccaccccctcccctcgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgttccctgtttcagttgtcttatagcctgttttgcttgtgtgctttgtttgtcgcgtaggtttcggccgttttgtcgatccacggtttctcgaagacgttgctgaggtctcgtcagtgcgagagcaaggcaagtcatgcaatacgtttgatcatattgtacccaatttacaaatatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgctttccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaagggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactattttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcatcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggatttttttttttaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagctgcagcagcagaacctgcagtttggttctccacctcctcagtccaaactgctagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacacaccagctgcaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaacctcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacaatgggacatcacggtggaccttccaccatgattatccggcagtaccgtccctaccacccgggtagcttcaacaagaaccaccatagtgatagtcacaacaacagtgagcagcacagcctcaaccctactctgagttcactaaagattccagctcaatcagttcagccagctctgccagaacagcccaagaggttgggagaaaagcccgaactctgcttcaattgtaacaaacccggacacacggttggaaagtgctcgaagccaagacgtgctggacccaagttcgttcaggcccgggtcaatcatgcatctgcagaggaggcgcagtcagcaccagaggttatattgggcacattccccgtcaactcgacaccagcagtaatattgtttgattctggtgcaacccattccttcatttccaagctttttgctggtgcacatgggttatctttagtgaagcttaagataccaatgcgagttcatactcctggaggtggcatgaccacaactcactactgcccagccgtgacagttgaaattcaagggttgatttttccagccaacctcattcttctcgaatccaaggacctagatgtcatacttggaatggattggttgacaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatagtcagagagtatccagaggtttttccggacgatctgacaacaatgccaccaaagagggatatcgagttccggattgacttggtacctagaactgcaccgatccacaagaggccttacagaatgggagccaacgagttggcggaagtcaagaagtaagtcgatgaacagttacagaagggatacatccgccccagcacgtcgccttggggtgctccggttatcttcgtggaaaagaaagacaaaaccaagaggatgtgcgttgactaccgcgcactcaatgaggtcaccatcaagaacaagtatcctttgccaaggattgatgatctgtttgatcagttgaaaggagctattgtgttctctaagatagacctgcgatcaggctatcaccagttgaggatccgcgaagaggatattccaaagacagcattcatcactcggtacgggttgttcgaattcacagttatgtctttcggactcaccaatgcacctgccttcttcatgaatttgatgaataaggtgtttatggaatttctagacaagtttgtcgtggttttcatcgatgacatacttatctattccaagtccgaggaagaacatgagcagcatcttcagctggtacttgaaaagttaaaagagcaccaactatatgccaagttcagcaagtgcgacttctggcttaaggaagttcagtttcttggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgttgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcacgatctggaattggccgcagtcgttcatgctttaaagatttggcggcactatctcatcagtaaccgttgtgaggtatatacagatcacaaaagtctaaagtacatcttcactcaagctgatttgaatctcagacagcgaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggctgccctagaggcacagcccacactggtggagcaggttcgcatagctcaagcaagtgatcctgaaatagcagagctcaaaaagaacatgagagttggagaagcccgaggttttgttgaggatgaacaaggaacaatctggatgggagaaagattgtgtgtacccgaaaacaaggaattaaaagacctgatactaaccgaggctcatcaaactcagtattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccagtgcacactacctactcagggaagaaattagcagaactctatctatcaagaatcatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggggcatgggacaaaagcttgccgtatgctgagttctcgtacaacaacagttaccaagctagtctgcagatggcaccatttgaagcactgtatggacggaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctctcagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagtttccccccttttgcttgctttaaaaattggctaaataaatcgtccgaagaaattatcttaattaacctagagctaattccctaattaataaatgcaaataataatcagaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccttcgcccgcgctcggcctccccttgtgggccggcccgttcccctttcccctccc

SEQ ID NO: 67649 - DNA, 1063 bp, Oryza sativa
cgggagacgtgcgagctgctgaagcaggtgcgcgagccgggctcccggggatcctacctcaaggactcggagaagcaggagatgtaccggctgcacaaggaggaccccgagacgtacaccgtggagcgcctcgccaaggacttccgcgtcatgcggcagcgggtgcacgccatcctgtggctcaaggagatggaggaagaggaggagaggaagctgggcaaatcgctcgacgactccgtcgaggtcctcctcgacagttgcccagagtacgtgaggagtttgtttacttcctaactttgtgttggtaatactaattagatcaggttctgattggatggattcttttgaaggtgagggacaactggaatagttaaaatcataggtttaacctgcaaaagaacattttgatagtaaaccgatggcaattagaaacagaaagaggaccatttcatctataataacttgaaaagtctgctgaattattaaattattcctgaatagtattgcacatttcactggatcatatcttctgttgttaatactttagctaagattaagttagagcggtgtgatctaggatgaagcgactggtttctaatgcaagtgacagttggaagctctacgacatgtgttttgtgcttacatatgtacacaaaggaatgtgatgatgtctgaaatcttagaggggatgaggatgccaagaggtccagaacccagtatgaagtgatgattttgtttgtcttaatgttatttgttagaaatagaattactattggcatcaaatccttctgttaatcttagttgccttcaggggtgaatccagaacaaaaatgacccgctgtcccatgcatagcactaaatctctacaatactcaaaataaaagagcaccttgtatttaacggcaatcaatattacaaccctatggtttcgcttatgcttatgcatatccggacagctttttattaatcaaaaaaatattttttgggtaaaacttttatatacgattcaaaagcaaatgttgtaaaataaattaggataaaaaaccacaaaattaactccaaa

SEQ ID NO: 67650 - DNA, 681 bp, Oryza sativa
aacatagaggacgactaggggatgctttatataggcttggattagagagatcggaccctaaccaagagggatcgaagccggaaaaaagtagggttagtttggagagataaactcaaaacgaatttgatttggtttattcgggcaaaattgatctccgaaactttagggggaagggagaggataaggaggagatgatttcccctcaagcaatcgaactcggagatggccggttgaggcggaatcgaaggggaggtggcggcgctcgggctcggctcggccggaggtggaagaagaccccgacatgtgggccccacacgtcggcggcttgagaggagaggggcggcggcttggcttgggccggcgtgggccgcacgcagctaagaggagagttgggccggaaacggcccaacagccttggggagggttttaaagacgttttcaattaaaataattcgtgaaatgatgtttcatttattaaaaataccttccttgctcaaataattcccagaaaaatctagaaaatagataaacaagcaaagtgtttaataaaattttatctagctcaattttatgttgaaatttttcctagattattagagtttaacttgtaggcttttaaaatattttctaaaaaagcattaaataatgaattattaagttaggcgattttcagggcgtgac

SEQ ID NO: 67651 - DNA, 1462 bp, Oryza sativa
aaaagggctagggtttaaggtataacctatatcttagggattatggggcttgtatttgctagtggtaggtttaggtggtataatacctagggtttagttatatgggagtcgattgtggagtaggatagcatataggttaggctctatattttatgtggaggttctagaggattggaggctagaggggattaagcaattattgtcgcttatattttatgtgaaggctctcgtggtttggatgataggaaatatgctggatagttgatatggttaaataggcatgtggctaatatgggtcaaggttgtacttttgtagaatagtggctagggtttagttgtttaggccgatatcaaggtaggataaatatcggctagggttttgggtgttcgctagtcgtcgctagagttggacggcatgacgactagatttggtatcatttctagccatgtcgatagacagcatatcagctagaagaataggaggtgggtgcaggtttagtggggcggaagtgttactccgacaaccgtgagtggcggcggagcggctaggatcacacagagctcaagagctaactgtgcggcgtgcaatggaggtcgaggggatagtgaagctccgaccgatgtacgcatcaaggcgtggggtgccaggagcagcacttcgaccttgggtttggtttatgccgggctttacaaccaacggtccgacgttgaggtccgtagaccgtgaacgtccccatggaaggcgtaaagttccaaccggcggctttttagtggctaaagggtattttggaaataaaagaaaatatttgaaaagcaaatataagtttaaattgtaaattcaattataagattaaatcaaatatttattcaaatggtatttgaataaattaaagaaattcaaataaaatcttaaaatagcaaatttgatatcaaaatgaagagtttgaatttagatgaatttaggtccaaatttcactggaatcggatctacggtttaggagatatgggcttctaaagattgggatttgaattaaatctagaaaatacgaaaaggtactatttatgggcccacctgtcaagacctgcccttcttctcttcttcttttgttcttcttcttcttcttgccggcaacagaaaggaaggagggaggtggggcgccagtgctccagtggccaaagtgtggcgacgttagcggtatatcgtgttcccgggcgacgcgcacttggggattgcggtacctagccaagggaaagaaggagatggccggaacggcggcgacgagagctcaactccggcgataagaaaaagtggtggtggcggtttatcttaagatggagggagaggggaaaggggaaaaatggaatcacctccgtgaggcggaattggtggcgcaagggtttggctttgcaagctccggtgagggaaattggccaatggcaaccatgggccggacatgggaga

SEQ ID NO: 67652 - DNA, 1225 bp, Oryza sativa
gggttggtggtacttgagaaaatgggcggcttgactcagagaaattctaacagtttggactgtggaggtggaggaccaaactgcaggttctgctgctgctgctgtgcttgctgatgcacctgctacaacacctgatggtgctgtcgctgcatctgttgcatcatcattgtcatcatctgagtctgattgtccaacacctgagcaatcgttgggttctcgggcggtggagatgaactgctgctagatgcatcgcttgcacgtgctccactgatctgctcttcgctgccactggcgttgttggattcccgggaaccattccttgtcttcaccatctgaagggggataggtagaaatatgagaaaaggaagaaaaacagggggctcagaatctaatctttcttataaatttaggtacaattatcttaattttgattaaaacaccgaaaaggaagcaaacaactcctaattaaggcagccataccactcacacatgatatcgaccgccgactaacccacaagcagcagacctaaacacagaaactagcaaacaacaaactaagaaagacgataaagctaagggcggcgactctgaagctcggagcggcgcttgcgatcggagaacaggtctgacatctaaagatggacaagggataggaaccaattcatgctcaaatccaaattaaacaaagcaacaaatgactcaaataaataacctagcatggctgatttttatgcatagaacatttttcgtgaactcaaatgaagatactgatgcaactggctaatcaataaattaatgcataaaatagatgcatagctataatgatacgcataaaattgccccatcgaacagagacacgacttagtgcatatcacccgttagatttccgactgactgtcgaataaacctcaaataaaattttactaaaaccctagactgagctaattttaaagatccgatccgaatgaactaccaagatttttcccgcaaaccaaagaggcaaaaccccaaattttcccgaaacaaatccaggtgcaaaaggcatatgcagatgaaaagcggttcagagggctcttaggtttccagttggcttgtcctacggtcaaggctggctctgttaccaacttgtcacgcccagaaattcacgaaccagaatttctaagaatttttcctgggattaaatattgcactttggtgatttttaattggttaaaattatttccaa

SEQ ID NO: 67653 - DNA, 6063 bp, Oryza sativa
atgcaactataggaattcaagtgaattcgtgtcagactatatcggtggtgtaataaattgataaactgccttaccatgttgtctcaggatttagctgattgtcaaagcaaaataaaatttttaaaaaggttttacccatctacagccaactttgacagaaaagttcagtatactgtcgatagcatactgtcgttgtaagcgtcaatagcttactggtttggggctttcccccaatccatctcgacagcatactgtcgttgtaagcttcaaaatgtaatgaaccccctcttctttcttaatgaaattggttgactgtatctttcggccgacccggcaaaagaaaagttcagtatatggtatccctgtttgattcatgtccacttattcagttcaggaggcaagctatctgtataactactgctgacagattaagatccattctaccatacatcattgccttaaaccatacttcacctgaagatctagctggggcaggatctcttggtttaggtcgcaagcttgatgactggccagctttcggcaatgtaagcttctggacacggttcaccgccctagtcctgcatgagaaatagcaagttacagataaccagtggaaataaatttcacattatacaaaacaagtttttttagataatgacattatacgaaacaagtatgcaataaagatgtcaaattcagaaaaaaaaaagagttagctagtataagaacaagattggaattactcacaaccgctctttcgcagcagtgttggatgttttctcttgctcttgatctgctacattgcttactgaactatcagcttctgcacccatggaaataccatccgaagcatcgcttaaccttccatccgagtcgacatccgcaaggccagaaatctcaggatcaacggagagcatggacccagcttcagattgcctgtcactggtgtcggagaagttatcaagatcagaagctgccccactgccaacacttgtgcccttccctagggatgtaatgcccggggaagaggacgaatgcttcaatacggaatcagcttgtctcgttggcttcaatctggtgctactattgagtaattgaagcctgtcgatttcctcatccttctttgaaatggtatctttcagaagtgaaagctgcaaggagaacattacaaaacaatagatgtaacagtatttttcatggtgaattactattccattgcttacatcacataatgttttgacattcccgaacaatattcttaaccttttgccatttcaatactgagaccattatgtcaagagaagtcagaagtgacttgatgattattgagaaatttggttacctgatccattaattctttgacatcttttccctccttcccctccttattgctcctagcaacaccaagttccaccccagacactcgttccgcaaatttcagagtacttaaagtctctgtgtaagatgaaacatctgggttgacctgcacaaacattagggtttttgcatgcccacctgcatatcaaactatgcatgtcaatacaactccgtgtatggcatgtaaaatagttctcaagtgaagcagaatacccagtgaagtctgcaggacttgtgtgagcttgctatttctgtatggtacatgagcattcttttgtgataaagaaaatataacatccccaagagcagccaaagacttgttgatgtgctgtgcttctttgagcctgtcccctgtaactgcagagcggtccaccctctcacttccagcaaggtccacaagatgtagagcgccacgcaaagtgtttccagtcttcagatcttggcctcggacatgaatggtcacaacgctgcaaaaaaaatatgatctctagtaagaagggttagtcctacgacaaaaaaagaaaagagaaaaggcaagtaaattacctgtgagacctgctactcctctcattcaaagctgttgcactcatggctctattgtcatgccctgtttgcattagctcgattacatgagaagttgaggtgacaggacacattgttgcatcaggaacagcaagtccattgggttggatggtgttctggatccctagtgtgttggaagttaagaaaaaggaggatatttcttcacatcaattcagtctgcaaaaatcaatgtatggaacttctcaagcaagatgatcgcactagaatctgatgaaggatggccatcgtgtgtgtacacaataaaaaactgcaaattttattgcagatttaaattctatttggtgaaaggctacactaatgcaagtctgggggaaaaggatatttcttctgcacgccaccactgccaaggagatcacggatttgctcattgtagatctcaatcatctgaacaccaagttcgtaagtgattgtgtctctacggtcatgagaaatattgaaaaggtcatttaatgccctataattgactccccattccttctcagttgccttttcaggtcccatctgagaaattgatagaaacagatcgttgtaaacacatagtgactgtagagaaatcttctggcacgcaaactgaaataaacagaccaaatgtttttgccctgagcttcagcgtaccatagtgtatgtttttcctgatccagtttgcccatatgcgaaaatgcagacattgtagccatcaagaactgatctaattagtggctgtatgtccttgaagacagcatctattaacaaaataagagggataagagaattgatgtatatgacatacactattatgggatataattttttgaaggatttgttgaactaatttgatgcaatagcttcaatggaaacccaacagaagattaagttgtactgaccacttatcatgtaccttgtgtagtgatagggccaaaaactttgttaaatgtgaaatttttgcccccttccttcccttgttttgtagggtttgatagaactagttcaccattgtccccaatatattcaactgaactggacttgtcatcctccccaggtcgaaaaggtcttatccgacaatatactctgatgtttcctgctcagaaatactatgccaaggtgatatcttttgacctagataaccagacaaaatggactgatgattgtagttcacatgtaccttttagttcctggatctcattgaacaattttctgttttctgcaagagctccatgatacttttctgcagtatttgttaccaccttaaggctttttcctgttgaagattgcaactggtaatgttagttgcaatccatcgatgagaaaagaagtatttgtatatgaaacccacaagtaatcacaaggttaattcttaccaaggccagctagttcttcagaccacttgttttgacaatttaagatttcatgcctaacggaaacagaagatagcttcaaatcctgatgaaacacaacacttttgactaactgcagaatttaagaactccgtaaaatttgaaaaggaagaacaaaaggaagttatttttctaatacctgaacattctgtacttgcaaacttacaaattgatcgatcaccacttctttctttttccagaattggattctagtttcggataattcctcaagttctattcttctcttggtagaatcgtctaacataagctttacttcttctatcctctgttccaactccttacttacttgtgcagccttagtctctaattgctgactgtgtgcctcatgcaatctctttgtttcttcaagctctttcttgagttctgaaattatactgtcattgttttccttgtctgtgagaagcctggccacatcttccttcttagattctaacaacctgcagctctcctcgtatgatgatcttaatgtttccgattccttcttaagtttcaaaatggtattgttaccatcttctttctccttcatcaacctcattatctcagccttatccttaattgaccttgctgcatcttcatccgcgattttcttcaattcagccttattttccttctccttgatagacatgaacatgtcttccttctgcttcatcaaactaattatatcttccttttcttcaagcaacttaattatctcttccttctcctttgttaacctaactactatatcatctttctccttaattatctcttccttctcctttgttaacctaactactatatcatctttctccttaatcagcctgtctttattgtcatctgccatttgctttctgtcctcatcctcaccttttcccaagttaaccatatcttccttctccttcataagtataattatatcttccttttcttcaagcaacttaattatctcttccttctcctttgtcaacctaaacactatatcatctttctccttaatcaatttgtctttaatgtcatctgtcatttgctttctatcctcaacctcccctttttccaagtaaaccatatcttccttctccttcataagtctaattatatcttccttctcctttagtaacctaaccatctcttccttctcctctgtcaacctaagcacaacatcattcttctccttaatcaacctgtctttattgtcatctgtcattttagttgtaccctcaacttcacctttttccaagttaagcaaatcttccttctccttcattagtctaactacatcatccttctccttcaacaaccgaatcatttcttccccttccctcaccaatctatctaaagcatcatccttctccttaattatcctatatttatcttcatcttctattcgttgtgtttcttcagctttgactgttttcaagttaatcatgccttctttctccttcagcaatctaaccatatcttctttctcctttagcaacctaaccatatcttccttctctctcagcaacctcaccaaatcctcattttctttcatcaatctaacaacatcatcctggtacttcattaacctttccatatcttccactgctagttgccctttatctccaaacttgtctttctccatctgcataataagagtaaatcaaaattatctattgcttctcaagaactaatgatttaaagacctgtcatcttttacagagtgaacaagaatcccagtcattctgttgacatatcaatctcagagaaaaataagacaaagggaattgtatcagcattgccatttgtctgccattttatctttttaatatttattaattaatggtgacaggaggatcttcaaaacctcatttaggccaggtgaatacttcacttgaagtacacaaaattcttgcaacaacccaaagtcaagatagatggctcagagaagttgctggagtttacatgtgtttgcccacttaccccaccagctaacacctctagcactcttatccttgactgatacttctcttcgcgagctttaatcaggttattttgctgcagacaagtaagaaatcacaaaggactaatctggtataagaacacatatagaaaatatttatcttacgttccgtatatgcccagcctgggtggaaatgcgcctctcaatctctagtatgaccttcctcagcaagcaagcaatgcgctacaatgaaacatttacattcatttgtacaagggaaggtgttaaaaacatgaaatcacttaaatttggaaagaacaaactaactgcatttcttttctgagaagcctacataaggtatttgtccattcttcctctcaatgctctcatcaaggatgctgttgaaaacacccagaagtgactgcgtaggtgcattctgcaacaagccagcattgggtgacaatgtaaaaacttttctaaagtaaaacatggtatctcattactagtagggataattagatgcacttacatccaagctagtggatttcagcaagtctgaatatttgccaccgagctgatcagcatatcctccttgcttgagctgaaatacctgcaacggcgaatacggatcggatcctaacacagggctggatggctctgaatacaagcaaaagacaagaagatgtctctctctcagccagcaattggatgattcaccatcacaaaatcagttgcaattgtcagtttgtccactccaggtatacctga

SEQ ID NO: 67654 - DNA, 761 bp, Oryza sativa
ttaaaaccactcttttaaacatcgaaatatgcaaaaccaccgtctaaaatcacctcatgtgtaatataaattagttcggcaaagtttagggggtttggtctctggttttaaagtttaaagtggtagatggtttttttttctctatataatttagtactaggcgtgttattttgttgtgctagtgtgttatctgaatgaagatatcagaaaagaacgaaagcaaagtagcagcaccgacaccatctctgcaaattccaaccgttatttttgcaagtagcactaatacatcaatcatgctgattcatcagattgacgatttttattgagaaacatgcatgtatgatgtatccttgatggctagaatggcttggatgggaggttctgattggccaggaagtacttgaacagctcaagcgcttgctctggcatgatggatggcaccatgtggccggctcctctcaccgtgacaaatgtcagtccgtcgaacaccacactccacccaccaacctgcaaacggcacacgacaatcaaaatcagccagaccaattggtctaagggtgtgtttacttcacgctaaaattggaagtttggttgaaattggaataatgtgatggaaaagttgaaagtttgtgtgtgtaggaaagttttgatgtgatggaaaagttggaagtttgaagaaaaattttgcaactaaacacgggctaagcaggcaaatattagtatatatttaggagtaatgtgcagcattggagtaatgttgt

SEQ ID NO: 67655 - DNA, 1677 bp, Oryza sativa
tttattgatcaagtattccaaggtttgaataaaaggttggatttggcctatagtctcaattttgttcttttcatggtttaaaacatgaaattaattaataaatactttactattctcaaataattggcatagttgattatggttatctcactttaactataaattacgtttgaaatgttatattatgatgaattaaagttgtttggttatatttataatgccacatacatcaataatataatatatttttgagtgttaataaaatgtctgaaaaaaatacaaacaatcagttaaaactcgaatcatgcgcgtacaaattactccgtatttaggccctgtttagttcccaagtttttttttccaaaattccaactttccatcacatcaaacatttcatacacacacaacttttctatcgcatcgtaccaattttaaccaaattttcaaacttcagtgtaaactaaacacagctttaggataggaagggggagtaccaagttctaccctccgtgcaatctcaagtcgagtgttttcccgatttattaatttccaaatccaaaagaagaaaaacaaagttcatctcacaatatagattcacttttaaaactgcaatatgatcccccatatgatccagctctaagtctctaaccaaatgggcatgatggctgtgcaaattaattttaaggcatattcgccgaggggattaaaaaacaatcccccctctcattacattactaattaggaaatatacttcccccatcaatcaatcaatcaatgcttaaatattgaagtcaatcaaaaccatcgttatccaaaggaaaaccttaaacaaaatctaaaacgccagatcgaactgataggatattactactacagtactcccccgtcacataatataagcgattttgagtttttgtttgcgctatttgaccacttgtcttattaaaaaaatttgtgcaaatataaaaaacgaaaaattatacttaaaatactttagataataaaataagtaaaaaaataaataataattttaaaattttttaaataatatgagtggtcaaatagtacagataaaaacttaaaatctcttatattatgagacggagggagtgctgtactccgataaaagcgggtagaaaaagcacatggtgaaattcctgcgtgcggtcgtgcacagactccgtctcggagactctcccgctgactgacacctcaaaaccggccgtcccacgaggtctcctctctttttctcctctttaatcccctccccggggtctcctctctctccggctgcgaaaccaacgacggcaccccaaaccgcctccgcctccgccgccgcttccgcttaacctcctcgctctccttgacccccccgcctttcaatcgggcgcggccgttcggggttcgcgtttttatcggatcgcctcgttcgttccctcccctcccctccccttcgcgcggttctttgccgcgccgcgggggttccgttccgtcgtggagcggctggccccggagccggaggccaaggggcgtggacggtggagggtaatccgtggtgttgagggagccttggtgaggtggtggttcgggctctcgcggcggcgtcttccatgggggagaggcggtccggctacagggacagagggggccgctagcaaggaaggtattggaggccac

SEQ ID NO: 67656 - DNA, 2110 bp, Oryza sativa
  unsure (1)..(2110): unsure at all n locations
attgtcccgtgatgcgtcagagtttaaaaaatgtgacgaaatttgatgtgcgatcaccccatattctgcactcatttatgagagaactgcatttaatgttaaagacacaggtcagctagcagacaatcccaatttagttctaaatatgcaacccaggttatcctaaccatgaatcggctcacattattttgctaggatttaagaaaaaaaatattttattgtttcctcctgtcactctttccggtcatattctcattatgtttccttgtcagtgtttttacatcgtagtactgtgctgctatcactctaggaacaaggatattattttctgccgctcacaagtcataatatattaatacttattatgtaagaatggtgtgtatgtgattttcaggaaatggaaatttctcagttccattgtgggaaaagaaattttgcactgatgcttgtgcaatcccatggggtaaactctgtgaaaccaagaaattgatgtcattgtacaaaaatgtggttgactgggatgattcagctgcattagaaactttcaacgatgcaaaagctcgtttctgtgctgtataccatggccaaccttgtgatatcccgttacctgacccaaacatgtatattgacatggttaaccaagatgaacatgttgatcctgaattggtggccgaccttgagaaatcgcggcgttcttatcccaaaagggataatacagctcctgatggctgggactcctttatatttacaaacaagccagttccagccacagggtggggtgatggggaaacaagcaacacacctggtcagcaataccctacgaactggaataatcacgtgaaacagccgactgaagcaaattgcatgcaaagttcagtaaattgggataattatgtcagccagcctcctcaagcaacagttcagcaaagctcgggaaattgggacatgtatgttaaacaacaagatcaagctaataatgggaggcaccaaccatgcctggcacntgggacatgaagggtgactctctggatgcatggaagcgtgattcggcctggggttctgcagctatagattcatgggacaaccatagagagaactgttatgtacctgacagccagggctggtcttacggtcactggaaaaggcgaaacaatgagtcgagcagaaggaatagcaggggtagagatagagttggtcccattagctcaaaggccatgaaaccaaagtaccattctgaggagcgtaatggtgctaataatggctggaggcactgccgagttagaaataacatgcagtactcctatgagaatcctggttgcaaccagtcactagcaatgtgaggaagtgcattggacagaaaatgaggacccgtgtaggttatgtttccttttttcttgaagtttttgtagatagtacgaaccaccacaaacctagagtgacgattttgtctagccatttgcatgcccgttgtacatatctatatctatgtatatgtttttgagctcagtcatttttgtttactggctgtattgcagcttcattgttgcaaagtgggaattaattaagatggtgtctgttcaactatttcttgtgtggtggttttggccggttttgaattgttaggggtatatattgttcctatgttgtattgttgtgtcaaagtttccatcatgctataaacggtcctcgaatgaattctgaaatgaagcacttatgttctgaaccagaagtgcattcggttggcgttaaaatttctgaaagttaaccttaaaaaaattattctaaaacaaacatgcgaggcccactctaatcggtcgttcaaccatgcataccacacttgcattgaacagtttatgagaaacagataattctcttttagaaaaaaaaaaagaatgtcccataccactaggtgaagagcgccggcacacctctgccaagattgtgtatcagaataagcttactgtgcatgtttttttgcggggcaatgaacttaggttcagtttagtatcaaaacagcggaatccacactagtggaatcatatttcatgataaaatgcctatgaaagtttgcgcccagagacagcaaacaaatgcatcgcgttatatacag

SEQ ID NO: 67657 - DNA, 984 bp, Oryza sativa
aatggtcaaacgttggataaaaagtcaacggcgtcatacattaaatatggagataatgctttcttaatatcggtgtcaacctaaaacaaagtctacattttaggacggataaagtttataatacacacttggcacgtagctagcgttggtgctggagtacggttggcaccgccgatgacatgcgtgcatacgtccgcgagacatggtgtacaagtaggaaggaactcttcttcttcttcttcttctttcagcacgagaaagtctctacacctgtaatggcgcccgtgacccgatcgaagaagaaagatgtgaatgtatgtagtacgctgctttcgtcagagaaattaaccaacgtcaatcgaccactcaaccacttgatgtgttaacgtacgtgctgatctatcaattgatcagggtaacaggaagtagttttaaaggagtaggagtatcaaataatccgtgacgtcatcatgtgcgtaaaataggacaatcggtgataattaattgattcgaatattgatcgggtgatgcatatatagcagtagtgtctggatgttatcatgcatgttaatgaactgatttggactggagactacctggggtgcacgccggaagatccggtatactatatttctctcctgtctcctctcgtagttgtagctttcatccatgatgtgtagcctgattgggacatatcctgggacgatgaccctgtcattgatttacctaagtagcgagatcggctgtagcaaacgtcactgcaaacgctgctttccgtgaccgattagttcgtagtagtagtagcttagctgatgatactcctagcggctcgcttggtttgtcaaatgttttatttactacccgtcaaattaattcgaaacagccgtcaaacatagcagcaaaaaccatagtagtgcgagcaaatggcttacgtacgtcgatcgatccgcgagtttaatctgcctgcccggttttgaccatggg

SEQ ID NO: 67658 - DNA, 20295 bp, Oryza sativa
aaaatttggttatacccttatttaaaacgactaatattatcagtccggagggagtaactacggtgaagaaggtacaggcaacagataggattgttggaccatgaagaaaaagatgtaagagctaaagtaaacttgcgaccaggtcgaaattggtttacttttgtggctcctactccagtacttttcaagatgatatctttcttttttatgttttggatatgacatagttgtttaatttacttctctctattgaagcagtgggaaaaaatatttctgcagttaattatagttaccctgtcaattgaattgggccacgtccatagtagggtggagaagtcgccttgtttatctcctctttgaagcagtaaccccactggaactggtcagaactacccctcgttccacctgaattaatttaccacggttaatactcagatcaagatggtaaaaaaatggcggtaagattaatctgcacactgtaactaataatgtaccggtggtctcgtgggaggtctggccgaagaaggcggcgagctcccgccggatgagctcggcgctgccgccggaggtgccgaacgccgggaaggagttggcggcggcgatgaaggcgtcgtacgtgtagaagcccctcgccgggcactgcgagttgtcgcggttgggcagcatgctgttgaacaccgcctgcgtgatgaccgacccgacgccctgcgccgccgcgccactcgccgccacggcgagcagcgacgccgccgcgcacgcggcaagctgaacaaacctcgtcgtcgtcgtcgtcatgtcgccgcttcacttgcagttgcttagctaagctagcgagcattgcagcggtatatatagctaatagcttctccagtgagctatgcatgtggtcaaactacgcatacatttcgactcgtcatttggcgcgtgaaccgcgcggcgatggatcaaccgcaggattagtaagtactttagtagataaaatcggcataaaacatctctcacaaagtcatcgagtcaaagaaaaaggacgatggatcactgtcagatgagttgtcgtgcacacaagttcattgacaggagaggaaattgttgatttgtttccgtggcgttttggcgtttgcacatgagttttcaaaatttccatcgtttctgtggatggtagtaagcgaggcatggaatttccaggaaggcagaggaatgcgccgctccagccaagcaggggagatggcattggcagccggttgtggtaaattgggtcagatttgcacagcgacggtgagacccgttcgttcagacacaaccacattgaaaaccagcattagatcaaacccaattggcattatttaattgggcctccagcctactaagtactatggtcttcggccttttaattcttagtagacagagacctggtccattgcagccatttgatttcaggttttagaagatactacttcatccgtttcatatgtaaatctttctaacattgtccacgttcatatagatgttaaatgaatctaaatatatatgtgtctagatccattaacatctatatgaatatgagcaatgctagaaagttttacattataaaacgttatgaaaaacgttatgaaacggagggagtactatcatacgcacaactgcttatagtaactgtatgacttcttgtcatgcacaactctctgccgcagcttcaaatgtcattgaacaccattttcatgcatgatacagatgttaggaatataatcatctttgaaaaaactaaataaccatgtacaaacaagcaaaattttagaaaaagaacatatacaaacaagcccttacggcgtgtcgaagaacggcactgcgatgcacacaaatatgtatttatatgggattggtgtacttccaaacaaatatttctgtacataggacatgttttattaactttacctacaaggacccttgtgaacaaccagcaacactctttagccaccacaaatgaactcccatgctctaactattcaacagatgttatatacatgggtccaaaaaaatgcatctcctatcgtaggaagccaaaccaaatgggttttcctttttaatcatacgacacgccggtaaacatcttctccaaataggtcttctaactcctaaccccgcaatatactacagataagtgccagcttctggaacgccgcttctctgagcctaaacaagttcttcatggaccttttatgctcttttgcctcttctcttctagctgtgatgcctcgttcaacatgtccaaagagtcactctgcatgttcagctttgagagcgccactgcctgcatgtagaaagctgtgggccaatcgggatacacacactgtgcttgcattgcgtccctgagtgcagcatcaggttggtcacacataaggtggcacaagctccgtctggcatatacagttggcgacaccattgtccccacatcaacaaactgtgaaacaataaccatgcagatgtttcaagaaggaaaatgataacgagcagaggatgaatgaactacatgaaaagtggtaattttagaacattgaaggtctcatgataaagaagaaataatacagcctcctacctgagtgtaacaatctatggcttgcttgaaatttttgtctcgaaatgcaaaatcaccacgtttcctagcatccaacatatctctcatctgttgagtccattcttggaaagatagctgcagagaggagaacaatttagacacgtccccataggaagaaaacagtcgagagggaccagtatcccaaccagctagaaaagagtggagccacagtgctctatattgtctttacctcattagtcccttcatcatctctgtaatgtgttgaaactaggatctgatggatggcagtaaggtccatcctggaacaggcctctcccatgggagaaagtgggtgctgtggggcgggaggcgcctttggtacttcttcaggctttggaactccaagcatcacataagaaggtacctgttttgtattttacattgtaaacaaggttaaccatcaaggatatatatgtatttgaaaactactttgttgctaagaacagcattaataaattataacatttttttaaaaaataacctacatatttttgcatacataagaatactgaacacaacttgatcaataaaatcagcttgtgtagcaacgcaagaaaagcatgaactgcagagatgatggtattgtttgttctgtaaatctgtagagttttgggatttgttcaaattggctaataactggattgctaaaatgttattaattgcatactactctgtgtgctattttatttgacatcatgcactagaaaaaggtgcacaactatcatttcataaaatatggcaccataatacatgattgcccagtcttaataatgtattccagacaaatatatcatagactcatattgcaatttgcaaaatctacttatatccatatctccacgacaaacaaaaaatgagcaaaagaagtgttaatacctctgattttgtttgcaaaggctgaagaatggaaaccaactttttaatatcaggcctatctcttggttcatactgtaagcattttgaagcaagatccaccagagtagtagcctcctctatagagtactttccctctaaatttgtctccattattgcttggatgcttctgcttcttatcatgtcaagtgcctgcacatgataaatgcgtaaatttatcagactatcactgcttgtacggtttaataaatggttaattgctagctctatatttgacacataaaagaattgtactcatcgcacaaggaattccaacaattctcgacttgtatgagctaaatgcgagatccatcttaggaaatgttttcattcattgaaatagaaaaaatggatgtcggatatttgtgctaaaaagacaaggaagataattgtatagaagatttcaaacaactttgtcagtgtgaccctgcaattgatgaaagtggcctgatacacaatggaaattgaactctagaaacatacttacaagggtaggaggaatgcgctttccactgagaagatcgatgagtattgtgccaaaactgaatacaacactttctagtgtgaccctgcctggaagaacagacaagcatctcataaattctgtggttcctcctgttttattctagtcagtccttgctactttgaaaatgcaaaattttcactgaacatagtttccatcgcattcacaaaagtgccaataagttggcttgaagagcactaatttaggaatccataagctgaataactgatctactggcccttctacaagaaaatccagtttgacaacatatttattgacttccactttaaggagtttagttattgttttaacagcaataaacaaaactttgtacagcaaggagattttaaaaaatggttcccccagataagtgaagagaactgccgaaaagagaatactggataatttgttttcaagactggtaagcaagaatgtgaaaaatcaagtaccatttctcagatattctggaggtgtatatgccaggtttgtactataacttttcccatccctgctgtttttcatcaaaccaaagcatgatagacgaggatcaccattctgcgataagaaagttaattagaaacttttcttacaacatgatggcatgctgaattgttgaatgcaatcaactatgatcttacaaagcctacttgactcaatacaagtttgtctacgtgatttgccgtgctcctatagtaggaactaaatttgccgtcggttttcccaatccttccagcacttggaggtgggaaaaatcaaaataggtgacaaacttaaacacccagaccctttaatcttgttggttttcttgaatgataagacacaaaatcaaggctagctgccatagtaaatatcacttttgagacgtcaactagatatggctgctctcctgcctccttcaaaatgaaattgtaagttttctgtgaaattcatgcgtaccaaatggggcctaaggtattgctacagacactgaacaccagccataaagaaaggcacttacgtcaacaaaatggcagttggcaagagacaataatcacttgcctgatgtacaatttcaggtgctacatattgaaacgtacttgacaggttgatcgcttacctcatcaaagagtactctgtatgcatttaggtcgtgatataaaggcctttcctcattgctacaatattccaatgcttcagcaatgttgtatgcaactctgaggcgcatagcccattcaatagccttgttttcccctgcacaagtgcaaaagcacggttaagatcaaaattaacttgttttccaatgctttgcttgtttatacgcgttaaccactaacaataaatgcaatccttacttgatagtactaaggccattcccaacccaaaacactagacatgattttcataaactccacatcatcaagaaactagtactagacaccactcttccaatgcaaacactattattccatacttaaattcaatgctccttatctcacatgatgtcttggatgttgtgtagaaaccatgtctcatgcaagacatggtttccttctctttcctcatttattcacttgccacatcatttttcattctaggtggcaccttatttaatgctatggacaccatcctaatcattgggttgggaatggcctaatactcccaaagattagacgaaaaggtaaattaaatgcagactgaaccgacaaaactaatcgaaaaaactgtgtagcctgataggagctgggcacctaggtggttccatttgtcaagtattatcaacttcaataacataagctcggcacaagcttggatcagatcacacgaagcatagcaacatccattatgaccagaagggtcgaatagttggcaggatcatcaaatgggaggggaatataaagacccggagttaaattgcaggggagtggagggagggaggaaactcacagtggaagaggtgcttggcgagggtgtcgttgggcatgaactcggcgacgaggagccgctcgtcgccgtcgcagcagtagccgatgaggttggccatcctccggtgccgcagcttccccacccctctcgcctcctcctgcaaaccaaaaacccacaaaaccaaactcagtttccaaatccacgcctaaccaacccgaaccccccaatcccgcggcaacccaaaatccacgcgcaagcggctggttcgttggttggttgtttggttggatggatgcatcccccctccccgcttaccgcgaactgcttggggtcgggccatgccagcttgccgaacttcttcacggcgatggcgcggccgccgcctcccgccccctgcagccgccccctgtagacgaggttgggcgccttctcgccgctctccgacacgatgttcgccgccgcgaacccgcccgtcgcctcccggagctccgccagcgagaactccgcgaacgccggggcgggagcggcggaggcggcggaggaggaggcggccgcctggtgcgcgttgagggtgaaggacgggcggcgcgggtggtgtggctgcggcggcggcggcggggggcgggcgcggcggggcggcttctccggcgcgtgggaccccacccgcagcgaggagccgcagcaacccatacagtgtgaggagaggagtttggaaaagtattcgcttcggccgcgtcgcgtgcgggggtggtggtgggtgggctgcgtctgcgcgctcgtgcgggtcggggaggagagagaggaggaggaggcgggttttgtaacttgctctttctctctcgctctccctcctccgggttctacgggtttggtttttgtttagtttttgcgcatggggctttcaaactttttggcgaaattcaactgtgagtcatgtgaccgtgtttgtactttgtaacccctggctggctgactggactgactctatagctgtgttcttacctcttggtcccaacctcacctctctcgtcatacacacacggtgtgttcctaaactgttaaatgatgcgggttttttttcaaaaaaatttatatacaaagttatggtaaaaaaatcatattaatttattttttaatggtttaagctaatacttaattaatcatatattaatccatcaatttattttacatgcgaaagagaggggttcccaacccatccaaaatactcaacctatgtatggccacactcttctctggcacaggctagaatgtgataaaggagtagtattgtttttcgatggtttagaggagagattgacgatggtggttggcgagggcgatcaatagtcacaagttgagggttcgtcaccgagtacgagaaaaaggcatgatacaaagaatgtgcaaagatttggttagactgtgctagagttgtggcaggaggggtaggataacaaatgaagtacttctattatggttagatacgatagatgccaccgatgtcgtgaaaaggatgggttgcctaatagggtggtgttgagggggaaatatagggagagaataataggggttagtgaagaggggatgcaaggtgaagtatgtcttatccaatatggctaatgccgtctcaaaactaagtgttgtacattacattaaatttgatgattagaacccccacacatatctaatggcttttcatcccgacacatacctaatattttaaatttatcaataaatgcacttaatgcattttgtcttaccatcttaggttgctaattgtgtggctatcactttcataccatgtcaatctagctaatagctacctataatgctagataattccatttttacacaagtcatattgggtgataataattggtgttccatatatgtctttttagatactagtatgttcttatcgatgtcttgtctgtacgttggatctgaatcatgtgtttagtaagacattataagcgataatataaggtagttatataattgctcagtatagaatactcaactagggtgtgtttagtttacatcaaaattagaagtttggttgaaattggaacgatgtgacagaaaagttggaagtttgtgtatataggaaagttttgatgtgatggaaaagttgaaagtttgaagaaatattttggaactaaacacggcgtaaagcattggctacacggctatacctacatctgaattgatccattcttgtgctttattttagtactacttgactcatctgttgctttgaatgtgaagaatgaagagtgacccttgacacgttcaagtcaacaagggctagaaattgaacggatgaaccgtctgccacgcaaaagcatttcactcaactaatatgcgcgtagctctagattatgtgctgcacgcggatgtgtactttgccttgtaattatgggtgttgcatggctatgttgcaaaaaccagcaggtatcaaattaaatacaatttacacatggcagaggtagtatgcagaaatttgtagaagtcggagcaagttttgtaaaggggtagtttccacatccaattttatatccatgtaagataagatgtgatatatgcaatatatgcaatataagatgtgatatatgcaatatatcacatctacattatctttagcatactatccccaataattttattttatttgtttgtccaatctcctctttcttttatcttcttttttgaaatttgtgtgaaggttgtctcttacatgaggtagtggcggagccagaatatgcttagagtaggactaaattagtattatctacataaatttgtgtcagggttacggataaggtatatcctctacccttggatatacgtcgtatactgatatgatatgcctgcgtgtatacggatattttctgtatacgttaaggaaattcatcacgattccacagatggaaggagtcctactcagatagaactgggtcgttactgtatcatgtagggtccgatgtcttcgagttctacttggagaccaactgacctgcggtataaaagggaccccccgggaggacctaaggcatcgaatctcaccgccaacacaaccaccatagcctacgaagtcggagccttcaggagtcaaagtcgccgaggtgatcgggtcgaatcaactcgactacggtttcgtcggtatcatcgagttctgctattccctttgtaatctgtggttttcactatataatctcatatcaactggattatgggtattacctatcaaggggtctaaaccagtataatccttgttttctgtttacttgatgtcgtactacgtagatcctcataccagcgtaccccaatatcctctatatccggtctacgggtatcccccgtcgacaatttgtctcttgtctttaatttttcaaatttatagtataatttcaatttatatttgggcataggagtaggattctagccctagctgtcctactcctatatccgccccttagcatgaggggtgtcttcccttctctttcttcacttattttctccatctcataatctaatcgtatgtaatatatttagaaacaatacatccaacattattatagtacttgctctcattggttgtcgttttggatacatctctccttaattacgtcgtacgtactactaagtccattgatcgaaacaaacaaacgagcacgttgcataagcatcacctaaggtaaaaagagaacgttgtacggagcaccatcatcaagtactgtaccttccaatataaacaaggcaaacatcgttggcgacacggagcacgtcggcgacgatggtgacgacggcgaagacgacacaccgacgtgcacgcgtacaacaaatttccactgttctcatggtaaagaaattgtactaccaccaccctacctgttatgccctgaaataaattcatttgttaattgttatctaccctactcataccactaaaacctactttatcaaactcaaatataattatttattttttatctgcttttaatatattattcttttacttttataaactctgatatcgtgattggtaaaaaaaacttattttaagataaataaaggagacaaaaataatagtattgttttaagatatataaatactccgtaatagtctaatacttactccctcaatctcaatttaaatgcaatcatatttttccgtgtctaattttgattatccgtcttcactgctgccacgttgaagtcctggatgtcactactcttggttaacttcttaaaaattggttaactgctgccacgttggacctgccgccactgcgtgtggtcccgggcacaggctcgcacgcacgatgacacggcaactgcacgctcgtgcgcgcgcttcgtgtgacgcaacgtacgtacggtgcaggcgctgggacactgcacgtgggtcccacgtactgctggccccacgtgccagtgtgacagagcagacggcaatgattgactgatggacagattactgacagatttcacagtccgtgtgcacggcgtgcgacggtgaaatgacccatcgtaccgtacgtgcgcgaccctgcacatggggcccacatctcagccggatcgatctaatttacgacctgtttagatcacatgtagttttcccacatgtcagatccaacacatgcataaagtattaaatatagaaaaaattgtaattataagttgtgagatgaatcttttaagcctaattacttcatgattcgataaggtggtactacaataaacatttgcttatgacggattaattaggcttaataaattcgtctcatagtttacatgtggaatctacaatttgttttgttattagtctacgtttaatattttaaatgtgtgtctgaatatctggtgtgacacgataaaaattttcaccgctggatctaaacagtaaacacaaccttaatttagatcttagccctgtatagttcacaccaaacttcctccaaactcctaactttccatcacatcacatcacatccaaaactttcctactcatataaactcccaactttttttccaaactacttcctccgtttcacaatataaatcattctagcattttccgcattcatattgatgttaatgaatctagatagatatatatgtctagatttattaatatcaatatgaatataggaaatgatagaatgacttacattgtgaaacggagaaagtaccaacttttcccaaacttctcctcaatttcaggaactaaacatagcccttatgtggggagcgtatgatgtggacgtgccctttccagaattccaagtttggtacagtatactatggccttgtttagattcaaacttttttattcgaacttccaacttttccgacacatcgaactttcctaaacacacaaaaactttcaacttttccgtcacatcgttccaatttcttcaaacttccaattttgacgtggaactaaacaaagcctagatacaactagagtaacaaaactagagtaacaagtactccgtcccaaaaaaaaactcaatccaggtttaaacccagaattaggcttttctaaagatggagggagtatgttcacatttatagtatataagttatattttttattagatttattttttatgagacttagtgagtatataacacataagattgtttttttacttctattacatggcatacgtatatgcgcacgcgcgtataaactactacacacgtgcttcctagtacatgaagatttgacccttggtgggtcctccttggtgtcttaatggaacaaatcacatattaggtagcaatattttaggatagatgatgtatctatacaatacaagaagtcaaagaatgctaggttcttttatccaaccgcaaacatagctcaagtccttttaaatcacttgtaaataattacttgtagtattctaaccaccgggagaaaaaaaaagcaccatcctattagctagatagatcatctcttttggtggaaaagcaagataattgctgggcaccgcagatcccagatggataatggagcacgagcccaccggaacacacttgtatttaaaaaccgtccttttcttggtggttgattggtgatttggtgccaatggttggcacctgctggtagctgtggatgaactcgccgtggcggcgccacctgctgcaagattttcttaaaaaaatatttattgttttcgagttttacagatctgtaccccctaatgtcacctgccagttagagtgggtcgacgaccgtttgccaggttattgaaaaaaaaagaagataatccattatatgccactgattttgtcacacgtctataatttactattgattttgtcgtgttctataatataccatcgacttttacttaacttctacgatttaccattgccatccggttagtctccgttagtactgtacaattttgtcgaaatgatctaaatacctttgggacaaaaactttcaaaatttggataaaaattctgaaataccagattttaagtttttgaccaaattctggatgtttacaatcttatatttataatataatattttgataattttatccaaattttggatgtttttgtccaagggtattttggtcatttgcataaaattgtacagtgctaacggaggctaaccggacggtgatggtaaatcatagaagttaagcaaaagtcgatggcatattgtaacatggcaaagtcagtggcaaatcgtaggcgtgtgacaaagtcaatggcatataatgaattctctaaaaaaaaaaaaagcccctacaataccaaatatcattaggggtatagaattatagatacgcaagacaaaaaaaacattataaatattaaaaataaataaataaataaaatactctgctacaactgcagcgagcactaagcacccggcccaaatagcaggattgggctttcacaatatagcccggctcaccacactttgggcctgcttggaatggttggttggtcgggaatgagaatcttttgagatggggttgcttgggagctgggacgcgtgaaccccacaacgcgtgtgccgttgcatccaatctcccgtatatgccgttcacaagttcgagctggttgccctaataagttaaagttaaaatcgaaatttaaattttcgatgttgattttaagatattttcaatgtgtttttaaatattagcttttatgtcgctaaaaatacacatataaattaatttttatttttaaataaattgtcttgatttattagagaatatggtaactgatgaggccttgacgaggaaggcagcggcagcatcacgagatcagctcgtgtccaaccgaccgcgatgcgtctcccgcgtgtacgcatattgcggcgtcgttgatcacgtgccaatttgcccaaacgcgcgcatctaaggtgggctcaaacaccaaaaaggctagcgacatgcattatctgggcccatccatccaatctccttcatctcctgggcccaaattgccacaaagcgatcgatcatgaattattccagtggttctccctttcgcatcttttcctccccttttctatcgtccttttttttttctcctagtagcaagagattggataacaaaaaaaaagctttattaacaaaacaaaagttgcctaaaaaacacttgataattccaaggttgcaaagacgaaaaagaaatcgtccgtgatgtgcatgcgagcgatcgacgagagattctccttttggtagctactcccatcgtgctcgcgcgcgtcttaaacaaaagaagcttttccactactcacaaatatactaaatccgcacgagctgtcacacgcaagtggtctcatcacatcagtctcgtctccgattaaaatgatttgaattctgtcctaacaaatctaagactaatatcatcctcgtcgtgatctcctaagttgaaatactattaagcacgcggtgtttggatcccatccccatgtgcaaaccgcaagatccaggccaaaatcatagagcaagcaaaaggaggtgccctacccaaccaacccaattatgcatgtgccattagattagattcagtattttcagtatactctggatttcagagactttcagatggtaccagaattccagaagattggggggtccttctcttttgcattatggattgcatccgtccaaagctgacttggattgcaacattctagctagccagccagccagcaaggctgtgtttagttcacacaaaaattggaagtttggttgaaattggaacgataagacggaaaagttggaagtttatgtgtgcaggaaagttttgatgtgatggaaaagtttgaagtttgaagaattattttggaactaaacatggtgcaagtgatggatccatatgattgaatctgcatatcatctctctctctctctctctctctctccattatttgagtgaggctacattgatctcctcttcatgtgatctggtggcaatgaaatccgggccaatcacaccggcgatcgatgtgttgcagcagagactactgtaccggagttgttcaggctcaggacggccatggctgcactgaccctactctacttgtgaaaaaagtgatgtgccacttttcttgttaagtttggtgttcaaaacgagactgttgctatgttgctttcgccttttcaattagtacggtaatctctgtggcaaaaaaacggcttaattattcagttgatctgatgcatggccagatggcccggatgactgtcagttgagttgtctgaattcagaaaccaatgtgcagatgttttgtttatactaataatgtaggagtatgtgtgaatgttacagttggatgcatggtcagtgtggatgaggatttgccataggttcagaaaccggtgtcagttcacgatcagaggatcatcttgacttgagaaccaagctggcaacttggcaatgttgggcaatggaatgtgaggttaggctgaaatggctggccggataaacgtcaacttcagtacagggagaagttggcgatggcaccactggaaaagggtttggtcactgatcactccagcgtggcacattaactgcacagatacaactccatgtggtgccaaaccgaccctagccctagattgatgcccaatctactcattaaacatctccctttgcaatgaatgcgtcttgaattgttgattcagccctgtgaccttttttaattttctgaaaaggaaaaattgttgatacaacactgttcccatgcatgcaaatgagaaagagatagctgaatgcctgaattgaaatagtaacattgttcacttctcaatctagcagagtagaattaatacaatgttcacctgttcaaatagaaaaaaaaataagaggaaagaaaaaaaaaagcaagcccattgagcaatcttgcagaggcaaataggcaatgcagagagaagggatgaaagatgcgaaatttgacatgtttttgaacctaagtgggggatcatcttctttacatcacaaaagtatttacatcatgtacacacgccaaacgaaacaaaatgaaatcttttggcaactaatctcacagcctttgctcaaaaaatcagttgatctctctgaagaagatgaacacaggggatcgaatcgaagagaaatgtgtggggattgtggagtcaaaatgtgggcgtgagcaggttgagcagcgacaccctggcattgacgagcgcgcggtacacctcctcgcagccgctctcggcggcggcgacgcactcctcgaggccacgcaccctcgccatggccgccttcctctcctcctcctcctcgttgcagtagtcctcgaaggagacggtccgccgccgccggaggaggtcggtcaccagccacatggggctggccggcgtgcgggcgggggagtagggcgtcggtgtccgtggcgacggcgcggcgctcgccgcggactcggcggaggcggacgacacgccggcgaagacggcggcggccgcggccgccacggaggaggcggcggccgcgaaggcgtcggcgagggtggcctcgtcggcgtcgtctcccggggcggcacggtgggagaggtcgcgcgcggaggaggcgagccgggagacctcccgcgccgagcgccgctgcgcgcgcagcgccgcggcgaggcgcgacccgtcgcggcgccggagcgcggcgtgggtctcggcgaggagctgcctgagcgcgacgagcgactccctgaagcagccgtggaggtcggtgaggaggaggaggtcgtcgagcagctgctccgtccacggccgccgcagcgcgtcctgcgcctgcgggtggtggagcaggtcggcgagcccggcgagcaccttccccgccctgtccgccccgtccgccacccaggccggccccgtctgcgccggtgcgtccgcccacttgagcagcgccctcgccgcgtcgtgcaggccggcgacgagcgggtggaggcggacgggcaggctcgtcgacctgacgcgcgcgtaggacagcttcttgggccgcgcgcagtcgagcaggaacgacggcgccaccgccttgtgcgacgtgagcgtcgacagcgtccgccggaatcccaccgccatcgatcgagaagcttctctcttcttgtgtgttcggtgatgatgctgcggtggtggtgaggtgactggatgcggtggcgggaggtggagttttataaaggggcgggaggcggagcccgcacgggtgggtgcgtgagctgagctcgtgcagtggaacacgtttgactcttgcactgcagtggcttgctgctgcagctgagctctactagtataaaattactagtactactcccttgtattttaagtacatttatacatttaactatttatcttatttaaaaaattcagacacgcataaagtattatttgtgttttattatctaataataataataaatattaattataaaataattttaaataagacgaacggtgaaacgttggacactaaaactcacgattataagatagagggactatttctttttcttttttctatgggagagtatgcgaacgagccgctggggtttgttggcttgaggcggaagaaagatgcttgcaagaggagacagcttgttggagaagctagattcttctggggctagccggaaagggattggaggaggaaaataaaccgagcaatgtgaagttgctggctgttcatgttgagggtaggggttgtttccagcaagagagaatgttttgtgcagttcgacaacttggaaagaatacgaatacgatgatgtacatatgaatctagctcatatactgccaaaaattggtataaatgattaaatgaatagtagtagtcatcagtgaggaaatcaataaacacttatagatgccgatttgttagaaaaaaatataaaaaaattagaggattttaattatataggaaaaaaatcctaggaggctaagcaagcatccattgggagttatgatcgcagggatgcacgccattagggcatccacaatgtagtgtaaaagtagtccataagcaatagaatattccattcagccacctattaccattgtgcaactagtgcatatatagaaaatagtaaaagatatccacatgcatatggactacctatatggaataaattatactcccccgtttcgaaatatgttgacaccattgactttttagcacatgtttgaccgttcgtcttattcaaaaaatttaagcaattattaattcttttcctatcatttgattcgttgttaaatatatttttatgtaggcatataattttacatatttcacaaaatttttgaataagacgaatggtcaaacatgtgctaaaaagtcaacagtgtcaaacatttcgaaacggagggagtattatctatctctactcctctctcttgtcctaatgataccttgtatccatgtacattgtggagattgctataggaaaaaactatttatgtgggtcctatctatatagatcactttacccatatatattgatgatgcccttagtatttagtaggctagtagcacttcccattcttcctcagttgaagctcaaccgaaatttgatcttttttaaaaaaaaaatgaaaaccaaccgaaagtttggtgactcacgcataggagtacagtccccatatgaacgaacataccatcatcaagacatcaatccatccaatcatatatcgatcaatcaatcacagagcacgagccaacgcaaaaacggcaatcgatccaatgcaaagatccgatcgctccaccatcctggcactgcaccgcgagtaatgtcgcgcgcgcccatggtccatggacaacggccccctcctccctccgagcctgacgcgtggtgctctctctctgctcccacccgcccggtacgcgcgtgtaggggacaccgcgccgcgcgcccgcgcgccccaccgtccccgcctccgcccgccggcaacgcgccgcgcgcccgctcccaccaccgcgcgtacaccgatcgatcaccgatggcgatatgcatgggacgcgcgtgcatgcattgcaccgcgcggcggcagatcgagttttcaatgcgtcgcgcgtccgcgtgactgcgcccgcccgggccgctgcttcatctgttgtactagtacactgtgtgggcgcgcggttgtgatcgacttgtgagcgcgtgccggtgcgctagctgccgtacggcgatggatccatccatccatcgatccgcacccgcccgcgcgcggctcgccgatttctccacgtgtagtatgcacgtagtacgggtacatgcatgaaccggcggagtttgggcaggggcctggttgcgttcatgtgacgaacagacatgcattccgaaggatggatggatcatggattggggcggggcgggcaggtttcttcaatgcgtgcaataactgatcggtgagttatatggtcctctaggaggaatttggattgatcggtcctctgggtttgacaaggagtcaaacagctactagcagcctgctcttataatttcccttctagaagctctattggctttcatcgaggagtacggagacggtgagactgggcctgttggaagataagcccaggactaattttgagagctaagagcatctctaacagtctcttcaaatcccactctccaaatgtctatttagccaactctccatttaatttggcaagtcaaattcgtttttactccaacagcctctccattcatcatctctattctgagtgtatgatagcgggacccatatgtcagtctctatactttttttttctaattatcctgtcccggccgcgcgcgggcaggcggccggcggcggccacggctgcgcgcgggcaggcggcggccgggcgccggctcggttttttttatatataatttgtgtttcactggatgtataattttttagattttgtgattcattgcatcgcatggatctaagatgtataatttgtataatctgtgatgtatttaatttgtgtgtagtttttaggatttgtgatgttgttgatctgtgtgtaggatttgtgatgtatttgacttgtgtgtataagtaacttaatatttgggatgttgatttgggatgtgcatctcattcgattcgggagaaaatacatatattaacactagccattagcaaatcaacaacaaaataataataaaaaaaagatctcgatgaactgtcgcttcccctcaaccgggactaaagatcgatctttagtcccagttattataaccgggactaaagatagcgatctttagtcccagattcgtagtctcggttggaaaaccgggactacaaagagttctaaaccgggagtaaagagcatttctccaccagtgcggggaccgccgccgcgacgacggggtggcggcggtcgggcgcgacgacgacggggcggcggtggtcgggcacggtgacgacggggtggcggttggccgggcagcggccttcgtgcgcggcgacggcgaggcggcggcggccgcgcgcggcgatgacggggcggcggcggtcaggcgcgacgacaacgggcggtggtggttgggtgcgacgacgacggagctggagggagaagagtagcacgggtagaggagggctggagatgggatagccagcctaggaggctggccaatattggccagtgggtgggcttggatggagatgcagttagcttggagagttgaatagagagtctgttggaggagtgtttttggttcatttgccaaatttttagcttggagagctgagtagagaagctgttggagatgctctaatgtttagtcttgaattggtaggataaacactagtctagggtgacatgttcagatctatgg

SEQ ID NO: 67659 - DNA, 1878 bp, Oryza sativa
  unsure (1)..(1878): unsure at all n locations
ctatattccctccctcccttcttttctttttcttttccataaaggatttaaataaatcctttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttacatttgatccttcctttgttaattgttataccatgtccccttgtaaccacccaattgcgcctcgatattcgtgcactctgtgcgagtatcgacggtcgccttcaaacttaaaatctgagtaacaacttgggtaaaactggagttttacaaaggacttggaaaacccgacacctgggtcggtgcttgcgaactaaatgaatttccaaaaccgcggaccggggaacgtaccgggtgtacggtttcccgctctcgcacttaaggactgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtctgactactgcttgtgaaattgctgttgtgaaactgggttcgatgtttgaaaaatcagcagctgacgggatcagctaggcccgggtggccgtttgaaaagttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaatagcctttccttgaagccttcattaaacacttatttcccctggcttgctgagtactcccgtactcacccttgctctatataaataatccccccccagttgctgaagaagatgaagtggatcctgctgacgaggagttcttccanggagcaagtcggcatacgatgagctttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttgctgtgatactctgtctccctgtgataccagcactgtttcctgggactggtatcgattaacaggttaatttggagcgtcacgggctagatccggtcgggactagttcggggcgtgacacggaggcgcgtggcggcagaggagtggacgg

SEQ ID NO: 67660 - DNA, 897 bp, Oryza sativa
ataagatactgtgggtgtgtttagttcacgtaaaaattgaaagtttgattaaaattggaacaatgtgatggaaaaattgaaagtttgtgtgtgtaggaaagtttcgatgtgatggaaaagttagaagtttgaagaaaaaattgtgaactaaaccagatctgtgttaaaaatagttatattttgatagggaggtagtatagcgtatcagccggatgctgacattcaatacaggatgctgatcaccctagcttataccgattgagagatattgtttgagatttctgtactatacgtacactactcacgtcgtcggtcgagccgagtcaatctctgcttcacgggaaccagctgcctctcttctgtaggagtagctgacaaagcaacggtcacgcggtctactgtccgatcgactgactggctgtccgagaccgagggcatgcaagaggtcagcgccattaatgtgagatagatatatggtcaacgcaccggctccaatcccacgcagccgatcgatcacgttctggtgggtggccaggtagcgttccatcaactggtgtagtaaggcggagtaattgcgtttgggagtacgtttttctacctaccaactgcaaatgggctgcacaactgcaagtggtcgggtgacacggccaggtagagaaggaataagttttctttaggtccctcatctaaacttcgagtataaattacatccttgaagcataatactagatataatgtgtccctcaacttatagaaccggtattcctaagatataacgtgttcctacttgtacaacatctcgtgaatgtacatatgcatgcatatccaccggcggtgccgactgtactccaacacgaacgctacgtgccaagtgtgtttcatacgtcgacctttaca

SEQ ID NO: 67661 - DNA, 6919 bp, Oryza sativa
ccagccgtgcacagctgcggcagatgggatcacacgaacctgcacgaccaactcctcctccacagcctctctctctctctcatcaaatccacgagctttctctctctctctctctctctctctctctctcctcctcctcctctccttctccttcccatcgccaccagcttctccggccgtccgccatcgctgctgaccgcagcatccgcagccacagcttctccgacgccggcgacggccgtttcccccccggaggtgagcgctagctgcttcccgttgttcatccggcctctctgatctgattctgatcttgcgttctttgggttggattcctgattgctgtttgggggaaaaataaataaataaataaggggatcttttctggtttcgtagtgggggcattcttggctttgtattcgaacgcgggagctgcgaaatggcgtggttcttggtgatttggaaacggatttcatttcatttcttttcttttctttcctgttattgatgcgattgatgtttctatttctcgctcgatttcgtctcggtacggctcgaatgatgaccaatcgaaaaagtactgtttctgtgttcccaaaaaaaaagaaattataacgatttttttgctgatcgttcttctgtttacagggccaatgaaaaagctgcatcttctttttctttttttctcctctttaaaatggtttcgtttccgagcagaatacgaatacggaagagtgtgaatcatgagcggaggcgtcgagccggagaccccgccgggtagcagcagcggcggaagcacgccggtgggcggcaagccgccgcgccaccacctcacgtccatccgccactgcgccagcagcgctcgcatcgccgccgcaaccgcagaattcgtaatcatcctcgctacctacctatcgccctgtccagagaatttggctcccaatattgtgtttctgacattttctttcgttgctttgtttgcaggacctgggtgcggggacgctgagcttgatctcgcccacggacattcgccctggcttcctgccggtgttccgttccgggagctgcgccgatatcggtaccaaatcgtacatggaggacgagcatgtgtgcgtcgataacctcatcgagcacctgggagtgcgtacacctgtgatccctgcaccgggtgccttctacggggtgagttggtttgcatttgcatcaaagttttggaggcttgctgttcagtattcagcaatatatgtgctcattatggaccaatgatttattccgttgccagtggtaatattgttgccatgatagtttcttggtgtgctcatttggtcgtacacatcatggtgcaaataattgcatattagtgtggttgatgatgatgtactcgtggtgggaatgattgcatcaggcgaatcagctcattatgagcatttataattcctcttaaattttcttattaggttgtgcaaatgtgcaatagcctttgtgacccccaaaaatgttaactaatcagcatataatttcttttcatggaacactaaaatattatcggtaaacggtagactgtcaagcatagtagagtgggcaagatgttgaattttaatatgctaaactatgcattgtatataaaaggagcatgcatgttgttatttgagattttcagttaactatttttcattctgtacgggagttttcacagcagatgtttaataggttcaactttttgggggtaatttacaggtgtttgatggtcatggtggtacggacgctgcttgttttgttcggaagaacttactgaggttcataattgaggatggtcacttccccagcagcatagagaaggcaatcaggagtgcatttgtgagggctgatcatgcaattgcggattcccattctcttgaccgcaattctgggactacagcattgacagcacttatttttggcaggtaaattctaacgccagtatctcaaatgtttattccagtggtacaatgcactattgagtcattaatcgatgctactttaatgcgaaaagtttctcaagtctgtactgaaattttccattcatgacatcatattgtaatccagtagcctctgctagttagtatccaaaccactagtggcagagaaatgagtattagcatttaaagtcaagctgactcaattatgaggtgtttctgcaacttcaattagttattagatactattttagctgatttgtgaatggaaataattttttatccatcggctatttcacatttttttagagaacaaatcatatattaacccggctttgcaataaagcccaacataacaaggttcgacaattttagctgatttgtgaatggaaataactcctttctcatttttcatccatcggctagttcacttttttttagagaacagatcatatattgacccagctttgcaagaaagctaacataacaaacagaccatatattgacctggctttgcaagaaagccaacataacaaggtttaaaaaaaagcgatatcgcccaccgtggggcttgaacccacaaccacaaggttaagagccttgcgctctaccgactgagctagacgggcttttggctgttacattttctttacagaacataccatatattgacccgactgaactagacgggcttttggttatttcatattttctttagagaacataccatatattgacctgactttgcaagaaagctcaacataacaaggtttaacaaaaaagcaatatcgcccaccgtggggctcgaacccacgaccacaaggttaagagccttgcgctctaccgactgagctagacgggcttttggctgtttcacatttattgcttcattgtccaatatcacaacaaagcgcaaagttctttcctgctccttaataagttggttgtgttgccttagttgcttgacaatctttagatcaattatatcattttgcatattatggtgaatatacctcatttgaatggcaggacattgctcgttgcaaatgcaggagactgtcgagcggtattagggaagagaggccgagctgttgagttgtcaagagaccataaacccagctgcagaagcgaaaagatcagaatcgagaaccttggtggtactgtctttgatggctatctcaatggtcagctgtctgtagcaagggcgattggtgattggcacgtgaaaggttccaaagggtccataagccctctcactgcagagccagagtttcaggaggttagactcaccgaagaagatgagttcttaataatcggctgtgacgggctttgggatgtgatgaccagccagtgcgctgtcacaatggtaaggaaagagctgatgacacacaacgatccggaaagatgctcgcaagagctagttcaagaggctctgcgacggaactcatgcgacaacctaactgtagtggttgtgtgcttctcatcagacccaccacctcagatcgaggtcccaagatttcgagtacgaagaagcatttcgatggaaggattgcatatgttaaagggagctcttgacagtaatgcctgagttctcaaaaccagctttttgtggtaactatggttgaatgatcttgttgttctgttgggtccttgaaagttatgctctgttcttcagctataggttcgcaataagtggtgtataatgagtgcaatattgttgaggtgtaggctaatcattttgtgaggcgatgatttatctgtaccggcgccagcatttggttgttcacaatgtaattgaccaataccagcattcatattctggtacaagtgccagttataatagttgatcagttttgttctacttcagacttcagagttttcactttgtcttgtaaaatctacttcctgctatgcttcctcttgagataccaaagcaaagaaaaaccaccttctatgttcagaaacaacttatctatgggaacatatgcataacagaagatattctgaactttttcatctattagtttcggtttagagaaactcgaatactacagcatttgaaaggctttggttgctgcacttccacttatcattgcattcttctttcaattaaatcctagaggcaatcatgtatgtttttccttgtttgctagcatatataataatacagttcagtaacctgagtacattaacttgcctgaatatttgaccaattgcaatggatttgccttgccaaattattggtgtcaattaactcaatcagcagcttcaagacagaagattctgaaaaaaaaaacaagcgattcctcagaagttgttgggacctgacctgatctgaggaagcttgtgcccggtttcctcgcatcctgccgccattgttggtggagcacatggccatgtgagccttcaaggagcaaccaaaggggtcgccgccccaaccccccgcagacgccggcgaccgcggcggcggagcctgaggtgtgggaggatctctccggcatgccgctcggagccgacctgatctccggccgccggagaggatctgatggggacggaggggagggaggcaaagcggcaaaagaaaaaggactactttgtaaatctcaccataactaacaagggtatttctataaatttatggatcgctatcattcctggcttttttgttgttgtaaaattaatcacagaaaatctacgactagcgactcaaaccagcgaattcctcgcaaattttgaattttccttaccgatcaggctgagttgtaaagagtagttggagaggctattctgtcctttttcatcatgggcatggtttctaaactattaattgatgtatttttatattaaaaaaacatttcatatgcaagtttttctaaaaattaaataaattcattttctaggtttacactggctaatatttaatcaatcatgcgctaatgactctttatacttttcgggtcagaaaaagatctcattccaagcctttctttcaaaagcagcctaaatacactgctgaatcatccctcccctcatccgagaaccgtagttaggttataggtgctgatgctaagatacaggtgctcctgatgctagtttgtattctctgtgtaggttcgtattattaggatgtgtctcatctgatcaaaattgtgttagatttaattgggtaattgatccatttaaatcaattaaatcaaataaattccaaggctcattatgctaggaattcatgtgaattcattcttttataggatatcaatgggatgaagagttttgagaattaatctatttgattagggaattggtaatttatatcaattagtcctaattgatggatggttgatggttgtatagtggaggatggttcatggctagttgatgacaattagttgctctattcctcttcctattccattggtgatggttgtgtagtggaggatggttgatggctaattgatgagaattagttattctattcctcttcctattccatgactcttactctttatcttccattcctcttataaaatgagaatggatttgatctcccgcgaaagaggaagacacactttcatccattttccaatgctgttgctgctacggtaatcccatcccgacgagtgtgtgcacatgcgttgggagagtgggcctccgaaaccacgcgttgctgcgacgtttgcacagacgggcgggcgatcaggtttttgggagcgcaaggcgcgactactcactgttcgtcaacatcaacttcaccttcaccaacatgtcaaacactagagacaaggagaaggagactcccgtcaacaccaacggaggcaatactgcctcaaactccagcagaggaccattgttggggtataaccttattacattatttcaattagaagttttactgttaatgttcatcgcaatgtcaacattgtgttattatgtgattattgatgcttattcaacgttaagcatgctcatgttgattacattcaccactatcactggatcaaatcccattgtaaatatcatgtttattatcttgttattttggattaaaatatgccgaattatgaccaaatttccaacaaattgtttatattttagaatatatgaagtaatcctatatacctataaagttgatccccactaactgcaattactactatttttctgttttgtggtgcatccacgttaccaaaattgtttaccaccgttagattttatttccaaggctgtgattagtctagatatagcttcagtctgcagaccacaatctatcaagtgagtctagcccagcgaggaggcaggccccaaaccaattaactcccatgataattgtgttgtatgcatcgcttaattttctatgttaattactaccaccaataaactaaacagttacatgcatatattcatcaattgcatttcttgactcgacctttcctttcatctaccctttcacctcactatttatatgcctgatctccacaatggcatgtcttagccatcgtataggatcaaaacatattctttgtgataccagtggatgcaatggctgtgatctcttcaaattactgatggttttcttgatgtattatgctgtcaatgccatgctacagtcatttcttcatggtaatttggtttgtggtgtgttcctttcctcggcctacaatttaaattattttttttattttactcataaatattcacgttgctattttctttctttctcatgtgttctttgttgattggtttttgctcaccgtgatctgaagttcttcagtttttctactgcttatatggatattgatcctgttgatattgcttcatggcaatgagcaactaagctccctatacgaccactattttttctatgatattcattcatacagcaatgattctttaagtttattatcgggtattaattaaagtttactgcaattttatagcaggcctatatctttgttagcatcggaatg

SEQ ID NO: 67662 - DNA, 676 bp, Oryza sativa
cgagatggggaagggccagttgtacatcttggggtcgaggatgtacttgttgtagacgatgaccgtgaaggagaggaagatccacaccgccacgtacatgtacgacaccagcaccttccggatcaccgaatccgacatgcccccctcgccgccagcgccgccgccgccctccttccccacggccatcctcctccccgccgcccgccgctcggtctctccggctccggcgagacggtggatctgggcggggtggcgagctgtcccgcgtcggcgcgctcgcgagatggagtgtgagatctgggagggagcaggggaggaggaggaggcggatctggctgggaaggaggagaggtaggtggaggaggaagaggagggggtttcctctccaaatcaatcggcggtgcggtgcggtgcgagtagcggaggagtgggggatggatggggggagatggccacgtggagaatagcctctgcctgcatcttggggcgcccccttttataggccggatttgattttgtttttacggccttttctttctcccgtctcgggctccggcgctgtcgattctgttgttaagggccagttattctgcgctgtacgacagcacgagtagtcttggcgtggcaggccgcattgtgaatcggttttctttctccttgtgtaacgtgcagatct

SEQ ID NO: 67663 - DNA, 884 bp, Oryza sativa
gccgaggaaaaacgatatccttgatagaagctgattaccaagatggtggcccttgttaggcaggctaattgaaaaatggagctctggcttcctggagacctggacggagtacttttctcaggacaaggaaatgctagctgaaggcctgcctgaagctgcactacagacttttccttacgatcactgtatttcccgttcgattttcgagtaacctaactgtttgagttgtacgtcagtacgtgttacggtaccgcaagcgactttctggtttgtaacatttctatgcatgaacctacttatgctaggatttcaattgtcaaccgagtatcgcggcttcatcttacgcggtagagcctgttgcatccataccatataggagtacagttggttgcattctctttttgtcaggcacacatgatcacatcagagtaccatatatttctttccagaatatagtactcatgttgaatcagtatattctgttttcagtcactttattgatcaaaatttagattttagatgcttatattccttttccaagcacctaattagctgaaaatatatggatttatgtgcattggaattagtacaaagtttaaatatatccttaagatgcttataccattttggagtgttgggactagtattttgatatcttccgttgagaaaagtacagatctgtctggtgtatgaaataatgcctcgccttcgagtccacaattctgatggggacatcagactactagcacaagatgggccgctcttaagtgctaaggtatggcgtgtagtgaagtagatcagctaaaaaatggttggccatccgattctagcatgggcattagcagaacagcaggccaggaaagcatgtcagggatgcaggaatt

SEQ ID NO: 67664 - DNA, 24148 bp, Oryza sativa
tggattggaagtcaatatccctgagtggagtggtttgtaagggaaaaaaccaaactgacccactctgtagcataaatgagtatgcatgtgtgcagatctgatttcttcaggtcatacctgaaaaactaaattaaagacatccagaaaacaaatctgcatatgaactgttgcactcatgtttcgttgcgtatatatgctgtgcaccactgaaatttcttgttggtcacactctattggttcttgactctatgagccttacgtgctatcaagcaaggagatattttcaatcattttttaatcaagttctattacaaatatctgtaattaaacggtgtttatggagtacttgttttcctactaactagtaggcttcgtttcactgtatttttgtggcttttgctgcaacaatgtttgactgtcatgcagtattatctgctctgaacatcctatgtttcgtgttgataatagattcaatagatgacatacagaaagctgcaagttctctaaaacgcatccacctagcctgcctagcatctagtgccttaggcaatcactgttctcttcgaatcataatcttgtcaggatcttgatagacttcctgtgaaactcatgctatattcttttttgatctctttatgttctcccccattgttcttgataatcttgtcaagatcttttcatttatctgattattcgagctaacatcttctgattgcaaatcatggggtgtttaagtgcggcaagttttatgaatattttgatgatcacttaagttacatgttattattattgtagacaacttgctgctgctgtgctccttgcctccttgtgacttctgagtttgtctaatcttctttgactatgattgaacatgtaccttttaacagaaagtggtcaccttaaaatcactaaattgtgctcactattacatcacacataataaaaaggttaacttgaacatataaaacaatgattcgagtgttggatattttagtaagtaaagtatgatttgttttttagcttaattgatccaggtttacattgatagtatgaaaccaatgattggtatatatcgacatttgatggagtttttctatttggatcaggattaagatatggcatagctgatcctaaaatcaattaggcaagaaggctgtcagaaaatgggaaaggatgacatcatggcagccaggttgtaaatcaactaatgtgcacatgcagtttctgttcaactagtattatactgacgtgctgttttgatttggggaaagaaagatggagcaaatagttttcatgttttgagtactgtgttgagatcctgtaagcaatattacatgttagatgtcttcaacaggcgctgaagttgattgtggcatatggccataccttttactacctgtacaattcaggggttgtatttgtacagtgctgatttatagtctatatgcagaagtataaataatgtagtagtatgacaaattttggatctttatgaatgtgttggttttgctaccaaaattttgacaatctaagtttggcctgatttagttcccaacttttttttcaaatttccaacttttccataacatcaaaacttttctacacacataaactttcaacttttccgtcacattgttccaatttcaatcaaacttctaattttggcgtgaactaaaaacacccttattccttccgtcttataaaaaataatcagtataggatgtgacatactcttttcgtcccaaaaacaacccaatcctgggtttgaatcgtgtctagatgatttaaacccaggattaggtttttctgggacggagggagtacatgtatagtctacactaggctgagccatacctcgtactagttttgtcttccttttattagacggagagagtatgtgcacggagtgtttttttttttggaggggggtgggtgggggaggtaggaatgtatactttgctgcctaattttggtaagataggtggtgtttgaatctcctgaagatgaagatgaagtttttcacgtaaaacgaggtggtaataacgtgtgattaattgaattttaattattacaaacttgaaaaatggattaatatgatagtttagaacaactttcatataaaaagttttcgcacgaaatatactatttagcagtttaaaaaacgtgccatttaaatccaaaagtttatcctcaaatttcagaggaaacgaacaggccacaatggaccaaattggcacatggctcattttcgtatctaatactttttttttttgtcaatgctcaacttaaaccagcatgagtacgaaccgatgcccgatataacacatacaacctgttttgttgttttcacattaaattactatcagtcgcatgttacatgagagcaaaaatgtttgagtcaaatcattctcaattgaatagggtgattatgaaactaagaaccttgaaagatagttaaataaatcttgaaaggaacatttttggtgcccaatgaaaccttagacaaaaatcgctgaagggtggaacaaaccgaagctaaccgaaagtcggatcatattcataactgaaagtaggcatgctgattggcgtgcgtgccattttatagcatgtgtgttatttaattatttttaaaatttaggcttgtaaatggatacgttgttatatttgtgggctgatgtagattatttaatgtagatacatgaataaagatgacattatgaagaataaccctggatattaagctaaattgaaaaggatcccaataaaatacaacagaatgccacgaattgatcttagtattatggagaagaccgtcgccacagtggttccactcctttatacaacggtacaacctcggtccatgatcgcacggcagcacgcaagatgaaccagcacgaaaattgccaaatttctcgtatgcgctagtacatatgcacgcacagcacatggaccaaagttggactcctcttgttgaggctttggcccaggcagagactccatgcacgcacatgacttctagattgcaccgtgactgcgtgatgaaaaattgagaagcacaaccattcgctatttttccctttttcctccacgtgtcgctagactatttggctgccactcgaccaatcagctaccaggagacactgctattttttatatctttttgttcttacataattcggattttatttgtgagatcaggggagacacatggtctaataggcagctggcaaaactgccagcttgagattagttgactaagaaagtgttggacaaaacctgttagtgatatgtcctataggcaattatagagatgattgtatcttatactgtcacgtccggaaattcactagtaatttccgaactaatttgtgcattaaatcctcattcaggaatcagcggaggtacacaaactgacaatttaatatacagattcatcaatataataacgttacatacttacaaaagaaaagaaaactgcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacaacaaatatgcaagtgcacaggataccaaaggatgacataatatagggctcatttgcgaaagcagcatttagcaaacatttaagaattgcaaaacagtagagtaattaatcatcaatattaatcaacactgaacagcacatccatgctgatcaggcccaaccatcctgaacaaccatacccggctgcacagatctatctccaaaccaggaatgtaccattccaaaccaggagctaaattaattaccatcaattatcacattattattaatgagtagtgtgggactaatcacgaaagacattgttcgatccgcccataaccgcgggcacggctattcgaatagttttactctgctagaggtgtaccactgtacccacaagacacaaccccacaacatgtcaccatgcgcctcaataccaccacggtacctcggaaaggagctgtgacagtacccctcgcacaacacaatccaccacagcgcaccgttcctggatcataatcacccccttataaacaaggcatggactccccagcgacccccgtgggcttatctctgccacttctcagtctcgtgctccgcaatgaaccatgctatacaaaaagtaaagccgttgcccatgctggcttgtggttggcacggttaatgtttcacaaccgaaactcgtgaaccggtccttaattgttatgagcacgaccatcaaaaccatgtgctcacaacccaccattatcaagttttagttggcacattaattaattcacaatcacgattgaccatcgtgagctacaattaaatatccatcattaagtaatagtgaaacattatttatcccaatagtgtgctaatgtttctaagcatggctaagcaattatgtctaacatctagctgaaccaatatataaagctcaactagtcaaattatcacccaaggtataaagaatagagtaaggaatgcaaagtggtcataacaaaggaataggttcacaccacccggtgacattccaaaataaatgcacagttgaaataaatagagaattttaatataggatcaacatgctcaaaggaattgtgtttgggatctgtgtgacttgccttgcaataatcggtcttcaattagtcttcttgaacacttccgacgcactcatgaaccttcgcaacgacggaaacgacaagctatcacgcaaaacaaggaaaaagactaataaaaaccaaataaacaatacatataaagtaaacaaacatgtagatcatgattttagatgaatttagagacttgaacgacctcattccgatttcatatgaattaattacaaatttttacaagattaaattccaattaaacctattaaaggaaagactattccaaattaattaaacaatttacaaatgatttataactgagataaaagattaaaacaacctccggaaaagattagattatattcggtagatgacatatattaaaaagaaataatatgccactgaaaagagagaacggatttatatcaattttggacggctaagattaatcttgaccgagagttgaccaagatcggatggcttagattgatctggcaagcgagcctcatgagatatcgactcaacgagtcaattctacgtgacacgggatcacccaaatgatcaaccgaaaccggcgaatggaatcggcggctctgaaaggctctaaactaaaggacgactccacacggatgaatgaacgaaacacggggacacctcgttcgaacgaacgagcgaacgactccacaacggctgcgactaaaccggtgggctagacagggttcacggtaaagccccggtacggcaaacgataggccgataggaacctaggaatgcacctacggctagacaacttggctactgagcaacggctaaagcggcggctaggttaaagcggcacaaagctgcgacacggcggcactagggcgacttggtttggctaggcggctagcacaacggtggcgacaagcaacaatggcacaactggtagcgacggtgcacaaggtagccggcaaatgacgcggcagcggctgcgctagggttagagcaacagcagcggcgacatgaccgagggattgaaacctaacccgaggggtcacggatagaagactcaccaaaccaaagcggtcggagagagatagatgacgacggtgaaccggcggcaacacatggagaccacggcaacgctagatagacaacggattagattgaattaagaccctagggaaaaactcacaggtgaacggcatgggagcggcgattgccagcgaaccacggcacaataacgcaaacggagggcaccgggagcgagaggggatcaaagtgacccttaccaccacttacgcgacgacgaacggcaacgaaagatggccggcgacgagcttcgaagggcggcgaggtactgtccacggaggcgacgactttccggcgatatgcggcgacaatggaggggtggccgggcttcacttcgcagctgcgaatccaatggaggcagcggtgaagcttggcgatgacgggaggagcagcagggcttcgccggagatcaaaacgcgacggcgagcttcgggttgacggcgacaatggagctccggtggatttcggcttcggggagatggctgccgggcttcttctcactgctgcgatgccgacagtggatacggcgaggtctggcgaccacggagtcgacggcaaagcttcgccggagatcaaaacatggcaacggttcggccttcacggtgacggcgacttccggcggggttcggcgcaaaagaacaggtggccggggtagagctcttcactgcgaagccgagggaggtggcggcgctgaccggaaacggccggggcgacggcgaatggcggctggagcggcggccggaggtggagagagagggagagcgcggggagagcgattccggcgacggcggaagatgggacttgaggggataggtagaggacgactagggggtcctttatataggcacgggagctcgggatcaagcccacaatgacgggaaaaactcgggaaagtctagggttctcgccggaaaaaggaaggatttgatccgcgaaattggaaagaatttccatagaaaattttggggatttcttggggaaaaggaagagaagattgaggggatttcattcccgcaactaatttggaaagaggagcaacggggaggtcggattggtgggaggaggcggcggcactgtgcacgagcacggctggctcggctctgtctggaggaggaagatggagtactgtagcgccagggaggtaaatcagacttttttgccggctgagaggagaggagggaataggagggaatgggctgaattcggcccaagctgaggaggagaatttttattacttttccaaataaattaaccaatgagatgatctttcaattgttaaaaatactttcaatgctcaaataattccaagaaaaatcttgaacatacttggacactcaaagtatttaaaaatattaaaaccagaccatttaatgattaatttattaattaaataattactgaaatattctttgtattattaaaattaggaattgagctctgaaaaatccgagaaaatttcagagagtataattaatcatggagaatttaataaaaattaaatccaaccatgctttatatttaggaaattttatttcccacatttaacttcacttgtaaattaatgaacatttaatataaattcttttaataatttattaaattatttataaatcctgaaacgaaaatcaggctgtgacacatactatgtttacatatttatccgactttgttacttgaaatagataactcattattggttaatgaatatgtgattctttcatgagactctttatgttgtgtgttgctatttctaaaggatccctgatcaaatatcatatatagaataaatatgtttagatgatcagcacatgtattaattgatgatcatgtctcatgaatcatggtatagagataccaaattaataatatggacacatgttggtgaacatgttgttggatagacccaacatgagacactgcaagagccatatgtgttgtgtcatcagtgatctcatttagtgttggtattgaatccttagacctaagattatcatggttcccaacatgtgtagtagcttacttagggactgctaaacgttactccgtaattgggtagttataaaagtagttttcgggtatgctatgaaacatgtagtaggatatgaataatcaagatgagatttgcccctcctatggagagatatctctgggcccctcgatgttgtagattatggaagtgcatggccatgccaaaggtgattgagtagtcaatcacaagttatataatctatcaacaggttcgagtgaatgattgagctattagaggatggcacatatctagccttgagcttaatcgatatcgtgaggcaaaggggttcatataagtatacactagaggttcagccgatatgatctttgtgtatgcccggtaggtcaaaacgttctgctaggggccgctgttgacgcgtggaccgaaaaggagttttcgggttacagctgagtgtacatgaacctacagggtcgcacgcttaatgggccggaataagggcattggatggagattcaatatgagcttaattcggatagggatccgaataggagttctacgggccttggtggcccgggtgatggatcctatatattcgtgaggggtgtgaccggcggaggcattgcatcacgtgagaaaccctagccgtcacttccctccccgagcaaaaccctagccgcgcgcggatgctagcacatctgcgcgtggcgttccgtccctgtacgtgtggataccggtagaggcaccgctggtttgcggtgctaatcaacgtgggagtacggcgaggagaacgcatgaggaggagaaggtcgagccggtgcgatcgactacttcctctacatcgacgcgctctacttcgcgagaattctttcgacttctcagcgtcttcttccgctgcgcagcgcgtcgagtggtaacgatctatgatctaatacttgcatggttcctggtttacgcgatagaaaattttgatttatgttatcgtagcctatgcgtatcccaacaaaaccaagggacagttggcaaacaatagtttaatattgcaaaaatcaacaccattggattataattcagaatacacttaacaagtaggcaacagcttcaaactacagcagcaaaacaagtactctgttcctccaacatatggatggtgaccttgggtaaatgtcccagagattcaacacttcagcggatacatataagatatcttctactatttttttcttacaatatacaccacactttctaaattttaaagaattacactataaccataactcttatgcagcttgcaaggaagatttccagaagtaaaacatgtccaggtaaatattcgtgaagatccaaaaccagtaccagcaaatgaagtactccctccgtcccaaaaaaagcccatcccatactaggttgggtttttttttttgggacgaaaggagtacaacacaagataattgggatgtttgtccctttgaacagaaggtaaaacatctaaattcattaccacgtcactcctctctttgcaatcaacattttaaagtttaataaaccatctctactagtattcgttaactttcaggcacccagattccttcgtactgtgaccttgacaacattctcaacacaaatatagtggttcctctctttttgaaagtgcagccataattcagtgcgctacggttcagctttcggatgcaaggcacatccacaatgggtgtgtttggttgcctgcatttagcttggcttgcatatgtgtatgcaatttttggttgtttggttgcctagttgagtgtaaacactcgattcgagcttcacaactcagtttagcccactagatgcagcagcctgcatccatacatgcaaggttcgcacctgcgcatacaaggggcgagcaatgccacgatggggtcaatttgctctttcctcatttctccccctaaaacaaaaaaactagggtttggtgctcattgtcttcctcctctctttgccattgccggtgccagcttcctcgcctaccactgtcggccctccttcttgagctccggtgagctagatctggcaaccacgaggtcagatgaccgcacaaacaattgggctcctcatcatcgctgcctctccacttcttaccaccaagaggagaggacgaggaggaagacgccaccgtgagatctggcgacaacgagctcgctggccaaagatctggtggctccgagctcgtctccatcaatgtgattccatagaaaatagaacaaagtgtgttcaatcataactccattttattatatattcacctacctatacatcgaccattattaacaacatctatagataaacagttaattcatattgctcatgcaaaccactttcactttcactttcaagtgcaatttttcactttactttttcaaaaatattatgattgagtctatgttagttacattttctttcataaaaagagatactaatataactatatataatgcagatacaagatatgtgtcatgggaatcgacaactcagcttagcttgaatttgttctattttgtgatgttgcaaccaactcattaccaaacctagagaatcaatcaggctaatgtatcctcaacctgagcttttagatggcattttggtcctgatcttttggcctaatgccagtagttttgccggcaatggattggtccacgtggcataaggattttggctgccctctgcaacattgtgcgccctcccctgcatccgcctatgatccaccaacgagtgcctcactcacgaggagtcgagggtctggctcgtagagcaggtacaataatgtgatgttgaaagagagagaaaatgacattcatattgacaacaacatgctaattccaaccaaagaactccactgaaccaaggtttactctcctctgatgtgaaagattatgcactctaaaaatctgatcacactgttcttcccaataaagataagcatctagaacatcctttccagtaaactttggaacactcaactttacccgagcaacattatccaggtcatcatgatcatggcgaccacgatggtggcctccattgccaaggaccgcacctcggcgaggatgaacatgccgccgctacaaattgttctctgaaaaaaaatcatcattatatatcaccatattcctcctcatggtgatgatcatggggctcaaaacaaccgccaaagtgcgcacgggagccaaatcctcgcccgtgagcacctccttctcgtgctctagtacctccaccattggacggaccatggagtctgtcatcggcatcatcatcaaccgaatgtgcatccacaactcatcctcgggatcaacaagcggtggctgaaccaccccaccactggcagccggaaggcgtgcattcagcaaccgttccatcacttgaagaatattattccccatttgcaacacctcagcccatgtggcaggtgcatctggttcgtcatgattttcaccatggcaacttgattgagaacctgccatgttagctccaaaaatatatatagtggaataggtaaatttgtcttctagataagcttcctttaattgattaatgtccttaaccgaatccactaagaatctgactactggggactgattaatttcccttgcccaatttccggactctaaagccaatactaactctaggtcgatgatgacttcgggcttaccaaagtgttaacaaacggctagaccgctggcagctctagtacgaccgagctacctcattcagatcggtgtcagctctggcttgtctggaccgtcgagccatggcatccctgccggctccatgggtgcccggtcagaccaagctcagcctgatcatactgaccaagagcctccggtcagactgacacacaagccgcgatgaaaccggtatgtcccaatcggtcaaactagctacggtcccacaaaatgaaatagatttgaatcaaaccaaacaccctcatacatatgacctaatgtagcattttttatcatttcttcacctaggttaccacctctcttgataatacgtcaaagctagaagaaaacctaccaaatttgactgctcaataccttgattgataaaaaagaaaatttagatttatcacctttatctcattgctttgcatcatcaattttaattcgtggtagctgtccttcatatgcacattatgtggtactaactcaaaatatctcattcaaataaaatagttagttcataattagcatttgtcattaattaccaaaataaacgtcgtgggcttatatgctataagctagttaagtattgcatggtgaacttaatggtggcaagtggtatactagctagtggagggttgcatggtaaaactaatgctaatactacctccattccaaaataagtttaaatttcatccatcacacacataccaatacaaaagcaaaaaagactagaataccatcaaatgccaatgcaactattcatcactttatctactccgaatacatttattccctacttttacaaactcttactcttaaaatgaacttattttgggacaaatagatggagctaaaaatgaacttaatatgggatggaggaagtaggtgacaaggtagcatgctagttagagcattcccagcagcacatccaaatttcatcctccttatgcccatatggatgagcatccaaaaaagattcctcctttatatccatcccacttcaacagatcatccatatcgcaccctcctatattttagtaatatctttcaattaactttacatttgtatttttaagggctatattttgaatgactaaatttcaatggtgttatttaccgtgataatctttcgaatgagtaaattttaacgcatattttttaatgggtaattttattttctaccaatgctctgccctttcctctgttcaattccaacccatattcctctttttctctccttttctctatccttctctatcgttctgtactcttttttttttcctctcttctatcctgtccagactactccggaggcgtcgaccggcaggagcggatgtgcgcatgcggcggcagtgcggcgggaagccgtggaagcggcggcggaggctagcgggcgtggagccgagcaggtgacagcgccgaatgctcaggcgggcaggcaacgtaggcggccggtgggcgtataagtgaaggtggtggccgcggagaaaggaagtgacagcggtggccgacgggcgtggagccacacaggcgacgatggcggatgctgaggcagcgagcgcgcaggcggctggcagactcataagtggtggcttgtggcttgcgacggctcggcgttggcaacttgcggccggcatggcagcgacgacgacgacggagaggaggttgtgatggatgtccggatgggggcgggagctcgatccagatgcaggcgttcatatatggcgtgaggagagagaatcgctatatttggctaaaatatgctcgctttggcgcattgtgacatatttggcaggttagatgtcgtatctgttggaagcccattttcacctccagtatgccatattttgggtggaggaccggatggaggatctcctagggatgctcttagtgggctattgcattcaatttcttggaatggagtaaggcaataatgactatttttattgatcttaaggccaactcactttgctctatcttaacaactccacacatacaaaatatttccattaatatagtacatatggagaaaaagtaatcatcgacacccatgacggtgtcctcgtcgtattcggaattaatttttgaaagcacgtgtagagatttgaagttttacctacacttcagtcaccctttgaaacatagaatagaaaaactcatgaatagaagtaacatgtttttacaatcctatagaatttaaaaacacaggagaagtttgttaattgcaagcagtaaagattgatgttggtggctgttaaatgtcgattctatactgagccatcagaaactggaacatggactttgagggagcaggagaatggagaaaaatgaaaatcgctgaacttgaagaatggatagagaaggcttatcacaatgcgaagatatacaaagaaaggatgaagcactggcatgacaaaaggataaaaatcaagaaattcaagccaggagacaaagtgctaatgttcaactccagggttaagctttttggccacgaaaaattgcgcagtaaatgggaaggaccgttcgacgtcatcgacacctcttcgcacggggcaatcacactccgcgacaactcaggtaacatatttaaggtaaacggtcaacgcttaaagattttccttgaaccaaatgaaactttagatgaagaagtggatgttattgaattaatcgattatgaaccatgatgatctcatctagtgcatgcttaaaaccctgtatagttgtcatttctgcgcttagcttaggaattagtgggcctaggacgagaagtggaggcctgccagatccaccagggttcgttcggccgaaccagggcggcgcccgttcggccccattttcgaatagcaatctcccccgctcgtctatagtctgttgtgatgcgctttcggaggtggatcagtcgcatccaaccagagcacctgttcttcctcctccttcccactttgcaaacctcctctccatctcaacccgattcccttgctccatcacctccaattcaccaatggcaggcaaatcactgatcccattcattcgctcttcttccaattccacttacaatctcaccggagagccaacgccgacaaatcaattgattccggtagaagaatacacgatggagggggtaaatgatgtatgggctcaacccctcgcagctgtgccgggctcccctgcaaatctggagcccgacggcgagctccctggttcggccgaaccaggccctctcggccccgttcggccccccgttcggcagtgcgatccctctcccctcgccatgtcacaaggacaaaaatacggggggattcgcctgcgcgacggccgacaacgggagaactcggcttgttgaaggcgcgacgccttttccaagatgacgggaaggccgtgccgcctcccgccgagcgctatgtgggcaccctgttcaccaaggcaggggatgaggtgctccataagtatgtcatacccaccgctactccatccactccaatggaggagcgattccgcatccagggagtgcgaactcccggcggtgggtatggcaagggtttactccggccgttgacggcatcggagaaggaggggcagcggaatcccgtagccctccacctatgaaggtgaagcatcatttgacgccccctccaatagtaagggctcccgaccaatatcaagaagatgaggtgaagttgccagagccctcaatccataagctcgctgcgcaagtgaagaaactccgcaaggagaacatagagcttagggatcgcaacgcggagctaggggtagagcttgctgaaattagaaataatttcgatacccttagttgcggtttgtgcgctaagatcaagcgtgcattcgtagaaatgggaaaggaaaataagtattatgctaattagatgcttcctttcccatgaataaaatagtagtaggtgcttggttttatttttccaatcatgtaagcacttgctataaataatgtggctcattggtgttaaccccaatgttttccaaagtttgttttgtttcatgtttaataaaatttaggttttgaataagtgtgggggagatatcccagcctctgacgtgcatatgctctgaaaattgttgaatctctgaaacacctggaaggcactgaactctgtagaaaattgcagagggatcgggcatcaggttcggccgaaccaaagctggccccaatccctcccaattttcacaggtaagcaggtgagcacgtcttgtatctgtatatctctaccacggtatagtactagagctgaaaattcagaaaacaattggttcaagcataagtgaaagataaaatttccaactaatgaaattcttcatgtgattgatcttgtatattcattattctcagctgaacttgtgcttgtgaacaaccatccatgtttagggaaccttatgcatctaagtaattgctttatgtgagatgattcaagatgaagggaatccttgcaactcttgttatgactctttggaatttgttttcaaaataaaattgttttaaaagctcaatcctccaattgacttcatcttatacctaccaaggccatatgcaagtatatcattgatgaaccttgttatgcatatgactgcttgacattatattgagctttgtcgaatttatgagactcgtgttagatatctttcatattctcatgatcaaggggtcattaccatttccatctttttccacatatatataattaagctaagcttctacactggaagttggctttccaccgaaaaaattccatttaaataaactcctatattagactatgctttcttctcctggaaaagttcttggcaaaaagaaaaaaaatgggaggaaaggcatggctataaaaaagggggggggaggaaataaaagtttgctcccaaaacattgagcaatgttggaaagaaaatatagccatgccccttccatgatcatgccaagagaaccaaatggagaggaagtataggaaaaggggagaatcattttttttaattccaccattccacaaaagattttaccttttcattttccatccacaaataaagacccttgatctaggagtatgactgatgatcttcttgagtccatatttttggctttgcaatatatatgatgcaggtatgccccgatttatccctaccaagctccacatatcagccttagaatagggatgaattatggcacatttttccttggtaagaatccaaaaagaaaatatacatctgtgagaaacaagagggaaagtcaatatgaggaaaagagctggtttgtgaaaattcataaaaaaaatcccatgagtttgacggagaagcaagaaggattggaatcgagatcattccatttgtcaattacttaagatggtaagatagccactgataaagttcacaggtgcaggtatggttgtgaatgatttatatgcttgattcatatcttgaagaaattcattatgcactaacctttactcagggacgagcaaaggactaagtgtggggggttttgttggcggctgttaaatgccgattctataccgccaacatctgcataaagttcggataataaaatatccaacatagtgataggtgcttaatctcacatattccacagtgttggtgtatatttgtatgcaggtgataaactccgatgttgagaggaaatctagactaaagtgaggagaaatatgtatccatacaaggatgggttgtgaacttcgtagaaacaccagagaatcagcccaaaacacctaagaatggataaaggaggatcagaggaggagccaggccaaaggccaggccaggggggcccagcccaggttcggacgaaccctggtgatcaccattgatcccaggttttggcatggacgtcccagatcactccctgatggcggttgcggggcacttcggacattgccccttcgatcatcatacctacccctatataaggacatcatctcactcactttaacacacacttccaagcttgagctgaattataagaggctctattgtactatattatatactagaataggaagagagtagagtagaaggagtcggaagaaattcggagttgtcggtaatcttctcctattccttttattctgtttattactctgaattcaatataatattcttcttgagtaatttagatttattttgtgagaattatctcttggttagttcctaaatagcatacgggattattgttcactataatcaactaaaatatagtgattgctttggtgagttataaacactaaagtagatagtaattgcttagacgtggtgtttaggtaattgttatccagtaattgttgcatatcccacagtacgtttgaggtgggtgtagaggtggttacagccctcaagatcacttaagtccttcctgtccgggtacgtagtagagcgacatctgggaacagtgggttgccagtgcatgaagtatagcattaggattaaagttaagctttccctagacactgtttctcactagtaaatcctctctatcctggcatatcatttgcttggtgtccttggatgaaccggaggaagatctgaccacacacgttcccttatattcgatacccttggaatactccgtaggggaagtgctacatcggtatacccgtgcgcttgcggattttgtctgtgatcgtaaaaaataccaacaattgaaccaaaggaaaattttcaataggcttttatcttttacttatttttctatgaaattgacgataggatacaatcataaagaaaatctcatatatcttctttccataattaagagaaatcatttgctagccctcataattattaagcttgcctcgctgaaaaaactaaatctttatactgtgcatatctcaggacggtcatgttgaagctcgcatcactgaaaaatactttaaaagaagtcatctgtccaatagtgcctccattaactagcaaccacaccatcattgtgaaatggggagttactaggagtgatgttgtacacctggtcagcatcggcccacctgtcagtccccaccatgtggcgctatcccctcggccacctagctacctactactccctccgtctcataatataaggtcacatcccaccaaaatctgttacattatggatggaaccctatctagatttatagtgttaggatgtgtcaaccaaaattcttatattatgagacggagggagtagcaggcatgtcatggcagcaaattccgtttttctctcctttccttagcccggaaattcacaccaacgcccctacaaccctagcgcagcagggggagggccacctccaggtgggccctgcacccgcgcgacgtcagcgtagcgggtggcaattggccctgctctccgaaacggagattccccctgctacaagaatcgccacggtttccattccacccaccagcgagtacccacacacgtgacaggcacgcatgcgctctcggtctcggtctcggtctctgccccctcacgcgctctgcccccggcgccgcggccacgccatggctgccgccgcggactccggctccccccccttccctccctcccctctcgctctcttctctggtggcggagtccccggtcgggttattattatgcgctggttccggtttttttttcttttcttcgccatttctgcaggggcggaggaggggtggggggactttttggggggttggagattgtggtacattgcgttgttgggcgaggacttggccgtggccacgattcgtcgttcatgggggatgcttgggatttagggttttggtttgggtttcgagtggggatgaaattcctttcattttgagggggctttcttctccgttcgctattcgtcgcgtaaggcgcttttgtgtggttcgggcttttctcggtgataatatgtggatggtaatgttggctcgcgtccgttggtcgaaatctcctgtgatctttttttggatcgtgatgtcatgcattaagcacctgtacatgtacacctcgatttgagtagaacaaggtctgtattgtgcttggaaatggtcgggaagagtgatttcctagccgtgctcctcggaaacaaactatttatgacatttgagggcttttcctatgaggaagaagaagtgcttgttctactcctacctcatttgtttgcttgcttgcttgcttgcttgtttgtttgtttgagtgaactaggttctggattggagcttttttgctttgctttggagcctgcataatgtttctaaaacgctgactgcagaggatctcaatccagcggtggggggcacactgagagttatgtcgtgatttgagattctcatggcgtacaagggaggtgtttgttgagagaaaataaccattctaccatcatcgaaacggagattcgctaaaataccactccgcatttgggattcaccagaatgccgctctcaagtgtggggctttaaatgccattaacttccattttttagaactaaaaattgtttcgtcgcttctctcctatgtttaatgaccaaaatacccccgattgaatccatcaaaattcctcattcttctttcctactcgagcaggagcagcggcctgggagttaacttccatttttgagaactaaaaattgtttcgtcccttctctcctatgtttaatgaccaaaataccccagattgaatccatccaaattccccattcttctttcctactcgagtaggagcagcggtctgggagctagggttggccccgtgccaccttgccgttgccgctcctcttctcgcgggcgtccccgacccccgtccctacgcgccaccgccgctcctcttctcactccgccgccgtgccagtactcttcttctcgtgccaccctgttgctggcccacctctccactgccaccgtccctcccctcttgtcgctcgtcaactgctcccacgcgctcttcctagatgtgtgagctcccacttgattggattcaatcgggggtattttggtcagtaaacataggagggaaaggacaaaataatttgtagttctcaaaaatggaagttaatggcatttcggcgaagccccacacttgagtggcattgtggcgaatcccaaatgcggagtggcattttagtgaatccccgttttgatgatggtagaatggcaattttctcgtttgttgatggcacttgggaagtgggcgtttgcagatggtgcatataaagaggagtatatttcacaatactcttttagtttattatgccaaaccatggtgatttatgattaatgacatctatatactctaaactattcgaccctacgaatttcaattcatactaattttcttgtcatgttgagccatatcatcctgaatcatcatggttattggatagttgttctgtgtctgagatttgcaaccagatcagaccagccgctctattcacatatcgagctcttatgtgatacttgccttatgtgcttgttgatgttgtttcagtattgttcgctattatattatagaacatcctaaataactttctgttctaaaattaagagttgtgcattaagctgaccattcttcttgacatttgcacagtttcaatgttttgcagactgaggggctattcaagcatcatttggtttccttcccaaccaaaacctgttctttcatggacctaatctgttgttttctcttattataacttgataccccaaaccacaaccaacatctcctctgatttaatcaatctgctgtctttgtaggaatgtattaccgcaggcaaaggaaggcttcttctgaggccaacgccaatgtgtttatgcctgggggtccaaatggtatctcatttcctgcatcaaatagggctcatgattggggatatggcggtgttggcgaagaatgggaaactagttatgctcgcaaactccagttgatgaattttctttctgcactgcatcaacgcgctgcaaattctttggtaaccactagaatggatgcaaaaacagaaggacagctcagcaataatagttcttgattccgatgatgaggacgaatacacggaaggatgtgaacagctcacatctgagaacaataaagaacaggcaccatctggacccactagtccttacacgacatggattgtatccagcacgaaagaccaagtaaatggaaccttgcatgttgatggagtccaaagcactcaaattgttccatatggtcaaaatgcaccgttaataaatcagttccctttgcaaaccagctggcaaccatctatccaatatgaaagggttatattgcagaaaagacctgaggagcaacgcgttcaagatctggtggtatgtatctttcacttgaaatttttcaatggactatccacttcgacatattggtacttttactccattacatacctgcactgataaaccaatttattgcatcatgtcttgtgattgtattttgataaatctgaagagcattatgatatttcttgtctggaatgttagaatggaaatgtttgatgtttgttgaatctatactcttttgaagcttaaatatcccatatttgaactttaactcttgttgctcactgtaggcagcaagccatgcagagaagatagcagaaacacaagttctccttactcttcctactcttcctactgagagaaaacgaaggaaaacagaacccaccaccctggtagatgttgatggtggaactaacctaggaaaaagaaaaaggaaaaatcatcaaaatcaagcagcagttgattcaaacttggatttgcaacaaaatgatgttccttcacaaagctacaggactatgatagaagaggagaaacctgtaaaagaaagtgaaggtctcgaggatctttggaaagatttttcattggctgctgaatgtacaaaggtacaagttgtaatcacagatgttttttttttacttttattctgcagcattataaaattgttggttctttttccatctgactgctaattgtactcgtaaatacatgctataatctttattttttgtttcaagattgaataccactgtgcacaaagtaagtttcatggcaaagtgtattttataagataagatagagtttgaaaaggcattcatttgtcaaatcatttaaatatgtgtattatgacaaagttttgaagcatttcaattgattatttctatctgatttgtgtctttttccaataaagctcacgtaatattctttgtccagcttgatacaaatgaagacatgtccaatgaaaaagatgtggatgatgaaaatgagatggatgatgactgcaatcatgacattcggattcatgaagatctaggccacgtatgccgtatttgtggcatgattgttagaaaggctgaaacaataattgattatcagtggaaaaaggtgcgtaccatgtttaggacatgtgattcttcaaagttttcaaaactgtgatgtctatgattctagttttactttgaggaaattataagcagacaaccaactttgggaattgttttttcataaagaaactgcaagttaattatttacatgaaacccctcatgtcccatacagcgtcaacttttaaagccccaagcgttagatctggttatacttgacactacacaccaagagggtctagtatatgaatgttcgctattggacagtcacgcgaacggttccgacaaccttcgtcttactcgtacgtctaaccacgcctgcatgcaaatatctgttactaatacgtgttcacatgagagttgctctaagcctgccttttcaaagaccaagtccacctatgcttatgttatttgattttcctagaatcgtacacatgttcaacgtatgacgtatgtcaacagtaaatgttggttctgttaacagtgaaatttggtaatcggcaaaaacatcatcggcttagaatcattattggctgcagcatctcggaattagccgatgggagttatcaagtcaccaatagttggattcctgctatattcggttaaggaaatcaatctactaaagaaagcttatccctaagtgaccgagtttaaagaggatgcggcatggtagtttatctattaattaggaatagtttgttagtttccttttatctttaggaaagtgtgtttagtgtccgataaggacattatattttccttttatctttaggttagtttctttcttgtccgataaggacttatatcaacccctgggtataaatatgtacacccggggtctatgtaatctatcttcacaataaatacaattcggcgcatcgccacattttaccttttctactttattttattgtccggcgggacttggcacctgacgcggggttgcatcggtgttcgatctccagcgaaggggtaagtccaatgctccgccggtccaggcaattgtatcgtctacgtcggcgtcgttcaagactgcatcaggacattcgacctcttggattactctggtttggatgatatatttgcctacctatttatcatatgtctatgttaatctagtcctagcatctcaatttagctctatcggctgcttctcgttttagggtttctgccagtatcggctaaatcgcgttgctagattagattagcttagacatctaccaccctgaaaactcagtcaatggcttgattgtctagatattatgttttttttcatacttagtgctgcatcagttaagtttg

SEQ ID NO: 67665 - DNA, 11923 bp, Oryza sativa
ctgcaagcagttcatcacaaatgaatatctcggagaccgtgccaaagtccaaaaatgttcatattttgggacggagggatgcagtgcgaaggaaagggaacataaggaggacgcttttaaagaagtagagaaatatcatcatgtgattaatagcaggattttctagataagtttgtacggataacaaagaatagaaatttgaaaatgcccaattctacaagattattcttggtagatttcaccgagagaaaaaagaaatccaaaaaaaacatggcatgaatacatgcaggcgtgggtgtgtgttagatgagaagagaatatataacaaccaaaatgtggtatagtcggtgataccatctttagctagctactttctgtttagtttaggccattaggacggtggtccaaaatacatgtaggagtataaattgcagaaagaaaaggtaggtaggtaggtgtggccggccaggggccagcgccgccgcggcgcgtgctgccggccgccgccgcgccgtcaaccttttggacggacggacggacggcgcagctagcagctcacaaagattatctgcggtcaattggccctcctgccgtcccctgtactgcttctgctgatgtgatgaccacattttatgatcacagttgtgacttgtcatactttttaaataatatatttcatatgccatagatttatttttttaaactttttggctagcaatttatccaccacacttttgtggctgtcataatttatctaacgttagttgtggtaaagtgtggctggcaactaaacatgtaagttttcgtatgattaatcacattcctaaaaaaaatatgcaggtccagatgctaccatcgttgtgattcaaattatttgtgttttacatttgtatcttagatcattattttataagatatcattcaaagccagctcctaccattcgtacaacgtgcttatcggcaattttacaaaattataatggcattgttacaattttcccaataaactaaggcccggtttagatctcctgcaaattttgcatcctatcatatcgaatgtttggacatatacataaagtattaaatatagacgaaaaaaataactaattatacagattacgtgtaaattacgagacgaatcttttaagtctaattgcgccatgatttaggcttaataaattcgaattaaatttgaaaatatattgttcattcaattttttgttagaaatattcggtatgcaaaatcttttgcacaaatataccatcggtctcgcacaaccattgcgtgaaaataacgtggaaatgacattgcgaccggtatcgcgtagtgaaagtgcgagatcgcacagtctcgcgcggtctcgctcaagcaaactgcgataccgtgccttgccgatttaattagcgattaattatctgataacaatccggcccaggtggggttggccgaggctcgataacttaaggttgcccggatctcaacagttcataggcacacccactcggggaaatgtcccatctccctaaaagactagtccaatagggaaatggtggctctccccttttaaagtggcttcctcctgtcaagctaagcaaggtgggattattcagaggctcacatggtcgccgcccaacttttgcatctttgccagcgggtaatagtggatgatgtcctcatcattatcctgattagcgatcgctaatcaaatggaacccattggacagtgtcgttgattgcttcagcgagaccgttcggtctcgctcttccattccgcgagaccgtgcggtctcgcgctttcaccgtgtgataccattttcgcgcaacgaatgtgcgacactgacggtatatttttgcacaagtttttgtatcctgaatattcctgagaaaaaattgaatgaacagtatattttcaaatttaattctaataaattcatctcgcggtttacaggcggattctgtaatttgttttgttgttagactacgtttaatacttcaaatgtgtgtccgtatatccgatgtgacacgccaaaactttacacccatggatctaaacacggcctaaactaaacatttgattggggaagacaaaacaagttccttttttttgacaaaaataaatccgtgcggtattatttgaccgcacgggataatcgattatcccatgcggtccacttaacccgaccgtacgggaaaatgattatcctgcgcggttgggccgcccgcacacgaaaatattcatttttccagacacctgggtccatacggggaaaacctccgcacggaaaaatcaatttgaccacacagaaatatagtttatgtagtagtgtggttatattaatcagctatcgttgcatcggagtttgtggaaatagagaataaatgtatttggaggacataaagagaaataattgcattgaaatttgataaaatatggatattttagttcttttttatgtgttgatatgtgtgcgatggatgaaaaataaatatatttttatggcccctttgaatcaaacgatttttggagaaattttataggtatttgaccctttcatacaaaggattagagctttttaaatcatatgaaattccatggaatgactcattgcacatagattttgaaaaaacacttagcaagaactcaaaactcttagaaaattttctttgattttatctctctcatcagattcctttgttttttatgtgattcaatcaaacagtcacttatgtatgttttacattttcattcctatcgtaatccagtattttttttctattctttttttttctttttgcgattcaaaggagaccttagggcatgttgatccaaccctaaaattttacgccctgtcacatcaaacatttaaacacctacatgaagtattaaatataggcttagaaagaactaattgcatagattgggactacttggcgagacgaatcttttaagcataattgctccatgatttgataatgtagtgctacagtaaactatggtaatgacggattaattaggattaataaactggtctcgcagtttactagtggatactataattagttttttattagtatctaaacaccctatatgacaccatatataataattgatgtaacactaaaattttacacgtagacacccctttagcatactacaaatcggtagaacaacacgtgagctgagtagtacgagtaatcgagatcaggttgtgatgtgaccgaccaaacaggacgacgtgtatactgttgcagtagtacattgcattggaggcagattaacttgtccacgtggcgaccggctggcaaaatttgggctttcttggcagaggagaggagcagtagcagctttgcaaattgccattgtctcgtgttgctcctctctgcagctggttcagttggtgctgtgtgcctgtgcaaaatgaaaatgcagacgagacgacttcaccaacgcgagaacgaaaatgcagacgactccaatccaccaacaagacaacggtttctatgaaatcgtagcgtttttgcctgtatttctattccctctacttctctactgacaatgttggatttgatattaaaacatcgattttgctatatctcactcgaaagattttttcttatctctcactcgattttctcactcaaatttacagtgtgttttcttgtaagttacaatataatttatgaaatttgcacggtaacttttgtaagttacagtgtaatttttgaatcttcgcatataagttttgaaatttatattggatttggtctttttttttctgaagatatggtaatatagtatccattatggtgtttcttagttgttttttgcatttttactgtgtctattggattttaatctaaggattaaaaatctgtgtgatatgattataaaaatctttcaaaagatacatagacactcccttaaaacatgccattctaattttctcggttataaatatacgctacacctgttgggccgtgcagcccacttgagtaagcctgggccgatggcaccatcgttcgttggaataagttcatctgacgtcctttaacttgtcaacaaatccgattttcaccttcaagatacgattggtccctcaattgtcaaaaccggtgtaatatagatctcaaggtggtttggatgacggttttaattgacgtgacacctaagtggctaatttgactcggtcttcatctgacatggcatatgaagcaaaaatttaacaattttaaaaaataaaacaaaatatatagacctacatgtcagtcaaataataagattaaaaaataatggaacccacatgttagtggcccccacttcctccacctcatcctttccccctctcttcctcttctaggcttccatcctccatccttcggtgctcccacagcgacgacatcccacgacagcggcgtcgaagtgggtgaccgttggccacctatggcttgcgggctcaagaacgtcagcggtggtaagaggaatagggagaggaggacggcgagcgcactgagcggtggaagaggaggggtgtgcagcagtcggcgggagtgaagcggatgctttccttttcctctagatctccgccccctctgctccggctccaccgccgtcgaccaacgcttatgcgcggaggaggaccgaccgcccgcgctgtcccttgctcctgcctcatctcccatagcctccatcctcaccacgcggaggaaatacggaggcggtcacctgcttcgacaacgacgccgcaagcgatgggcccccgccgactacttgtgcgactcctgggccagctgcgtgagctgtgccttagctttcactacaccacaagcacatgctctgataactaccacagaggccgcggacaacaacccagtcgctttccttcttaccccgttctcctcctgcacccaatagatctgccaggtcactaggagtgtagtgtggtagccctagaggcatgacgtccgatggaagagaagaggggcggtggccataggggagaagggcggcgaccggcgggaaggagctaagcaacggccgcgacgtcaccgagttcgaccgccgcagggaagtctagggacctccgctcctacatcgccgtcgtgcctcctaagctcccaccgtgggtaggctaagcactgaacccacagcaagtcagcaaccacgcggatttgggtcccctcccgatgatgatggatccgatagccagtcaccgctagatcccctcccgccgcgtctcctcctgctgttgctagtcgttgagttctccttttcgaaggccgacatgaccattccctccctctacatagttgcttccttcgccccgtaggcggtggtctccattacgatggaagaggagcaagccggcggcgacctcgtctccctttgagcggcgccagtgaagccgcccgcctccgttctccctctccgcgtgtgctcaccggtcgacgaggaagctcgaggagagaggaaggatggctgggaggaggcaccgacactgccgtccgtggaggcgatgagccggtgacaggagaggacggtgggatccactgatacgtgggtccacctatttcttttatcttttatctaactgatatgtaggccctacatgttttttaatttttaatttttatatgttgcttttagtgcctcatcactaccacagagaacaaggacaaattagccacatatagacctcgtttgctttgtaagttggaggactagttgtatctggtttttgggtggaaggacgaaaatctaggcaacaaattggacgaccacaagtgaacttattcctttcaattttaagttctatggttacaaagcccatctgcaaactgtgcaatttgactgatagaaactcatttgccatcaacacaggacacaaggtagcattcggcaacccaggttaacagaccttgatttctccatatcattacagctcacagcaagaaatacgatgtcaaaaagagccgaataattcacttaatcaatgaccacaacaaaaggcccgagtgaagaacaagaccaataaaccttgtgccagcgaactaagagcaggaaagctgattaagagccaatttatagggacactgagatggtatgttgatcaaagccaagtcacagtaaacgcagcaatgtaatgtaacaggggggcatatgtcaaaatgctcaaaaaacttttttttctagcagatcaatccatattctgcgaatagcgacaaggagatgcgctaaggggtacaaaaattgatagtgggcggagaacttaaggcagctaaggtggtatgtcaattcaacaccattgcttacttcttcttgcctgcatctccagcctttgtctgcaaaatcgacacaagcaagcagtttagttacatgtagttagcaatgcggtttataactcttataataatagaacttggcggtcaggtaagtatatagaccttcttcacaccacggatcttctttgctctgttcttcctctccttcatctgcttgcgagacttctcaaccttggtggcgaggccattctgtaggtatggcagcaaaaagaaaatgagaaagacaaaatacataaaacatgggctttcatagtgtttcacgagttaaattgatatgcatcatggaaaagttgaattccaaaacccatgaaagtaattaataggtacacctgccacctgaagctttaggcaatgaaactcattaagtttggcagcatgcagtaatgcataaggctagtgaaacagctcggaatcaagcactacatgcaacagtatattatgcatgtcaaaagatgagtattcaagcatgatttaaccaatttttcatgttataagttctgtaatcatcatgcagattagtagaaaccaccacatattgcagtaattcctagaataagatgggaagtcaaacccacaccaagcttcagcagtacatgttttacacactacccaatacaatcgcgctaacattctgaacataaaagtcatagtttgctaacaaaggcaacgatgctagtaaaatacatcatttatacgcataagaatgtgattcattacttccaaaccacattttacaagaaatggtgctctactgatcaacataaaaaaaaacaccgatcaacaagaaccaacaatactatatttttcaaaatggtaatcccaagtgaaatttactcctttttcccatcagacaactactctagtagtactagattgttcagatttcagcatagcatcacgattaaactaaactatcaagagcagggcgagatcaacgagacaagagaggcgcgtaccctgatgagcctgtacttgggctcgtacttcttggcggcgtcgaggttgtcgtagatgagtccgaatccggtggacttgcctcctccgaagtgggtgcggaacttgaacacgaagatgcagttggagtccttcacctcgtacagcttcgccagcttctccttcagatccgcctgcacacacgcacacgcacacgcacgcatgagcctcacgccggcggcgggaaaccctagcccggacggtcaccggaggaggaggaggacgcgacgcaccttggagacgttggcgcggcccgggtggagcacctcgagcacgaactgcttgcgggagaggaggcggttcgtcatgaacttgcgggtgcggagcgtcaccgccggcgccgtcttcgtgtcggccatgcttgcgtcggtggtgtcctcgccggagattcctcgctgcggcggcggcggcggcggcggcgagagaggagcggcgagcggtggcggcggcgagggagacgcgggttggggtggtgggggcttatatataccaccccgaacaaaccctaggtctggcttgggccgcttggtagaatgggaatattgggccgattataatgggcctgaagagacacataggcccttttgttattgggcctctcagctaccggtccgatcatatctaccagtcaaacctggcacgtgcagatgagcacagcatagtatacagctactgagctacctaaccaaatttccttttttttagaagtaacctaatttcttgcacatcacatgtagcagtagctagtagggccgagtttagttctaaatttttttcaacaaactttcaatttcttcatcacatcaaaacttttttacgcacacaaacttttaactttttcgtcacatcgttccaattctaatcaaacttttaattttggcgttaactgaacacattctacctagcttgctctaaactgaagtgaagcgtaactcaggtatatatagctgctgctgctacttgaacattagctaaatccgattgatcatttcagtggcttaatttagtatatggttttagttagtagaaaattaagcgaaatcgcgatcgatgtgcccggcggtgacgggggcgacgctgttcgcggtgggggtgatgctgtgcccgttcccggcgctggtgccgtcgtgccggaacctcaccgccgtgctgccggagctatgggacctcctcgccgccgtctacttccacatccgcgacgagctccaccagctgctcgtccgccgatcgccgccgcacgacgacggatgatatacatgatgatttgatccatgacaaattcgagatcgatcgattcttccatatgcatatgttagatatattcgcgctaattaagttccctttttccttcgaattgatcgtgtgggtcatgcatgtgtgtgtgtgataaatagctcactcttgggtccttggatccggattgattgatgttttgaatttcttgtggagaaattggtaagctagctaacttgtttttggctagcttgtttggatgaataatatatactccctccgtattttaatgtatgacgccgttgacttttcgaccaacgtttgaccatttgttttattcgaaatttttatgcaaatatgaaaatatttatgtcatgcttaaagaacatttgatgacgaatcaagtcataataaaataaatgataattacataaattttctgaataagacgaatggtcaaatgttggacaaaaaaatcaacggcgtcatatattaaaatatggagatagtatttgattgggttatgtatgatgatcatctcactcgtaccgttggtcacgcgagtgcacgagtgcagctaccaatactgcaggttttgtttcattaattgttgaatgcttttacgtcctgattgtttcagcttaagattattataatctatattattaaattagattactttaagctgaattataataagctaatataaaataagctgcgagttgtttgtttctccggattattgaaggcatctaagggtagtgcgtcattaaccaccaataatatgaaaaaagcttctccaaaggagattattagattatagtaatctggcttacaaattataataatctatcataataatctacttgtttgtttcagcttactcataataatttagattataataattttaaactgaatcaaataggaccttagccttggttgcatctatctattgagtgattgagttatctggatcatatgatatgctatttggttagtttccgatggatgcggataaaaatatggatatccaaactttgttgctacactgctatccacagaacacaaaatgtacatcatcccgcttgtaggcctagttctatagcaaactttctcattttcttaaagagaaattgtatggttcttgaaaaaaatatctcaagataactaaattttacatttatattgttggtaccttgagataataaattttacagtagaaaatctatacctccgttaccttctgaagaaatagtaaaattacccttctttaatggtgctttagcctacaacactagcgcatgctgttaatattatttcaacttgcaaatagcaatctaaattaataggcatgtatttatgtcgcttcgttaatttcacatgtatttatacttgttatatcgatcgtatgtgttgaattcaatcggcatcatttagcctattatctaatggtttatttgaaattagctaggttttcatgtttcaagaaatatttatttccatacttgtgtccaatattaaatatttatttgtattcaaataatatgtatttatttcagttattcatattcatttttgtctttaattaaaaatataagggttaattagatccacgccgctgtaactttttttttataaaatgcaattactatttgtctatttggagacatgtcattacaatttgaccgaaattacagatataccactatgtacatcttcaatgcaattataaaatatttggatcgaaattacagatatgccactgaaaatatgtcgattcagataaataccactgtaattcgtcgattcagataaattcatcttcttcctccatcttctccctccctttttttctcatctctctccaccacctcaacggaggggactaggtgggcatggccgccatggcgaggtccagggccccctcgttgtcgacatggactaggcggtgctgccatcatgtggtcacggcttggcggcctggatccgcacccctgtggccgcggcggcggcatagccaggcccagcaggtgatcccgagcagcagcgacgctagcaaaggtgcccccggtgagccctagcattgacaatagtgaccctagccgcggcaacgctagcgacgacgccggcgaagtccctgcattgcccgctgaggagacggccgccacacgtccagatctgctcctccccacgccaccagacgtaccgccgctccttgaccgcttgttattccgccagccgccaccgctgggaacattccgtggcgagatatgagaaaaaaacgaagagggggaaaatggaggaagaagatgaatctgacatgtgggtcccacgtgcagatgaggaagaagatggagatggatggaaaaagtgacggcattggcatgattccaattttgtaaaatttcaatggcacgactatgaataaacgaattgttatggcatttatctgaatcgacatatttacaatgtcatggattcaattaaccctaacaagaattggagctttttgcaacgatttgtgctgcggcaccatggacgaatggatgatgagtggagaacagagggagcgtccgtccggtaggctggatgggaatcgccggatcggaccagtgtaagagatgacagagattagtgagtggaaggaggaagaaggggtgaataaggaaggaggaggggtaatctggtccaattctgttttataattgcattgaagggatatgaagtgtacttgtatattttcaattttgaccaaattacaatgacatggctctaaatagacgaatagtacgtaacggtatttttttaaaatcgaaggagttataatagcttgatccaattacccagaatataaaaacaaatacggagcgagcattattcatttgtatccacactgttttaataggcttctggggaaacaaaaacttgccaggtctgctggaaagtgttgtgtattatgtaaagtttttttttcttttttttacaagtagtgttatgtgaagttcaaaatcccagcccacacgagccgagattgaggcccatgaagacacggcctgaaggtgacttgctcagattgttaggccctaaagtcagccaataggcagttggatgctgttatacttcataagtaggaaaaagtacaccgaaggtctcatccccacctgcaaaaccagatatctgatgtcttttaactaatcaaaaccggtcacaataggttctttggtggttttgaccccggatttatcctacatggaggatgagtcagcgtgggatccacatgagccacacatgtcaggatgccacgtcatctttctcccttcctcctactcctccttcccctactctttctctcac

SEQ ID NO: 67666 - DNA, 30270 bp, Oryza sativa
tatttttcggtgatggtgggccggaaccttgggggccaacggacgttccgaaggctcgccacaaaggctcgatagccggcaccgccaaccggggacacgggggccggcccccgtgcccggaccgaagtggcgctccggacgaggaagcgccctccgttgcgtgggcggcgcgacgagcgtcgcgccggcgctcgatatcgaggcgggcatccggccccccacgcacatcttcttgggtcggaggcgttgacgagggaatggcggacgaacggcgggtaacggccgccgctcgccgcgccctccgcctcgacgacatggagccggcggcggcagcgccagaggcctcggtggcggaggaccgcccgccggcgcctaggcgttgctgcgccgtcatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtctcgccgtcctcccccgtcgcccgcgagtggcgaagtcgcggaacctccgaccttcctgagcgcctccccccgcccaagatttcggcgagagggggatggtggggtgcgagcccgacggcgcgggttctgctccccgtcgtcaccgctagcgttcggagagaggctgtgcgccactgcccgttcggccattgggctgagcgggcgaagcttggcgcacacgaaagaggacgagggcttcgaaagacacgcgcgccccctacctggcgcgccagatgacggagcttggggctcctcaccgggagaccgcgcaggcccccctttgccggttcggccgggggcgctaagtgaggttcttcgccctcgatctgaggaacgtccgcgagagagggagtgcacaagacacgggcgacgtagacaggttcgggccgctgagaagcgtaacaccctactcctgtgttctggtggatctgtgtgtgaaggaatacagagagccggagagcgagagagagttcaggctctagaaccccctcgccagagtcccaacccccctcttcctaggcctgggcctcctttttatctggtcaggggtcaccacatggggctctagctgcctaagaagggaaacatgctttttacaaagagggctagtctacagccggaagtgacctctgacaagcagagcacacgcctcctgcctcgctcgcccgcttttccggtggacgcccatttcaaccttcatttaatggccagcgacttccttgccatacttgcgctgaagtctggaatggatctgactaggactgacataccaactccaggagttagcacgccggctccggctagggacgagagccaggtagctctcatcattccgatgggacggggcgaggcgtgtgacaggccgcctgttgccacctaacccgcgatctgaccggtctgtcaccgcgaccggtcacggaccggataagcgctcgctgcgccgcattaaatgcggcgtggcgcgctcgtccaacctgctataaatgcggttaggtgagcccgctgtgcttacctaacccacatacgtggcgccaaaaccacagggggtcagggcgccccagccctcggggccgaaacgggagcggcccgacccctcggggagacagagggaggggtggccacgtcaccctcgggcccgacccccccagggggtcaggccacgtgggtgaccgcggctacccaagcctctagtcacgatacccccggccccatatcaccgacacatgctatacaacatttaattcatctctacaattaactatccataaaccataatccgtcgaatcctccattaaaaaaaaaccacacgctttagacccgatgctctcatgtcatcacttgtggtatatgtccgtgttactatatccatcagctagttgcgcaaaaacatatataccggatgagatactcctttccaaaagggcagagctttttgctcactctctctcctctctctctctctctcttccctgtgtgcttttctgttcggatcatatcccaacagaaaacgacgctgccaagtgccaacccaagtagggagatattaaaccaacatattttatataatagattatctataaggctggctataattttcttctcctatccatatctctcacttataaattaattgtatttgtcttggaacttgtgataagctagctcttgcataagagccaacatctttgatttttcattacctctctcctccacataagtttatagtaagcttatagctcactattatacttgctctaactaaagccactgacatgtgagaccgataatcgctggacccatatatcagtaacaaaagacacggtgtagtaaaatatcgaccgatattaaagctttgccatggcatactggcgaaatgggcccatccatgccgtgccatgcatgctacagggcacccccaacctgactttccccctgtcacgtaccctgtacgtacttgcctgcaccatgtacgtaccaccatgtgatactctctacgtacgcatgtgtttaaatccagagtttggatctaaacttcagtccattaccatcacatcaacctgtcatatacacaacttttcagtcacatcatctctaattttaaccaaaattcaaattttgcggtgaactaaacacagccgtactacactggaccgccctatagcatcaatgcctgcaaagtactctactagcgctgtggtattatacatcactgtgttttgtgttgtgcagtagacatgtttgtccatacttccttttatgttctgaggaaaatatactctcgtcgttgtagaaagttgttttgggttcgtgataagttacatttcttcaagtttgactaatttttatataaaatataataacgtttacaatgttagattggtttagttatatctatcatttgtatgtatttttatgagtaaagtatacagactgttcttaaacttatagggtgtgtcattttggttcctaaactctcaaaatacatatccaaagtcccaaaacttatcaaaatatgttatttaggtctcaaatcgccacaacctcttcagaattttacgtggggctccccacatggatgtggcgtggtatcatcttgactgaaaaataggacccacttattttttttcttttttcttcttttccttttccttctcttttttttccttttctgttcctttctctgtgacctgagtaccccatgcggcggtagcctatttttagtgagaggaaggagaagaaatgaaaaaaataagagaaggagaagaaaaataattttttttaagtaggtcccatttttaagtcaagattatgctacatcacattcgtgtggtatgccatatcagcgccatgtagaattctagacctatatgacactttaacaagttttgagatctagatttacatttaagagattggggacctagatgacactctaaggactgctcatgcactttactctatttttctagaaatgtcggcaccttctttgtgatcctggtcgaatttgaggagtttttggcttaaaacaaatccaaaacgacttataaacttgacaagtttagatatttgttacaaacgacttatattaacgacaaatctagacaatcttttatctaaaacctaagctctaaccatttgcccagattagttatattagagcaagtttaatagtatagcccactactagctccaatttatctatagccaatctaatagctaattcatacaatagttgtttactatactattaatatatggtctcacctgtcatacacatactgtgtcttggagtccgtgctacagctggctacagatctgtagactgcttctcttatctctcatcttttatctcattaaaatatgtttatagctgactaatagtctgctattgtacctgcttttaggaggggttatatttggttgagtatttttcgggacggatggagtacactgcaatatagctgtagaatattcataaaattttctctaaaaaatactcctcgtgaaatgattgttcattagtcttaagtatactcctaggtcaaaaaaaattgccaagtgaggtcttaataaaagaaagggagaaaggcgtttgcactgcatgcagcaactgcagcagtagtggtagttaattaattaattaattaataatggcgatcgacagctcagctcggaagacgatgcccacccctctctccgaggccgaggccgcacgaatcttgaagcgcctagccgttcgccgcgcgtgccgcgggcggcggaggcggtggccacgtaagcgcccgccccacgcatgcagccgtcggattccgattccttttgccgcttttcccgtctgcccccctcgttctccgtcgcctttaaacctagagtaatcaatcaattgatttattggtaattcacgattaattaattgttttctttctccatcaaccccaattaggttataaattatgcttatataccctaatgtataaagtattcttttattctagtactttatactagcactattactccatactattgtactccctccattccaaattgactacatatagttttttttaaggttattcctaaatgatctacatatttgtgcttatttattaagtctattcgttacttgtgcattggagtaaatagacattgatgcatgcatccatgcacacaagtatttataacacacatgcaatatcttgatttgctattggctaggaaatagtggggatggtgtttgagtttgtttctagaataaatatagtatgagagagttattagcttttcttggtcttggtgtacctatgaaatatgtagatcaatttgaaatggagggagtactatagtagatgtagatccactggattatgatttgtgaggaagattatgacggtgtgtatagtatagtattggtgttagctgaatgcaccctttacaaaatggcatattgtttgtttcggtcttagatacatgtcattttaattatcaatgtcatctgccaaatacaattcttttcatgtgttttattttactataatcacactacaggcatatttgtgacaaaaaaaagaatgggaattatgtggtagtatgtatcactttatcatgtatatgtatgtcgaggagcttagctaagcgaagactacatttaatattgattagcggatctaattacacacaaacggttggttcaactaaccctacaacttgttacgtgcgatcctataagcctttgtttatattgtacgtaaactatacaaaaatgacctaaaaataactcaattgaaatatgaatcaacgcgacaaaaatctacaagatgtttggtacagttgaactccagctgtgtgacacttacaactacaataccaagagatcgaaatatacaactttggttgtacagcgctaccggctatacccatagcccaaccacatgtcagacctcatccaaccctagatccaccgcaactcgatattatcacacttctcaacctactcttattatcatactacaagcttgttagcttggttacaatgtatgctaatttgaagctctgaactatgaacacgaactataccactattactattttgcccaacaaaccccaagtagagccgcctaaccaacaaccaacctcgttgaccgctagagccgctaatcactctggagtcgggacccatcaccgaatacgcgagaacccgaggaccaaaccgcaaaagcctcacctcaccctaggctttgatatgcgtgcggacgcctaaggctaggagttaacctcgcgtagagagagagagagagagagagagataactagcagagcactcgcggaggcgaggagagagagagagagagagagaggttggaagaggaggggagagtccacgtgagtgagaggaggaggaggaggaggagatccctctcccgcgcgcatccgcccctctcgccgatccccaattcgccatggatccaccctacgcaggtcggtcagcgccgcccccgcatccgcggttttcgccttgttttttttttttgttgttgttgttgcgtgtgtgtggtggtggtgatggctcaggtctcgcggcggcgtcggggggagctcgatctgtttgttccggcgacgaatccgctgttccggcggtgtaattgcgggcttggtggtggaggaggaggaatttgtgggcgtggattttagggtgggaggcggtttttttttttttggggggggggtggtgtagtgttcgtcgagatttagactttttgtgtggatggatggatgggttagattatgcgcgcgtggattagattgcggcggtagagggtttgtactgttcattgattggtttgttgggttgatttggagctgtagctgatgcgtggtagaggggtggaggtggaagcgcgttggggagggtggatggcgatgccgctggtgtcagattcgccgctgcatgcggtgatgggtactcacattgcgccccctctctaccgggggaggtggcagcggagtggttcctgcggctttacgtcgttttcgtgggatttacgtccgcgggcgttggtagcagcagcctatcctcttttgggacgggaaaataatatggcgttaggctgtttgaggcctcctgttcgtgcgttgggtgttgcattggtgctgatttggtgggatcacggctgccgaaggcgggtttgtttgctgttagttgatggtaaggattggctgatacgtcgattatatcttctagaggagctgcgtctacttgcatgtcaaggttaccacgtttaggggttatatgattgatgatagtttctttgtttagtggtccaaaattagaaagactcatttctttttagttttctcgtttcccttagacagtctgtagagagttgactttctgcggctcgtgccagcttcgatagctctagttaacattgcgccttgtggtatcacaactgtgctttgtagttcacatttagtcctatacaatatggtacatgttgatgagcctttaattcttagattattgaccgaatcatcttttttttccgaggttaagacttattctgttgcaatgtgctataattataatttgacttctactccagtaagacagtgtgctactcacattaatttgattcagcatgtcgagaatttaatttcctttggaacgtcattcattgagtttttccttgcacgctaagttactcagtaccgtctcatagttgttctgaagaagagaaagaatgatgccttcaaaatatgtattcttctactggatctaatgaactttaaacctttccattctggactgtaaatatgaatgaacgtctaaatttccttcgttgtttgcttcttgtccgactggattttgtaactatttctgactttatcaaattgataataatagtttccagtgttctcttgtttaggagtacctattgatcctgctaaatgccgattgatgagtgtggatgaaaagcgggaacttgtccgtgaattatcgaagcggccagaaagtgctcctgacaaactgcagtcttggagtcgccgtgaaattgtagagattctttgtgctgatttaggaagggaaaggaagtacactggattatcgaagcagagaatgttggaatatctcttcagagttgtgactggcaaatcatctggtggtggcgttgtggagcatgtgcaagagaaggagcctacccctgaacccaacacagccaaccatcagtcccctgcgaaacggcagcgaaagagtgacaacccatcacgactaccaattgttgcaagcagtccaactacagaaatacccaggccagcaagtaatgctcgcttctgccacaatttagcttgcagagcgactcttaatccagaagataaattttgcagacgctgttcatgctgtatttgtttcaagtacgatgacaataaggatcctagcctctggttattctgtagttcagatcaacccttgcagaaagattcttgtgtattttcgtgccatcttgaatgtgctcttaaggatggaagaactggcatcatgcagagtgggcagtgcaagaaacttgatggtggttattactgcactcgctgtcggaaacagaatgatctgcttgggtattctccctaaacaactttattatttgcacagttttttttcctgttctgtaactatacgaaattatgttttaattattcctatgcctccagtttttactgccttaagtaatgttaccattatttattgcaacgataactactagaaatatgttagtttgacttttgtgagagttagctttgataatttgcatgcattcttgctttccagccactttgattaccttactgattctgtttttaggattcttcggtgaagatccttgtagtgtcatcatcattggtccaatcatatgatgcatatttctcaattgtgtcttaagaagtgggttggctgcttttgcccttcagcttcatgctttgagcttgtggtctgtgtgcttacttctgcattaagctgaattagtgttggattcttccttctccatctggagtaaatttgtttgctgggataaccctattttcataggttgcgagctgcgaaaacaggctttcgactgcattttggtgtctttgtgttgcattccatagggttcttgtagttcaagtttcagggtatgaaccaagttactaagccagtaaaacttggtgaggcactgaggccaggtggattcaatattttcaaggatgaatagatcatggagaaatgcttagactagtatatgcaaggagtctctaatttgtctgtgcatgtttataagccatttgagtaacctgggaaataggattcattttgaagttttgaactacaagacaagtgattaattgtctttctcaaaagaatctgcttggctattagtatcttgtagtagtaagttttgaaccagttatatgttatttagagttcaagattctttggccagtccagcacaatgcacttaagtaattcaatcaagtttactggcccattttccaaaactatgctcctttcaagagtttggatattgaaacagtaaattagcttgccgagcaatacttgactgtttaatgccttgttcaggtcctggaagaaacaactggtgatagctaaagatgctcgccggttggatgtattgtgtcatcggatttttttgagtcataagattcttgtctccacggagaagtacttggttttgcatgaaattgttgacacagcgatgaagaaactggaggctgaggttggtcctatatctggagttgcaaatatgggtcgtggaattgtgagccggcttgctgttggtgctgaagttcagaaactttgtgctcgagcaatagaaaccatggagtctctgttttgtggatctccttctaacttgcaatttcaacgtaagtttccacgtgcttcacgttagaccacatacatacaaatagtgttgaattctcatgcatatgtgcattttcaggttcacggatgataccatcaaacttcgtaaagtttgaagctataacccaaacatctgtcactgtagttttggatttgggtcctatacttgctcaagatgtaacatgctttaatgtatggcacagagtggcagccacaggctcgttctcatcaagtccaactggcatcatacttgcaccattaaaaacgttagtggtcactcaacttgtgccagctacaagctatatattcaaggtagttgccttcagtaactacaaggagtttggatcgtgggaagccaaaatgaagacaagctgtcagaaggaagttgatctgaagggtttgatgccaggtgggtctgggctagaccaaaacaatgggagcccaaaggcaaacagtggtggtcagtctgatccttcttcagaaggtgtggactcaaataataacactgcggtgtatgctgatctcaataaatcaccagaaagtgattttgaatattgtgaaaatcctgagatacttgattcagacaaagcaagtcatcaccccaatgaacctacaaacaactcacagagtatgccgatggtcgtagctagggttacggaggtatctggattggaggaagctcctggactctcagcatcagctttggacgaggagcccaattcagcagttcaaacacaattacttagagaatcctcaaattcaatggagcagaaccagagaagcgaagttcctggatcacaggatgcatcaaatgctcctgctggaaagaggtggtgattgttccacctcgatattctggctctattccaccaactgcacctagatatatggaaaatggtaaggatatcagtgggaggagcttgaaagcaaaacctggtgataacatccttcaaaatggctcttccaagcctgaaagggaaccagggaattcttcaaataaaagaacatcaggtaaatgtgaggaaatcggccacaaggatggatgcccagaagcatcttatgagtactgtgttaaggtggtcaggtggctggaatgtgagggttacattgagaccaacttcagagtgaagtttctgacttggtatagccttcgtgctacccctcatgacaggaagatagtcagcgtctacgtaaacactcttattgatgatcctgttagcctttctggccagcttgctgacactttctctgaggccatctacagcaaaaggccaccttctgttcgctccggtttctgcatggaactttggcattaaagagaggggagctcgtaccgttctctttgtaggggagcatattttggtcccattctttcgtagcagatcgttgcattgattcttcattggaaatttcattgaagcggttaacttatacaatctgttcattgctctactttatttgctatgacagtaggtttaatttatccagcaacttatttctgttttttcacttaggagtccatagtttacagttctgttatccgtaccgccatgttggtacagagcatcaagagctgtgctcttttggtcagctttaggaacattctgaaattgccacaagtgtgtgggtacctgaagctctgttgctagctgctgtgagagggagggatgattctcaggatgtaccgggaaacattgggatgaagcaggcttcgtgtcgacactgacgaatccgagctaaccatgccttgtcaggataaatgatgatgtggtgctgtatctggggttgaaagaaatgcaaatgtgctgctgacttctatggggaatgggaggagtcctgatgtttttccttttcttaagacaatagatgcaaaatgtctgcactaatgttatgttcggtttagacccttgcttttactgtctcctactgcactttcttgccttctagttctaccgtttgagaagttaaatttatgtgcacatgcaaaaaggtttggaccttggatcctgctgcaggtttcacttgtgtacctggtgtatgatgtttgatactatttgtcttgcatttctgtagaagtacggtacggtgtatgattgattgtctggctcggcagacggcagttggtcatggggtcagcagaaagccatgtgcagatcaggttggtcgatactcccgtgacccattgttttctcgatttgtgaagagagttgatgggaaggaacaagtaaacttctgaagcaactcatgatcataagatggtcatcattgtgcacatgatactcatagcaacaccagttcatcacatcgctcaaagattagatgttgaagttgaactggaagaagaggtacatagaacacctgcaaatgaagatgatgctgaagaagaggaagataactggttggatggatgctatgatcatcattgtgctcattatactcgaagcaacattagtacatcacagtagtcatcaaagatgaggttgaagttgaactgaaagaagtggtacagcacatgcaagtgagcaagagaccgaagaagaggaaggaaactggttggatggatgctgtgactgatgatcatcgaagcgaggatgaacatgaactgaacaccttggttcattcagctccggcgaccgtggccggagaagcggcggccgacggcggcttgtggacgacgaaggacatgcactggcactggcggctgctgtcgaaggcgatgaggcggatgaaggcgtccgggtactccctccggcattcctccacctcccggagcaccgccgccgcgtcagagcatccgaacatcggcagcttccacagcgtccagtacctcccgtcgtagtaccccggcatccggctgttgctccggtggatctccccctcctacaccatatcatccattcatagtacaaacttataacaatacatttttcttttgggtaaatactaactgatggataaattcatcatggagaaaattagtgtaattacaaaaagagttaggacaagtttgatgcttagtttgtaccttgtcaaactcgaggcaagggacccatcctttggacatgatgaactcgatctccttggagatggacttcgcgctcaggggaggcaggtaagacatcgcctcgtacctcctgttggtgaaagggttccatgtctacaacaaaattaaatcactcgctgaatttactgtaagctgattttgcaagtatttcatgccgaaaagaaaacactttgatctgatctttttcgactcctcaaaacaaaagtaacatatagatatgcagagaaagtttcatgtttgctgaattgctcacctgcatgcagtaagttctgaagccattggatgctgcacctcttcttgccctgcaggagccaggcaccaccctcctctgatcccggacaagcttggccggctgctccggcgaagcgacgacggcgccggcgacgaagctggccgtgttgatgaacatgatgtcgccggagtagagagtggtggtggtggccggcggtggcgtgaagaggttaagaaggggagagtagagcaaggtgacaagagatggagagtgtggtggcgctgggagaaggtggcaccggtgcacttgggatggcaatggcatgggcatctttccatttcctttataacaattaacaaaatgggtgtttcaaatatgtccctttttagaaacataaaaatgggttcaaatctatttcttgaaaaacatactattgtgaataaaattttggcgtggttatcaaggggaatggttacatttcttggtaagttgatgagttttaatgggacaaatgtggaaaatactttggctgtgtacatccggtttagatatagaggctagattttttttatcgattttctaaataatatatggaaaacacaaattttacagttttttttaattagaaaatcaaatgaggtgaaaggaaatgtcaatgttgctaaactatctctcatataaattcgtgatgaaaaaaaaaatctcattgatcatttttttctcattggtctagagaaacggtggcttcaagccttcaacatggaagttgtttgtctgtagtggacgatgggaccagagaccagagcaatggtggtgatttcttcctttggtgccatcgccgatcttttccccccataccactagcatgtaatcatgcaggccgccaacagaaaatttattgatcacctatggtttgatttgatggtggacttaatcatcattcaaaacagtaggtttatttggcttgttatgatcaacaaaacgaaataggctttgtcatccaatcatgtaaaagcatctttctgcacaatttggcaaatgcattgtgatattgcgagttcaacaactaagcttttctttatacaacagtcttgaagaatgtgatatatcagggtaaaagatttctggcattcctgatcctgataaaggcatgatctcaagcccttgctcaaatcggtttcagttgatcccattggcagttgatagaagtgaacagtgctaccagatgagagctatagattgtgttcaatttacaggttgttgttagtacacgtttcccaaatgatctaattattcaaaaatttctgggctagggtagtatttacagcaaaatcaaaactactgcagattccagtatctttgacagaataacatctactggccccttgcacttttatgctgcaaatgacgcccccttcactagcccatcgttcagaatctcggccaagtcattttccagagccaactcctgcatttagagtagaacaatattagtctagatgaaacacccataacttcagaagttcagaacacatattggagatatcctgatgccttcatttgagaatttgcagagaaaagatggttccttttttttgttttaccttgtcgctgactgaacgctggtggccttggtcgatggaagaattatctccagatgatgcaacgaatgtgtgaagacggatcagctcagggagcacgacggattccaagtcaggacggtctctgtgccggagttcacagcatttcagtgaaagctcagcaaacttctgagcttcctgcacaggccagccggtgacattaggatccaagagcccctcaaatgttccttcctccagtgcatcagagaccatgtaagcaagccccattgcatcttttgcagtgatcatctgaagatagatgatgccgagcgcataaacatcggatttcgtggtgaccaatccagtcttctggtactcaggatcgatgtagcagaaggtccctgcagcatctgtcatccggtactgcgtgaccgtctcatccatcgaccggggaatgatgcgagcgaggccgacatcgctgatcttgctaacgaaatctttgtcaaggaggatgtttccaggcttgagatcacggtggacaaaggcttcaggtttcatcttgtgtagatagagcaagccagtggctatctccactgccatcttgaaacggagctgccatggcagcggtggggtgcctgaccggcagaagagacggtcctcgaggctgccattcggcatgtattcatacaccagacagccatactcagggcaagcacccaacagatgcaccatattcgggtggcgaatgttgttcaacaactcaacctgttgataacacaatttaaattcttaccatcatggtttacagatatatcatttatatatagctgaaactgatgcatgatgtttttctttttagcaaaggactaaaagtaaatcatatgattcccttcccttttcatttttggatgcaccacaatagtctctatgatttcatattactgaatgttgagtttttcatttttgtgaatgaaatttgaaattttcacgtaaacacatcattgtctacatgattttgacttaacagaagtatctggctatctatagtgacaatattaccaaaatcaaatgataatatgattgtgctgctctgaaaacattttactgtcagtatctatcccaagttcccaacatcactctcatttgattggaaattaaagagattgtggtggtgggatacttgtgtcaaacaaaattggccatggacatacctcctgttgaaactgtttcagtccttgagttatgttagaatggagaatcttggcagcaacaagagtattgtcaagtgtagctttatagactggtccataacctccttcccctaccttcagttccggtgagaaatgatcggtggcatttgcaacctcttctgttgtgtatattttgcattggaatctagttggaagaccctccagtagtcttttcgtctcaattggccttggcaaagatttacacttcagttcaaggttgtaagccttttcagaagcacatccatgcttagaatcatttctaggcgagtaaaatttgggcggcaaacgtcttaagatcggatgcaccgtatcctgggaactatggtctttaaattcctgtatggttctctctctgcattgatcagaagaggaagtttcgagtttcaagagcttatgctttgggccacgaactgcggaactcggttctgcatttggtctctcactgtaggaatgggttgaacatgtcgtgaattcttgtaaatgttcatcctcatgttcaacacttgcatttgagttttcactcctgtctccgatcccaagaggtaactgcagtccaaatttccattagaattcatactttcagaatatgggattagagacaagtaactttatgagataaacaataagcaacacagcacaaggtatcacaattaccttgttccacatgtgcatatcgtcatttttctgtttcagctcaagctttaacttccttatttcagcctccaaatcttcctgcaaaaagcagttggtctaatagttatatttctgcaagtgacaaaaccaaaataacaaagagtaggggaaaatatcaaaagcatactgggtagtatttagaagttgattcagtacattcttcactcaggtttggagataaagggttgcagccaggacaaagtgcactatcataaaaaaaaaaactcatttatcaaaacctgggtagtttgtatgagaagggcacatatttgatgtatccatgaaaacatcaaggaatttatgttagcatatatatagagagaggatgcaaagctcacctagatgaattttgcccttcaatatgtattattggtgctggttcacctgcaaattccacatgcacctaatgaacatacaactcacaagtatactagagtgaatatcatctaaagggaattagcattagagtaacacaaactttttgcaattagcggccgattttcagatatattctccagctcttctttgctggtatcatttgcatttgcatgggtggcaagcctgaatgaagatagtttccctttggatataacatacactgaacagaaatttggtgcagattttgtgacacatgttggcacatccaacttccatattgtcctgcactagttaagaactgagatcaatatagcaatcaaaagagaagtattaaaacaattcagaaaataaactgtaaatagaaatggttgcaattttctttgacttaatggttgtaaaataatacggcaccttgtaaatgcattcctagatgatgcccccagtactaatttgtcaactttatggtcaaggacaaaatctataataactttccacacatcagttccatcaagaatggtttccctgcattgtaactgtagatattaaagcaagtcagccaaaaaagggtcatgattttgctcatgctatcatcaggtcaaacaaaggaaagcaaaatcttaatagattatatgaaaagccacatgaatgatcgatttcaggtccatgccaacatgagcattccagtctgtagttttcagaaactctctatatctccatagattttagattccgccaaaatgaacataatctctgcgtgacaaggtagaggtaggaaaaatggatgcatacccctcgtctgctgcagaagcactggaatgggagcagcagatctttggtgtgatgatccatttgatcaggagaagaagctgcaacatcatcctgcacgtgcaatagggagaattgctttccccctgcataaatgaaaaacttggaaaatttataaactctaacaatacaatgcaaaattcacaattcatcaatgcacatcacatgaacagcaccgcaacttggatgcacatcaaatgagacagattaaggtgggttcttttctccccttttccaacctctactcactagttttctacgcgcacgatttccgaatactgaacgatacgtatttttgcaaaaattatctatcatatcaatcatgtcaatcattttttcaagtttattagccaataacccaatacttcattaatcgtgcgctaatccatctctccgttttccgtgccgggatcccaaaggagatcaagatcacgtcaagatcaatttctagggttgagatgggtgagctgaggggggaggaggatcgtaccggcggagtggagggaggcgtgcttgcggcggacgtggaggaggaagaaggggtgggagagcgagaggacgtggtcggccgcccacttgagcgcgtgctggctgcccctgtcgccgtcgacggccacggccgccaccaccttcccgccgtcggctgccgcgcggtggtccatctccgccagccgcctcatcgcggcggccgccgcctccttcttgccgccgccgccgccgccgtcatcctccttcttcctcgccgacaccgggaacggcgggtggacgtggaacgtggggtacgacatctccggcgaggaggaggaggagagagagagagattgtggcgccaaaatggagggaagcagcggatttggagggaaatgctttgcttcgcttgcgagaggagagtttttcttttttttttttccctttttgtccttctcatattattgactaaaaatagtccagttattaataattgaatttggacgaaacagaatactgaccttttagaaaatacggtcataaatatttgacgttaaaatcgtaatttgatgatttgattaagtttttgaacccttatgtatttaatattaaataaatatgatattatttttcgaggcaaatttaattacacacattatatttaaaaaaactactccctccgtattttaatgtatgacgccgttgacttttcgaccaacgtttgaccattcgttttattcaaattttttgtgcaaatatgaaaatatttatgtcatacttaatgaacatttgatgatgaatcaaatcacaagaaaataaatgataattccataaattttttgaataaattttttgaataagacaaatggtcaaacgttaaacaaaaagtcaacggcggcatacattaaaatatggaggtaatatgatttttgaaaactttatactaaaagttaatggcatcataaatttgaaatgaaatcgagggagtatattaaaaaatatttaaaaacagagtactagtaaagattggtaatctatgattaagtcttgtcctgttcgctttaccagcttaaagtaatctgaataatagattgctccagttcaatgcgaacacatcaaacagttcagtgcgaacacatcaaacaaaattgtgtgatttttgctgcaacaatcatatggttgatggatcatcattcatgcaaggctctcatgctattttttcacaccactaatcctggtaatgaaatgtgatggtattcataattgcctctttgcttcaccggcttgaagtaatctgaagaacagattaactgcttaatctccagttcagtgcaaacatatcaatttttttttgtaatttttggctgcagccaacaatcatatcctacggttgatggacgcctccgcttgttgacagaccgatcgattcacatggcagtttgaagcttgggtctcttgaagagtcacggatggaagaactggagtcttgtctggtgtggagttgctgctgaaccatgttaggatgacgaatgttgttcaataaccaacctgttgataaacaccatttaagtaatctcatcatcatatggtttacagaatatggcatttacataagctgaaactgaagcatatgatgcattcttgacaaaggtctgatgctgtaatttcttttggaaatcatatgattactttccttgctgatctgctaaagataaagagaacaaatatgaaaggtctgccgtcatacctatgttaacttcagaaaaattgcccaactgggctaagaagcttcccttccatcacctgaacaagttactgtactggagggtcgttgttgccaattgttgcagttcatatacattggtctgcagtaaagaggataataagatatctgaatcatcatatatcatgggttatcagacaagaaggaaactacaaaattaatcagcgcaattactgatgcagcttgatccagatgcctcaatgacacatgttctactggacgatttgcagcttttcctggcaaaaacttggtctcatggagctcaagaaaccagcacacagtagccaggtcagtctttgctagttgagattggagtatacctgaacagaacaccatgcttatggcgtgacaatcttgatgcaacctatatcagcttatccaataattccacactagaaccaaagcatgttgaagttgactaccactatgttagagaaagggtggcacataaattgcttgacattagattcacttaagccaaagatcaagtcgaacaagaattctgacaaagccactcccagtgcacacgcacatggaacaccggacaatctcaatctgttttaaccaggatggcatagaggatgttaaagtaatcgatgaaggcataaacaattttttttaaaagaaattgacttacaataggaggcccaaccatacagcacattctgatctattgctcctaagctcacggttcagttctatccatccagcgccttctgttctactgctcctaagttcaaagttctgttctattgctcctaagcttcagttaggtagtgacattaaaaaaagaaaaggaacaatgggagacaggagtgctaccgatttaattaagattagaaaaaaatgcataaagttttcaggatagtttgagaaccagaacaatctatatgtaaaaaacaattatagttgatcaacggcttgagaataaaatggattgagattgtcttcttcaaagaatcaaagtaaatctaatcacttttataggctagctgcctagctccttctatagactcagctaggaaacaacttgaggtgcatgctttgaatggcaagacaaacagaaacgacgaaacgtgatgcactgcgacaaatctaacctaaaaagtggtgttttcagttggcatgggtgccatttattcccaacatatatggatgtgaatatgttaatatatctcagcaaagaaatgcccctgatgcctatatggatgtgaatatgtcattgtattcatcaccagcaaagtaacacccccattacatacacaattttgaggaacctaaaaaaaccaactctagactaattgccacattcagagactcaactcaatcccaagattaatagtaacagacgggaaacaatgccatgctaaaacatctgcatgcaaactttaaaagttgtgtgattcgaatgttggcaatgtaatgaaaattcaatcgatggcaatgcaatgaatgatactcctgagtattcattatagtctagagacaggccaaatgaacaaaacaatattcacttcttttttgccaatgaactaaagagggagcatctattttccaatttcctgtttgaaaatacagagtattacaagaaattgcataatttcaaaatactccagctaactcatcttcaccaaccaaataattgattgtttacatgccttatcatagatactccctccgttttatattataagactttttagcattgccgacattcatacgtatgctaatgaatctagacatatatatactccctccgtttcatattacaagactttctagtatttcccacatttatatagatgttaatgaatctaaacatgtatatatgtctagattcattaatatatatattaatgtcggtaatgctaaaaagtcttacaatatgaaacggaggaaataggtacgatgaggacgttgtgaaatcaaagaacactatggcagaggactttgtgagcgatgctgtaacgctccgacttgtgcttgatcatccggagctcaccacgggaggtgcgctccagctcaacgccggtgaagacagcgaacctgtcgaaccgctgcgagaagtcgcagcgcacctcgactagctcttggaagaatctggccacgaagaacctgctagagccaaggtgcacaaggaaggcctcgaccgggatccattccctcggcactgacagctccatccacacgttggtcagctccggccccgtctccggcgaggcggcggcggcgaggtccacggcgcagagcgggtgcttgtccctcctggaggaggagagcccgaaccagagcttgtgctcggggacgtactccgctaggccggcgaacggcatcggccagtcggcctgcttgctccagctgcagctaaccgtgtcgaaggcgtaggtgcccgcgcgcgccgtggagatccacacctccgatccgccgaccaccgtgtaggactcgataggcttggggctgtagcccggggcaaacaggaatggcggcggcgggagcgcacgggagcagtaagaagaagaagaggaatccaccgccgtgacagcctcgaagcaatggcggccgccgcagggcaccctggggtacaggtcgaagaggtagatgtcgtcgcctacagggacggagactggccagtacttgggtttcagcggggtggtctccgcgagcagggcgtgcgtgccggcgtcgtagatggcggcgctgtcggactggtccgtcaccagcagcctgtcgcgggcgcggccgaagagcatcaccccgatgtcgccgttgctctccggcggggccggagctgggtagaacgacatggagggctccggcaaggaggattcctccgtcaccaccgccatggacgacgggctgaacggcggcggcggccggcgggagaagaaacgcgacgtgtcgatgtggcggaggttggcgctgccgttcaatgcggtcaccaggtgcacaacccgccgcagtgaacccatcctcttgatgctcttcttcttcttcttctacaccccgtcctaggtaggaaaccacatcgattcgattcaatccaatccaatattatctttctgaaaaccagatctcccaaaacaaacatacctgtgctgtggaagaagaaagaagcgacaatttgaatccgatcgtacgagcaacaggtggtagcgcggcgggcggcggcggcggcggcggcggcggcgggcgtggtggcgagggtttccttcccttgtctgtttttttattttttatttcccctgccttgttctgtttatttattgtttcgctcggcccagcaccaagacaggccaggggctcggcccaactaaggcagaccagcccgcgaggccgccgccttctccgcgtgtcgacggtggcagtggagaggagtgcgttgatcttgagcgatcgagccagcggtgtcgcacccatgcatgcgcgcgccgagctcacaatccgccgccagcaacggcgtcccgttcccaacacccgcaccgacatcgtcaagacgcaccacgtacgtcggccgaccggtcggatcctcggcttgccatgccatgctcttcgactcatatgccatggatgcgtacagctgcctactggttccaaaatacatacccaacgattttgctaaacgcgaagtaatcgaagcgagaagtctcccgaaataagatttccccacaaaataagatttgggttcatttcaaatccctcggctcgcgactcctgcctgcgtcgtcgtcgcctacctcaagccaaaaccatggctggggcggggctcccaagctggtgggcgctccctctcctccgcgtgcccacgtcgtccgccgtccgcatcatcccgtcgatcgccgccgccgccgcgcgcggccacgacctcctcctcctccgcgcctcctcgtccgaggccacccggggcttctcgtcgtcgacctccgcgcccgcggcaccggcccacgccacggctgaactgctccagccgcgcaaggacgagccccccgcaccagggtccgccaccgccgcacgttctcgtccgcggccacccgcgtcgtcgaccgccgcggccgcactggtcgagctcgagccgcagcagaagcaacctcccgtgccggcgtccgccgcggccacccgcgcctactcgtcatcggccgcactggtcccatctcccgcgccggcgtccgccacgaccccacccatgaagcagcgcacagggcagcccactccggcagcgatcaagcggcagcgccaactccaaccggcgccaacacgtgtggccggaccagccgatctgatcaacctcgctcaagcgggacgcgtcaatgaagcgatccatctactaagccagggagctcgcgggaattgcaaggccttcgaagagctcgccgcaagctgctcgactccagcactgaaggaggaattgaaagatgtccaccactacttcctgtgctccggctttcacaacgattgcggcgtgaacaacaagctcattgagatgtatcccaagtgcgatctgctcgagttcagtcgcaggacctttgatcaaatggcctatcgtacccttgactcttggcttctcatgatcgaggtcagctacaatgcggaagagtttgaggaggcgttctggcttttcaagcagctcaaaagtaattaccatgatctgcacaaaacaaagcacctgatatctccagttggatcggttgaactgatacaactatgccgatctggcaaggcaagaaaggctctcaaactgctagagatgggagtgcacgccaacctgcacgcattcttcgagatcgcagccggttgccgtacgatcgctgagctcaacctggtgcgcggatgcctgcaacgctccgcgttcagtcacaacactttcatcaatagcaagactgaccaaatgcaagccaagtttgagcagatgcacgccaacctcaagaacaaggacgggcacggccatccttagcccttgtggctaccaagtataccttctgcttcgtcacaaaagattttgcaatgttgttttgggtagtatctaggcatctctctcatgatggtagacgatagatatatttgctgacatgaactccgagcctcaaattacatacctactgtaagaaaacaccgtatgccacttggaacttaattacatgttcgtctctttcagcgtatgttagtgggccagctgctccaatagtggtgtaagtagaggttgttctaatatattcaaatagagcaacctgtaaatgcatttctagatgatatgtcccaatactaacttgtcaactttatggtcaacaacagaaatctagctacaatacctttccacgtatcagttccctcaaaattgatttccctgcattgtaacggttgtacgtactccctccgtcctaagatatttgacgccgttgatttttcttaaacatatttaattgttcgtcttattaaaaacttttgtgaaatatgtaaaactatatgtataaaaaagtatatttaacaataaatcaaatgatatgaaaagaattaataattacttaaattaatttgaataagacgaacgatcaaacatattttaaaaagtcaacgatatcaaatatttagggacagagaaaatacaacggtccgaagatgtatgtgatattccgtgcaaacacgaggagttttttacaaaaatgcccagccctctcaccgggagcagccctccaccccaaccggcaagtatgcacaccacaatagcgcccaaattagaaactagaaactattaagtgtggcgggctgggcggccgctcgactatgccacgtcagcgattcggtacagtactacagtgctcgggtgtatttttgcaaaaaggccctccagttttatgtaataacatatatgcccctcgcgaacagtttttggagaggagaatccgtggataaggacctatatgtaaaatattaagtgtggcgggctgggcggtcgctcgactatgccacgtcagcgattcggtacagtactacagtgctcgggtgtatttttgcaaaaaggccctccagttttatgtaataacatatatgcccctctcgaacagttgttggagaggagaatccgcggataaggacctatatgtaaaagtggaatatgtagggctttttcgcaaaatggcgttcactacctaacacccccaaaccctatccgttgccgcccgcaccctgtccctctccctctccagcgccgccaccgagcggctcgcgccgccgccgccgccgccgccacccctcgcgccgccatccccaccatcgccgtcgccgtcgcctcgcctcgtcacggccgcctccgccatcgcctccgccacctccaccatcgtcgtcgtcgtcgccgtcgccacccctctcccaccatcgtctccgccatcgttgtcgccgtcgcctcgcgccaccacggccgctgccgcctccgacttccccgtcgcctcgcgtcgtcgtcgccgtcgcccgcccccgccaccatctccggccccccaaaccctagccgccgccgcccgctcgttccgacggggattcggaggggtcgaagggaggaagaggcggtggcggtcggcgaagaggatgacgatggcgacggcggcagcggcggaggaggcggacgcggcggtgggagatggagacggtggtgatggcggtcggcgaagaggacgacgatggtgacggcggcggcggaggaggaggcggatgcggcggcgggagagcgagacggtggtgatggcgacgacccccgcactctctcatggcaatctcgggggaggtgtcggggaccacggcaacgctggtggtcatcaatggattcacggtcacggtggagtcagtcggggactcgcggtgcatcctggacacgcagggtggtgaggtgtagctgctgaccgtcgaccactgcctggagaagaatgccgaggagcgggagcgggttagcgccagtggtggggaggtcggccggctcaatctcttcggtggtcaggaggtaccaattcgctcccgagaggccagattgaaaaagagaggcttcctttgtgatgcattgctgtgtgacgctttgttttcagtcggccatgtcctgctttgtgatgcattgttgtttgatgcagttctaggttggccctctccggtgctagacaggtggcatgtgcctttcaagatctattggggacctcttcctgccgctcccatcatccctagttgcccgccccacatcccatcatcgacggcggcgtggattttggtggtcgcgcaggtctggctgacgagctccatgccggctcgaagcagatggcgacctcaacggcaacgtggatccaggctagagcttgataatggcactaatctgccaacgagcttggcggcaacatgcccggcggccgccgttagttccttacccagcgccgtctccaccgtcttcgctgcctccacggtcatggccagcggcggttgaccatggcatatgctccggcaggcaaaagcagagagatggccttcctcccctttctctcccatctctccttagattaatctctctctctctcaggctgccattgttgttcttttcatggataaaattgttagggatcggcaatatttcctattctaattgtgtcttgactgaaaattagttcgattatattcagagcccgtggttaggtgatccgagattggtgcttgctggctggattagtcaattagaaaaaggtagattttgatatgcagtattaatttgatcttgtgatgatcttagttcttgtaccctgccttcccttgaggctacttctggatacccaaggccctagcgcgaagacgtgtgagggggctgcaggtgagtcgggctatcgccgtggagcgaccgtggtgaagcagcagctctacagcggccggatcagtgcggtggtccggtggctttacggttgctagaggtgtgaatccttgcttcaatggttagagaaacttagatgcacctttgctgcatgtttcttccatgtttcatgtcttctttctgcagctgttgctgtttagggtcaactaggaggcagtgtctgtgtggtgattcatcacagttgcggcggtctcgacctacagcatatgtccatgatcgatgcgtgacaagagccgaaaaggatcatccattgtgtgagtgtgctctatgcggctgctaagcaaacaaccaattatgtttcactgttaaagtttggctgtaatattcgattaaaaataccttgataattttacctcccaaggatctaaatgttttgcctttgatttaaattgtttttcccctgatggctgatgcagtgatgcagtttttcaagcaagtggataagagcagcaagtattatgaatttcgctgcaaaactagattagtgaaaccatcaatcctccactttcaggtgagttataattcattattctatttaatgcaggataagctatttttcctaagctattagcatttggattattctgtatcatcacggagttgctacaccttatttcactgatcgtatgtatttgtccatgtcaatagaactaagaagttcaaaaaattgtatgaacaataatagccttaataaagggacctctgagcaagaaatctactatcccaggggaaaaattttgtaatattttgaaggaaatgctatggtggttaaatacttaaatgtttgcatgttgaactgttaaaaacactcataacttgatgatcttttgacagaacctatacaaggaagggctcttggagcaactgctacagtcaactgctctactggttagttggtcacttggtcgtcacttgtcaggtagtatgcacaaccttttgtggtatatcatctgctttatctaaattagtttggctcatttttactaatgttataactgtgtgtgcagcctgacggtgcagcatctaaaagctaacttatacagtgtgctttatctctggtatggctgacctcagttgtaagttctgaattttgagtggtgttggttagaaccatttatctgattgctcttgttcatgatgaatggcaatataatgggattactcttactcaggcattgatggaaagtttcaagatttgtgcagtcaatgatggcatcataaattgcgtggatatggtaaaaatatatcatttaccagttttctcttttgctgaatcattgattgatctactatatttgatcttgatcaaatcatatttttgaactaatgtagttctttgacatgaaaaaagcttgatgttaagtacagaagaaccaggtatgcataatcattgtgtgggttcattttcttttttcttctatagagttgcatgcattttcctttttgcttcgcccccgccccctgaatagaagtgtatacggagaactactgatctttagaatatcagagaaaaggtctaatctgatttgtatgatctctataaggatttggaactcaccagaaacatccaatttccatttctaagatagacaattatctttaccttaccctgtaattttttcgtttgaccaccgataattctgattccacatggatcttttatgtactttctcatccgccatctttattcttgtaacagtggaaatgtacatcagagaagcccctagaactgctcctattacaaataagaccgtaacaagtcattaagctaatgtcttaagggatatattatgtactcactttataaatcaatgcagttcttagctaatacgtgctcatgtgatgaagtatttttgtgccttttcctttgctttctgcttgattgatgatttccagataaaagttttagatgatactaacaacagttttttcactctagaacaaactattaggtagtaatacaatgcttaagaaacactccattatggtgtaatgtcttcatttcctgactgcttatccttctatacctcttaaacctagccattttatttgtttataccgaaacctagacattcaattttgtccggcacttgtactataagtggttagtagatgatgccatgtatgttatcttgggacaaaagtaagataattcagtggcttgatgaaactgtacaggaatatccccttttttagtaatctattgtgaaatcagttgctagatgtttcactaatcatgacgggtgggttagtaaatatgtgcggattattaccgggtaatacatttatccacatactgatcataattcagaggaacaaaatatattggcattgattatttattctgattgtgaggttaaggagtattcagcttgcaagtaataaaattgtactactacatttgtacctaggaagtcagctctttctggtaaaaattttagcatccttttattctaaatatgttttatatcttctagatttatttctttttcagggcaagtcactaactttatggtattggagttggagtagaagatcagcagctccatcatcgacgatggcctgatccccaaacatggattttggtggtgatacttccagggaggtaaaat

SEQ ID NO: 67667 - DNA, 19363 bp, Oryza sativa
atcaaatatgaaaagaatgatgagatctcaacattcacttccttgtatattatgctctcatataggcttgcagaaaaaatcttaataaaatcctacttccatatgtaacaaatgaactatggagtacctttttacataactgagacagctcacatggattggcaaaaccttgagcagttcaatttaattcaagaatttaaagatgaacgaataaagcaacaatatatggcatcctatctttaatgctatgtcctctctagaagaccagttctatatagaaccattgcatgttatataaaaagcgtgtgctcaaaagcaagaggtacaccaaactgcacatactggcatatccacacattagaccactgggatgtttaaccatagagtaacatacaataaactgaagcctaaactgaatggtcccgaatcccgattcctgattctaataaatgttttattaaagaacaggttgtgatggaaaacatcttcaccaatcaccattatatcgcaggggaacagataaggtaagataacatggccacaaagctctgataaccaaaacaacttttctcaaattattcaggtgaaactggagagtatgtacctgtagaaatacaccaggtgaactctctgatataaaacgatatttccctcccaaatcaagaagcctgaaagttcttattgtggaagcccgggtctaagggaaataaatcaagagaacattattacagtgaatactgatatactcagctggcttgcaaataagaaaattgattcctttaagcactaaacatcctcctgcggtaactcccctttcatcagggaactttaatattccaaatttctaatactctgttcttctataagaaagctagaaatagcattgataatatgttgaagaaagcagtctacagtttagcattcacttcagataggtgccacattcactttgcatgcacgaatacatgaaacccacctttccagtcaccgtgataacgtttattccccttgaaactgcctctctcaaagattctattgattcttcatgcgggtatccttcattatccacaatgccttaacatttatatagaagaagttacctgctagaactaggaaaggtccaacacaaacagcatacttctatatgctccatcaactcaccatctatatcacatacgatatggctcagttttggttgatgaacttcccgtaggttaatttcatctgaatctctactggcctctgcatgcaatggggaaatcagtgggaactccaattagaagaaattgactgacaacataaagaaaaagcatgctaaaatgtgtgaagatacctaccaacataactttgtgaatgatccatgtcatgaatggaatcatatgcactcttaataagtcctttccctttccaatctagagaatttaagatatgttcttccccgctctccatctcttcttcagccactttgctgagctcatgatcaaagcccaataaatgcaataatccgtgcacctgttggagttcgttagcattgaataggattacaatctactccgaaattgggaattaggaaataaaataagatgatgaaaatgcaccggatcaccacattagaccaaaataataataataaaaagtgatgctagaaatgagcgaaacaaaccatgagaattcttatctcatcatgcagtgtatggcccctttcttccgcttgccgttgtgcagtgtcaatagagattactatgtcacccaactgcagctgtcaaacaaacacaaacatatcagaaaaaaatggtaatcaaacaatatgttagtcatggtattcatcgactcaatggtacacatacaatgggaatgtccagcccggggatatgctgcgacattgatagaacatccgtagcgtgatcctcgtccctccattccttattcagtttccgaatgaaatcgtcatcacaaagcagtatagagacctcaacagtatcgtacttattcacatcgcttatacaattgtctctggttttgtactccgagttttcgaggtggtcaaaggccaccttcgctgccttagcaacatccatttgaagcgcttctgcaatgctctgcatagcaactcaggtcataagagggacaaacaatttcaacatttttcagtgcaagaaccgtatataataaacagagcaaattagcttcaaatcgtcaaatgcgatagataattttatatggaaatggtgagagaaacgcacgcagaagctactattaccaggatagtggggtcgtcggggagggcttcctcgatgccaatctgcacgttgagctcggcggggccctcccgcggcggccgcctcgccctcctccgcctcagcagcatcggcggcgctcgcctccggcgtccaggtgtcgacgacgcgtagtgccgcgaggccgcggcgagcgaggagtggggcacgccgcgaccaccgggaagcggagaaggaggagaaggaggacgcggtggcgaggggagcagcggtgggaggaggctggaggagggcggcggacacgggaggaggtggtggtggagggggtgggaggcgagcgcgcgggaaagaagaaggtggtggaggcgcgccatggaggagcgcgaggggtctagaagattctagaaggtttttagccggaggaggaagacggtggcggcaggagggaggagggagataagaaaagggtttagggccgggcctccattggccctcctaaatgggccggtttaactaacggtttgcgacacagttggttgaaggaacagcgtggacactagacagtgcatgattgattttatttcaaagtatttttgttttactagatttgaagtttcaaacatatcatacaggaaatttatgttgtgtattaacggtacacgaatacaaagcaacatttcattcatttcaaagtttaatttttgtttgtagcacagtgtacaccataggagtacttctcatgatggcatgagtgcatgagacatagacctgcctgttcaaataaaacccatatactctgagctccgtataataatgtaatctcaagctttattacttagtacaaatgtacaatatagtattaattggtcagaacaaccatcactgttattgccaggttatagactgatacatggtgacatgttttgctaatggatagaggaccaattgttaatctttgcatataggacacagataactgaactgacctgtgtactacaatgatagcaacaatactacagactttgctgctcaccaattaaccaagattattacgatttataatctcagggacacatcccagttgcttccctagtatccccagtgtagagataagccaccctgttgtcgagcattgacatcacctgatgcgcggcgagtcctgcgtagcacttgtgatgtgccgaaatgcagatgtcagtgatggccctggacatttcatcctcctgatggaatggctggctgacaaattcttcgaccggcatccactgaaaatgattatagcgggcataacccaaaaaatcattagtgagagctcaatcatctaaactagtagtacaaactacaaagtatctgaattatggttagggagtacccttgctgcttcaatctcggactcgtcgatagatatgtcagatgagagtggcttgagtgtgcatatgaagagtatatccgatttatcgaaaaggacttgatgcgcatgtctgtatgaacagaggcagaaacgtgaagaagaaaaaaaaaacatgaaggaactctcagcagtaaaaggttcgaataactccattgattgtacttgacaattacctgaaagcaacgacatccaggaaacaactttcgatctgaaaagtggagttcttgtaaaacatcaaaataacatttcatcttaagtagcatagttcagtaaaacaagtcaaaacagtgtaattaccccagtttcttctcgaacttctcttatggctccagaaaacaaatcttcaaactgatagcagaaaaagaaataatataagattagtaaagccaacataaacagcttaaacaaaacatagaccttttcttgaataagtttgacatgacttggctattggtttttacacagagaaaaaaaattggcttttgacttatcatagatcaataatttgttttactagggagtctccgctctgtgttttgtaccttatctataaagcccgtagggatcttccagatgtctgaacagtgcgatggacattttccttctttgacaacaagcacctaaaatcaaaggcatacattacaaacacaatacatacgcagataaatggttgcttttttctttcgttcagaaagtatatgacaaggcaaataggcataatccagaaattatcaaaacctcgtttttgtcattcatgacaaatgctccaacaccaatttgatgcaatgaagtggaaggcaaaccgggaggtccatctggaagccagaaagttagcatcacgtaccctggctctgcatgatgataaacaaagcccgcctaaaaaaattgtaaaacaaataaagttaaggttgcccatctaaaaaaatgtaaaacaaataaagttaaggttaactgcaatttttaactgattagttaagaggtaatgaggtattgttatcaaacaaaagaatgtaagagacatgaaaagaaaattggcatagacggttttttttttcctttccagcaatagtggcatacattagccagccttcagtgaaaagaatattatgctctttcagataagtctgatgctaaactaaggtcgataagataaaaaaacttataataataagattaacttgcctttattgcaattggaactagatcagcttgatcttcctgtatcttcaaccaaaccccccttttcccctgcagtaatgaattaatcaacccccttttatatccatctactttctagcaatatgtatgtgtattacctgcttattccaataacaaagtgaggactggagtgatgaagaaaatgcattggatgtatttggtaaggaagtagggttaacaacaatgccaccataatcatcctcaaaggcatccagcacatcaatagttccaagcaatggtgtatctgaaatagctgcattagttcccttgcttaaggtcttgccaccactgaatattgacaatttcaagcaaggctgtctgaacactgaacctgcaaaatataacactgtaagatacagctaccagaatctgagaaaaaattatgcataatatagtaaggtagtttggcgaaatacattgcaaagctgagaaaaactatcacactgaacaatgagttaggagatcaatcaaattgccagaccctcaggtttgctattccaaacaaaccaacaaacaaagtaaaaaaatatcagactaataatacttaaatagcacaaatcaacatgaaaaacataagaaactgattgcagcttcttgtttctctagaagcagatgcagtaatgcacactaacattttttctttattagaaagttgaataaagatttcacacgtcatcacctgctgctatgccaaaactaacttgttttgtacttgaaatcctcggatgaggcaaagaaagatagctctttgaatatgatgagggcaaaacaaatgccattggttttcactcgctgaacttgaagttgtggcaatcctaagagacctatgcgtcttaaatagatctgggaaatatacaaatcacataataatatacaccacctacacatgtccaagtggtgtcccctgctgttatttcaaggagaagccatctaaaatctcactccaatttggaccagaaaataacctttttaagtgggagtacatgccatattagcctccacaacggaatgattcccaactttgcatattgttaaggacctattgggatcacagagaattgagatcagaactccaatggaatacacgactatattgcaagtaaacctcacataattcaaaataattgggtggaagtctccggaagcatgttctatcaactgtcaccattggcaatttcatggtctacttgtcaaataactgtaaaattctttaaacacacacattataaaaacttatattacatttaacttaaatttcatttgacattaaaaacgaccttagcaagtatcaaattttaatttgtactggaaaaatatagcttattaacttcccaaatctgcagattacactcttaagattgtcctttctttgcttagtagtagtggttatttgtccttgtctccacaaaataaggagacatgctcagctcaaataaatattaacaaaaatcgagttccatcatatagttcaattccttggattgagaaaaactaaacatagttttgattaaagagtatttgaagttgtgtggcgataaacctttcttgctgttcctacaattttgacaatgtggtaaagagtccaagaccaactgattcactatttgatccatgtctggaacattgggccttacaaacaaatataatggcaggtcccaaaccatcaataaatgcagtagaaaaatgatggccagaaggtaccgttgatgaacttttaacaaaatacagtgagtaaagaacaatattctgtactgagtatgttgtaaaagattgaagttgtcattgcatcactctattcctgaatgtattcacttttacaacatatactcagtacagaatattgagaatgtgttaggcattcccttttaatatgcatattccccaacacaatattcttacgtagccactgagccatccagaatcaggcaactgcagccaccattcttttgctatgctgcttcttttttttttttaaagagcactatatcaaatattatggtagaaaagataggattttatgttcttttgaactttgtttcgaccgcaaagcaataaagaatagttagaaatatatatatatttttcaaaacgtctgtctccctgaataatatagcatcagtaaattggtaacgatcatgaaaatctagaattgatggaagggaaaaacaacttaacatcagatttgtccatagaaacatgtttgtatagaacgatataatgcaatgctattgcaagcagcacacaagttcaaccaagaacaggacatggatcatgatgcaaaatgaagtatctgaacttaagattaatcagctgtttccttcaccaagttactagttgtgattataatacttgtgctagcagttgtgtcttctcagtacaattttcactgaacagatgctaacatttagccacatattttgcaacacccggcaacctaaattgaagctacgccactaatccaacagagtgctacaactctaaaattgcaagattcggtatgcatggctatcattcatttccaatgtccaacttgactccagacgacataagtgaggagcgagcctcacttacaagcaactggcctattggtgcaacttactaagacactccgaccatcactactcactaagttacattgagcaaccattacatctgacaaatggaaacaatactaccatgggaagacacagtatggcaaaatttacagtggcctgattaaacatagagaattgagcttcatagtgtgacaaactacatatcaaaccaaaggcttgtctgtatggaaactactgatgtccaggtaacagtaacattttcagcaacagaagctcttttaaaataaaaagaaatcttcaccagttggcagattacctgacaatttgaaagcatattctaatgttgtccagaaaggttgacagaagcaaatcctacccacacaaaaggtcatccatatcttatcctattgaaacagaaaattcttgtggcaaattgcaaggattgagaatacaatgaaataagatatttacaattgtttggaatactatttcttttcaagctgaaactagttgggaaggaatctggtttcattcctcttgattgctacctgagtggtgacagcaggcacaagaatatggactactgcaaatgttggactaatggaaaagatactggacagtgaaagtgttacatttgttctgttttattaatatagtaacttgaggtcatacaataggaaacacaatggtattaaaacaaattaccactgagtgccaaaggaattcttactttttaagaataatttatacagctattgtacatactgcagaaagaaataaagggggtttaaataaatgctacaaccagtaaccaggcttgctacaaactccaaaaacagctttcatagccagcaatagaagcattacacaatagaaactaaatgaaaaaattaatagaaaacaatgtagcaggaccaaacatttgtggacataaataatacaaaagctacataggaacgttacaacatattttataatgtttggttgattacagtagacagtaattactcagtaacaggcccccagggtcccagacagcagcatcactatcaatgaaaattgaaacatggaatgttctatatactactacaatacaatgtttgggtaaccgtaaacatttgatcagaacaaagcaacaacaaataaaaaattgcaaaagaggatcctctctgtggccacatttgggacacgggaattatttcctgattccagtaggtgaaatgttccatttaaaattcccatgatccaaacagtaactaaaagaaacaatagatccatgttgtttcagccctttaacgtcaacagaccttataagaaaaacacattcagggcaattaatagctaaatgtacagttgtacgtatctacttgactatttgacacagattaaggatgtgttcgatagtaggggttgggatcttctctcacgcacacataaaatggagcaagttattagtgcatgactaattaagtattagctaaaagaatttgaatatcgattaatatgatttttttttcaagcaactttcccatagaaaagttatgcaaaaaaacataccatttagcagttcgggaagcgtgcaagtggaaaacgagggagtagaggttgggaaaggggagaaacgaacgcaccctaacattctttgcttgaaattgtgtggctccattagggctacaacttggttactttgttttatgtaaccagctaatttctatagtaaatcatctatgcaaagggatttttttttttttgcggggaattgaacaatgaaaaaaagggagaaaggtgggaaagagaagaaaaaagaagaaaggaacgtatggtcctactcctttttcaattaggcatatctcaaatagtgtttttttttttagtcgaacatttcaaaggaaaaacttttaagtggaaaatctagaaaccggacagtctagagtgccatacatctaaataccactttcctggcctaattgggaagccaaaaaatcctggtccatctaacatggcgagtcaggattctgggccttcccaaatgatcctaaaatattgtagcatagtatattgatattgtgacagtgttactaaattatttcagaattacatatggcctttccactgtatattgaggtgggaagcataggtatattctcgtggaatatcccgtaaaaacaccatcacagggcaatccaatcagcctaataattatctgacgggaaaggcagcttttgtacaaaatgtactcatcaaatatctgttgattagttataactcgaagaaaaacaattgatgtctccatgtcaccttaaatatttcaaatttcacaaatacatcccaataagcggaaacaacatgcaacttctacaggtaatccgtaatcaagtagtaaccttgtaggtcaagtttcgtattatctgtgatatgtacatcaaatactacagaaacagttggctataatgttctccatactataatcatcctcagaatatagggaagaaagcagcagggtttacatcttaaaaacaaattggctgcataatcagcacttagagatagtgaaaaaataataatgaatactagttcataaccaaatcatctggttactgtaaatatgatctccaatatttaaaagatagcttgtttgcatgttgtagaagcttatatgacttcaaagcagaactcttaccacttttggaaatgtcttcaatatcacaccagaattttctcttgtaatatgatgaaccttaaaagatacgaaggatgcattcattacatctgccatttccaaagcattgtaactacatgaatctgcatgccctttgaacttgaaatgaggacactttaacattttgaaagtcgatggcacattaaatgcttagaatcagggtgtaggtagctgcgcagtatgcctgatccagtgatccttagctatcattctggaggagaaagtgaaccaaaattttcagttgatggtttgatgccaatctggaaattatgcacagtccccagatacacatcacagaaggtatggacctgaagaactagggagctccctggaaatttaccaagccatcctcatctcaatgggctgacaacccaacctgaaatccgagttggcttacgtattcttactgttcgttgagatctactttccagtcgctcaagtattgagtaagttattgagtcggggattaacccttgttgcttcatagtttcataaagtttatgagcttcttctgtctttccacgtctctccagacaatcaagtaaaatgttgtaagttacaatattaggggtgcatccctctgatatcatctcatcgaataagctgcatgccatctcaaccttattggattttccaaagcactcgattaatatgctataagtaaacacatcaggatcatatcctttctcttgcatctctttgaaaagcatatgggcttcatcaagatcaccatgttttcctagacagtttatcaaagaattgtatgtgacaacatcaggcttacaactgctagcctccatcacttcaaaaagttcagacgctttatcaactaagccaactctaccataacttgaaatcataatattgtaggtaaaaacatcaggaataattccatttgttttcatcttgtcaaagagattgctaatgaaagagacctgcttgagctttccaagagctgaaaagaccatattgtacatgccaacatctgtaacaatccctttttcaggcatcatatgtagcaggtcgatcgcctctaatgttttctctgcattacataacacctcaagcattgatacaaaagcatccctgtcccctttctcatgggagttccacatgcgacagaatacattatgtgcctcacttgcatgaccagatttgcagagtgacttcaccaaatacgaatatattgatctgttcataaatctactacagatatctagaacctcattcagtctgtgcagctgcccttctgttgccaagatatccagtgtaatgctgtatgtgaattgattgggttggcagtcattctcgaccattttggagagtacaaaaattaccttgtccaccattttgttcttgccaagagcctcaataatagtattaaacgcaatcaggttaagaacacatccttttgataccatttcatcaaaaaatgagagaaattttgaggtcctcccagcctttccagacattctgataagtatagtatatgtgtatgcatccggtacacagtgtttttgtttcatatcttcaaagacttggaaagcttggtcaacctaatcaactaacaaaggtcagctgccaagttttgaggaataagcactgaacgatatgcactttcaagatgcatggtatgtcaaatataaaaaaaatatagaacaggatgagatacaagaggcaagattcttgttgaacggcaatggttagaatcagacaaccaaacaattttctgtctgtgctccactaccactcgattcatatttcacaatgtgcaagttatcaagagaaatgcttctccacatgtattcacacatggctacatgtactatactaaacatccaaaaaaagcttcaatatttggcaaggacacctcaatgaattaaagacgagttggttactttgcatttttgaaagtttgcatcaattttgatgtggtgatagtacatttaccagcatgtacatgtggaaaacccattctcggttatcaaacataatcttctatgtaattggaacaatattacacaaaagagatatcagagtctactatttttgtacaacacaaccaatttccagtattacttttaaaatcaaccttgacatgatattcctctatgccaccctaacaaggtactctgcctcttcctcttccattccctccccccggtttgccactgttcaccacccttgtctcctctctcactgcctcaggctacagcgatggcataggagtgtccattttgcatcatcccaatggcaaacgaaaatactgttttgtcaactatgcaaaccaaccatgcttgatcttttagtacgtgaggaactgatgctcaaaacttagcaaatagctatcttaacttagactacattactagcaatatatgctagtatgccaaaaccattggcaatgggagtttttttcttaaaaaaaaatgaacgggctaccatcaatccatcatagagggcaatttcagtttataagcaagggcattatattgttgcaatttcagtttgatcttggtattgatgtcatcttaggtcacataacattaggtatgatgtcatcttcatacctaatgtttgcaaatatgactccaattctaggtcaaacaatcagagagaaacatatcgacagcatgaaacaatgattccacagagacattcctagattagcattcattccacaaacaccaccaatttaaacatatgcaaaagttagccgattatcgtaccattccagccttggcaagcgcgtcgagaagcatgttatacgcaaagatatccagcttgtagcccttcctccgcatttcctcatacacctggaaccccttggacacctccctgctcctcagatgcgcctgcacgatgcacttgtaggtgtacccactgagcctgagcccccacttgctggccagctcaaggcacctctccatctccacgccgccgccgcccatcccaaccagcaggttgatcgtggagatgttgccggcgacgccgtcccgctccatgtcggcgacgaggcgcagcgcctcggacgggccggccctggtgcggaagaggagtgccaggatgcggttgtaggagaaggcgtcgtggcggaagcccgggagcgaggcggcggcgaagcggaagaaggcgagcgcgaggggcgggtccccatagagcgccttgacgacctcgaaggcctcggcggcggtgagggtgaggcggagcccgcggaggtagtcggcgaggtctaggagcggggacggggaggcgtgggagcggaggatgcgcgcggcggcgcagacgaggtggcggcgcgggagcgggtagccgcgcgggtcgagcggcgtcgggggaggggtcggggcgacggtgacggtgagggaggggcccgccggggatggccgcgcggcggcgatgcggccggagtaggtggtcgcgaggcggcggggcattatttttttttcgtcggcgaggggggagacgccggcggagtgggcgccgccgccgtgcttattacgggcttcactgacaggtggggcccttgtatttcggccaagtgaggctcctaaaagggccgttcgtgggcctgtagcaaattactggattgttgttgagtgggccgaatctaacccatccatgtgttgtatgggccctcagtttttttctttaagacaactgttgtttttctttgtttgaattcattttttattttatttatcaaaatatttagaaataaaacagaaaacgaagtagtctattaacacgtgattaattaagtattagcaaaaaatttggaaagtgaatcaatatgatttttaaaagcaactttcatgtataaatttttttaaaaaaaacacacgtttagtagtttgaaaagcacgagaatggaaaatgaagagagtgagttgttaactcaaagaaactaactgagcctaacacccttccagaggaccactatggagcttcatgcctcagcaatcttccgagagctcgggcgtacgataacgttgcaaacgagtgaaatgtggaggtgatgcaacgagggtttctaggaagtcgatgccgcgaggtgaagcgcaagcgagtgaggaatagattgggggtgggggggggggggggtaattaagggccggtttagatcccacccaaaaatttacgccctgttatatcgaacgttggaacacctatataaaatattaaatactataggcttaaaaataactaattacacaggttgtgactactttgcaatacgaatcttttaaaactaattgctccatgatttaacaatgtggtgctacagtaaatatgtgctaatgatagattaattaggcttaataaattcgtctcgcggtttagtgacggatattttaattagttttttctattagtacttgaacaccctatacgacaccttgtataatatctgatgtgacacgtcaaaactttactcccctgaatcaacccccctcagttgggcactgcggatacaattttgtctgtggatctagctcactgcccaagactgaaccatttgaaatgccactggcactgtgagagccgttcgcaaacggttttattttagaacaaacaaacggttctctgggcctatttggcacatgaattaagttcctcgtatgtgtggcgtggcctacacagctacactcacagctacactcatcgcactaaaattccaatcctattttactataaaaaaattatcttccactaactacttaagcttaacataacatataaagatgctacatcatcatccactaacaagatgtcacatcatcctccactaacaatcatcacatttaaacattatgtaaacatgttgtatctttataatttttataatttaagagagcttttcaaatacaaacatgttaaattatcatccaagataattcatataatgtttcaatgtatatctttattatgttttatgatatcctatatatttatatagttcatcctcacttagttagtgcttaaatgattaatctatagtttaaattatctttctccttttttcctctaatgaagtcatatcacatcaattgtttttagtctttagatgattaatctacggtccaaactatctccctactttttttcttccataaaatcatactaccttactttttacgtttgaatcaccattttacatactattcaaatttaaatttttcataaaccatattaatttacttaatctgatattatctagctattttacacgttatttttttattgttatcataataaattcccgcagtaaaacacggggtttcacatagttttcttaatagtgtccgccgtctcacaacattgctgctcgtccaagcagcagtagcatagttacatcttacatgtggactgagccgagtatctctcttgtagcataatccttttggcacaacattgattttctcgtcgccaatacctcctccgcagtactaggcccattcaggccacgggctatatatcaaaaacaaatatctccttcctttagtacttcaattaattttaaacacacttttaacaattaattttattattaaaaagttgtataattatcatttattttgggctgcaaaccgatgtctgcatccaagcccaaaccgccggggccggggttactgcgccctggcggtaagcacggttaccgcgcggtaaccgcggtaacagtgaaaaaccatacaaaaccgtgcaaaattcatcaaaattttaaattattttttaaatttatttaaatttaaggaggttaccacggtatttacattaccgtaccccgcggtaagcccgataaccgcggtaaccgcgcggttaccagcggtatggtgaaccatagtctggactagagtagtagttaagaaccacgaccgcgccaaaaaggagcctggatagttaagaactcagaaggatatgagtagtttgatcagcggtcagccaacagctgcttttgcttggtcattatcaccattcacgctcactcatacgtcgtcacatgctgttcatcttctgcttaattagcttaattaatctcctgttttatcagtcgcgcttttataattcgcagtgccaatggcaacaacaaatgtacttaagctcggtgtgctgcgcactacgcaactaattgacgcatacaacacataacaaatctcatttgatgcttatatgatgaaagtcacaagtggtgtagttattaggagtatagcgtggctctgcccttagtacttcctaagctttagtttactttttttgctttttttttctcttcccttggcataagtcagtctggttgattgcgttgtataacataaacttattttcttctaatatattgacgtgtaattattttacgcgttcgtaaaaaaaataagtggtgtatcagctagtggctacgtgattttactcgtcaggttttaaattatagttatatgattattaaatattgcgatcatgaatttacccatggtttttgtccctttaaacgtgcgttacgtatcggtgggcatgcgagtatagtgtgcgtatgtagtgtgtattgataggaaatgattttttttaatagaggcagtacttcagtggtgcatactcctgcttggtcaagattaactatggtagaagtatttattttatttaaacaaatggagtaaagatcgaatcaataaacaatcacgcggtcaacgatcttgcatcatccttagaagatcattccagtgttaaaaggtctcctctacctgtcacatgtatgtatatatacgtgaaatgattcgttggactccgtgaaatgtgttgactttcctccccttcttcccaagttccaacccgtgcattgcatgcatctccatcacaaaccaaaaaaacacctccaaatctttcttttttgtgattttggactatttagggtcatgtgttcacggctaagtatccaatatcaaaatttaaatgtaccaaaaaaagttgttcctaaattgttggtttgcagtgagtgtggtccaaacataccttacaattgttccctaaccatattttgccacatttataaccaatactttagcttaaaccatccgtggcaaattaatcatgtgttaaaaaaacattctaatatctttaactttttagaggtatcttaaattaaaatcaagaaattgagatcaaggtgtgtcgctagtttccgctttgatttaaaacatgtgtgaagagacatattcgtagggggtgtgagtgcggtgtaaatgtgcgtagtggtgtgtatcaataaatgaaattaaactaaaaaatcaacataatctcacttgaccttttatcatctttctcacaaataaatatattactccgctaaattaaaattttaaacaaccagaagagaaaaaaaaaaccatcaagccgccggcaccagccaacccaagaacccaaccataaaaggcgcgagtcgcctcatctctcattaaaactcaactaatttaaactggagcagtcaatcacctcctcctcctcctccgccgccgccgaggacgacgacgacgacgaggagaagctgatcgtgatcgcgcgcgcatggagccccacatggagagggcgctgcgggaggcggtggcgtcggaggcggagcggcgggagctggagggcgtggtgcgcgcgcaccacacgttcccggcggcggagcgcgcggcggggccggggcggcggccgacgtgcacgtcgctggtggcgcagcgggtggacgcgccgctcgccgccgtgtggcccatcgtgcgcgggttcgccaacccgcagcggtacaagcacttcatcaagtcgtgcgagctcgccgccggggacggcgccaccgtggggagcgtccgggaggtcgccgtcgtgtcgggcctcccggcgtccaccagcaccgagcgcctcgagatcctcgacgacgaccgccacgtcctcagcttccgcgtcgtcggcggcgaccaccggggcgcctccgcaactaccgctccgtcacctccgtcaccgagttctcctccccctcctcgccgccgcggccgtactgcgtcgtcgtcgagtcctacgtcgtcgacgtccccgaggggaacaccgaggaggacacgcgcatgttcaccgacaccgtcgtcaagctcaacctccagaagctcgccgccgtcgccacctcctcctcgccgccggccgccggcaaccaccattagtgattgatcatggtgtagtatatccacatgcatgcgtgcattctgcatagtgttgcttcttctttttttttcttttttgcttcctttttttttctctacctaaaagttgagtaaagagatgaggtgtttataaattataagtttgaaattatttacttatatgtgcaattctgatggggtgatgacatcaaaagaggatgcaatgcaagtttggtgttagttttaaatttgtgtgtgtgtttctatatatatatatatatatatatatatatatatatatatatatatatatatatatatatatatatatatatatatagacacacacacactagtattaattacatcgttatcttgcaatgtcatcatggttattggtacttctctttagtttgttttgtggatctataagatttggtagtgtttactcatacttttgaggaatcccttttctgttatgctttttctaggctcaactaattttcagttggaaaaagatcgatcacaaaggactgaaggaagagcaaacagtgcaagttggtgttcattgctaaaaggattgttttttcttcttggatatattaatgcaatgagcctttcatgtgcttcatttgataactttaccctcattttctagattcaagttagcggacctcacgatcgatatcatcaatcatcgcattgaaaatcttatcccttaatctgcattggttgcacttatggtttataagctgagaaaaaaatggcaaagcaacaaaaataattttagagcgacttagagcctgtttggattagggactttttttttgttcatctcacatcggatgttgggacactaaatataaatattaaacgtagattagtgacaaaacccattccataaccttgtactaattcgcaagacgaatctatttagcctaattaatccatgattagctagcctatgtgatgctacagtaaacatgtgctaattatgaattaattaggcttacaaagtttgtctcgtgaattcgctctcatttatgcaattagttttg

SEQ ID NO: 67668 - DNA, 5362 bp, Oryza sativa
gacaaggcgggatcttgcggcgccttcctccaggggatctcgctcgccgcggccgcgcctcgctcgtctcgtcgcccaagaggtggaagaagaggtgggattttactcttttttcttttatcttcgtgggtggctctgggcgtagcgggtgggcactaattaaccaaagattagtgtagtaatcaccgggtgtttagtttactgccgccgctgcgtctgtctgtccgtatgtgcgcgtgtgaggctcgcatccatgtggcatctgggcagcggcagctgcagcttctcctccccactgagcccttttgtcctcactcgcaggtggcccttgccctttctctcttcttcttcttcttctctgctgctgctgctgctgctgctgcatacttccagcatccagggagtggctgcctcctggctttccatttgagccgccttcgattctgatctgggaccgaggagcaccccgcttccttccttcctcggttcttggccgtttctttggtcttctttgggaggtgcggtgatggagttctgcaagaattttgggagtcctgtgtttgttgttattgtgattgctggttcgggtgtgttcatttcttgctgctgatttcttggatgcagggatcggagaggggtgaagatgtcgggtgctgctctcgtcgcaatcgcggcctccatcggcaacctgctgcagggatgggacaatgccaccattgcaggtaaaaaggttttacttcccgtgtcgtgctagattggttatttggttgagagtttgtgagtactaggaaatatgaacagctgtcaattttttcttaattatcagtgttggtgtaccttctaaatttttcagattaatagactgctttagatcagatgtttgttgagtgctaattatggtcttctagtaacatgtctggtgttgttgtttgagtcctaagagcaattggcacaattgtttatcagcaaactggatcgcatgatattaatagtctcttaatttttctagatctgtactaatcttattgaagaaagagatgttctaatcataattgttagctattgtgttgtctgttgaatcattactgtttgccattctttgttctgaacacctgtaaagattgttctatccaacaagaaagtgtaaatgttaacaaggcacaattattaaacttcttcaggtgctgtactatacataaagaaggaattcaagctagaaagtgagcccactgtggaggggctaatcgtggccatgtcactgattggtgcaaccatcatcacaacattctcagggccggtatcagactggatcggccggcgccctatgctcattctctcttcaattctctacttcctcagcagcctcatcatgctatggtccccgaatgtctatgtgttactgctcgcacgccttatagatggattcggcatcggcttggctgtcacacttgtacctttgtacatctcagagacagctccttcagagatcaggggtttgctgaatacactgccacagttcagtgggtcaggagggatgttcttgtcctactgcatggtgtttgggatgtcactgttgccgtcacctgactggagaattatgcttggtgttctcgcaatcccttcgttgtttttcttcggattgacaatattctatctgccagaatcaccaagatggcttgtcagcaaagggcggatggctgaggcaaagaaggtattacaaaaattacgtgggagagaggatgtctcaggtatgttttgctgaaaattttgatgttcatttcacccatatttccagctgaccagtttaaaaacaatttctcccagattctaaactcatggttaatactagaaaacatgtgtggcattggtaactgttaatttcttgacacgaacttaacatatgcagaaatagtgtatttttgaaaaaaaagggtaaaagaaatcaaaatctattaagcgccttctatcggtgctcttttgaaaaagcttatgaatcttcaagtaaaaattactaagtacacataactacactaattcattttccatagaaggcagaacatggaatgtacaatcgttatctcaccaggtagagcccaaatgaggtgtcccaactttttgctgagtcctaatctggagaaaaataatcaggtgatctagatagacatcgccctcttttttttttttttggtaagggtaactctagaatttggggggtgggacctgctggtataatgtggatgtgggccgacccacgggtccttatctactctagtttaactaaatgaactatattttgcttttgagattttaaaagtgaaattaagtccatctagttgacctagagtgggtcaaggagccccacagcggccatgcctaacaacagtgattgttcagaaacgttagtaatgatttatccttaagttcatgctttcctcaaactaattacataatacatgtgtcaacatcaaaataggcatatgctgttagcaagtggtttctctattttctcctctacaacagactaaatggacagtattcggttggctgagagcataatattgctgttattttaagttcatcgaacttcgctgtaagctggttgtccccagctgcactatgctagctttctattaaagctgggcccttatatttctgttatttgtttctggcacaccattcatatttatattgctgctttattcatagttactacttatttatgccaatgtttataccaatgtccaaataaaatcatgtaatctacgtgaaaaaataaagttgcataatcattcaaattatcaaattgcgcaggagaaatggctcttcttgttgaaggtttggaggttggagctgacacttccattgaagagtacatcatcggaccggctatagagccagctgatgagcatgttgttgatggcgataaggaccaaataacactgtacgggcctgaagagggccaatcatggattgctcgaccttccaagggacccagcattcttggaagtgtgctttctcttacatctcgtcatggcagcatggtgaaccagagcgtgccacttatggatcctatagtcacgcttttcggcagtgtccatgagaacatgcctcatgctggaggaagcatgcggagtacattgtttcccaactttggtagtatgtttagtgtgacagatcagcaccccaaggttgatcaatgggatgaggagaaccttcatagggatgatgaggaatacgcgtctgatggtgctggaggtgactatgaagacaatgtccacagcccgttgctgtcccgacagaccacgagcgcagaagggaaggacattgcacaccatgctcatcgtggaagtgctctgagtatgagaagaagaagcctcttggaagagggtggcgaggcggtgagcagcactggcattggtgggggatggcagcttgcatggaaatggtcagagcgagaaggcgaggatggtaagaaggaaggaggatttaaaaggatctacttgcaccaagaggaagtgccaggatcaagaaggggctcagttatttcacttcctggtggaggggacgctcctgaaggcagcgaattcatacatgctgccgctttggtaagccaaccagcactttactccaaggatatcattgaacagcgtatgtccggtccagccatgattcatccatcagaggcagctgccaaaggttcaagctggaaagatttgtttgaacctggagtgaggcgtgcgttgttagtcggtgttggaattcaaatccttcaacaggtagagatgataccaatttcataattcttttttgtactgtccaacattgacggtgtttaagatttgtgtactattaagaattcactaattccttttatgttctttccttgtgcagtttgctggaataaatggggttctctattacactccacaaatacttgagcaagcgggggtggcagttctcctttccaatcttggcctcagttcagcatcagcttccatcttgatcagttctctgaccaccctactgatgcttcctagcattggtttagccatgagacttatggacatctctggaagaaggtactaacttgtttccttggtttgcatcatcttagtactaccaaatataccaaacaagaaatgcacccaagttagtattaattacatcatacattgtttcctttttaggtttctgcttctgggcacaattccagtcttgatagcatctctagttgtcttggttgtgtccaatgttatcgacctgggtacagtggcccacgccgcactctccacaatcagcgtcatcatctacttctgctgcttcgtcatgggattcggtccgatccccaacattctgtgtgcggagatcttccccactagggtccgcggcatctgcattgccatctgcgccctgacattctggattggtgatatcatagtcacctacagcctccctgtgatgctgaatgccatcggcctagcaggtgtctttggtatatacgcagttgtttgctcgattgccttcgtgttcgtcttcctcaaggtccccgagacgaagggcatgccgctcgaagtcatcaccgagttcttcgctgttggtgcaaagcaaatgcaggctacaaaggcctaattcttcagcaactctgctttcaatctttatataacactgtaaattggaatctgcaagatcacaccatgaggctggaggagctttttgagttgtaaatgagagaagaggattgctattcatgctccttatgcaagggaaaagagttcattactggcacagggcagctgtaaagtaggaaattttcatgttattcatgtccacttcttgtttatttagtactgtgttaggtaatgttgttattcatcagtagttgctgctagggatgttcaaaaataagcttgctaatctgattttgagctactatgttggggttcataataaagtaaattttctgtgtcaccttgcaagcttttgcactttgttgtaaattgtatggggaagtttatttattaatggtgccgctctaaaagcaactacagaaggctctctggtgtacaaccgatggtgattcttttgttcagattttatgtcatcacagttacaaggagtaaaaatgactgttggactatgaagaaacagtaaatattttaaaacactgatatttttgcagtgcatcaacaaattacaaaaaaggattggacttgtactccatttcattgtgaaaaaccatttcattcttcatactaaaaatatccacaaggttttctcattctttgatatcaatatagggcacaacatctagccagtgtaagcttactatttgcacaagaaaatcagatggcagcttgacttt

SEQ ID NO: 67669 - DNA, 4771 bp, Oryza sativa
tcctataaatatttatatcatgtacaaatttgaatcatgcaaatatttaaatttgggaccgaagggagtaaactagttgagtttggtctccatggctatcgatcattgatcatggtcgtgattttcctcttgtgatgcgtgccatttgatttggtccatgatccaggaaaatattgtttgtgatggaacaggtagcacatgttaagctgcagaagctgaactcatgcatgcttgcttaattacctgttgattaatttcagatcttgttatcttgtgctcccaagtctctgcttagcatcattttattgaattattgttcaaataggagcaggagatttggttcgtgagctggaaagatctcgaaggagttccagagggaaatgctgccactatttttcagtaactccagatcattgaattatttattgcagagacctgacgacaagatgacatatcttgtggccaatgtagatcttgatatggcctggccccctcattgtgttgttgttttcaaatcacaaatcactctctggtccattgattcttttatgggatccctgcaataatttcagaaaatgaaacttctgtctgcaggttttctttcctaggctaagcgcttcagttgcactgcactaggacagtgctcactgatcagtttttttcttcacttctactcctagctgaaatgcttgaacttgccttcacgatctcaatcataaaaccaaaaccttatacttccttaaaaacggagtcatccgctcatcccctttcacatctcacatggcgtgcaaccatatccccaaaaaactgaataaccacgcttttactctatcacgctaccaacccatttccaatcgtataggccattggcctataaaaataattattgttagataattaaagtttttattaaactcaatcgattacattaaggtaatacaatttttgtgatatctgcataactaagatgcacacaagcgaacacacaaaattaaccgcaatagtaatttaatgtccgcaacagtaatatacgggtatcttattagttatataaaagtataacagcttgctttcacaattctggaaactcttgtgaaaatatctcggatcaagaaagcccctgattggagcacgcacgttctttcttgagttttcagtttggactaatgacaaaagaatttggccgattatcctttcaatttggaggactgatgacagggaattttcggactgcggttttaattttggactaactagatgggtacctcgcgtattgttgcggaaaaattatgtgataatatagtagatattaggtctgttcggtagtgctgaactgtggttgtacagccgcagcgctgctgcttccctagtatctttcttgtggtgggactgtggctgctggctgcaaggcagccagctagtagcgctaccgaacacacccattacttctaaaattttctttcttacctactatataatttttctttcatgtgtttatatttttttacctttatcaattatacataggttataaatgattgggttgtatggtgtgtcttttggagggaataaatgaaatttataccttttatgaatcatccaaaaacttaaaaacagttgaggtgatgtgaagagatgtaatttacacccttgatgaatcatccaaaggctaaaaacaattgagatgatgtgattttatgagagaaaagagaattagcattaactatacttagtggggatgaactttatatatatatatatatatataggatgacaaagaggtttgctcattatggcttccttattagtattattgcaagggagaatcagttgacacagagttagctcgtatgagtaatcggcgtcagattttgacgtatgtttttctgccggtgtttggtcgtcatgtcagttaccaaattaaaaagcgtcagttgcttctggtgatgggaacacagcttatttctttcgtcagactgcacgctactacgcttctattagatttcttgttagttttgcattcggcagaatggctgttgctgaaccttttgcgttttgttgttgccgtcactatccgctttacagatattcatggagcgaaatttgaagctgttgtatgtatggccatctgaagaaaccatatgtcatttttttgttgatacctctgcctaaaaaatgcaaatattatcttagttattacctaccgtcaatacaactaatgcaaaagccatgatatcataacaagatgttgtcatctgatcggagtttatcatttttgacatcttcatctcagctcgtattattatttaccccgtctttttttttcaagaaatggacacatagattaacggaaacgcttcccgagctcttaagggtgattactagagtaaatttcattaaatcccacctatttatgcatcaagttgcacgaaatgttaggtattttggcacttgacatataacctagctttatgattctaaagttttagaaaaccacacggtaaccattttgatatattcctatattaaaatagaaaaaagaatggatgtagcatttataggatggataaagtgctaataaatttgagaaatttgagaagtgattgtaactgtaaagtacggtatatcaaagttaaaataattattaatgtggttttgtgaaatgttatgaccttaatatctaagcttacgtgtcgcataccaaatttcctgtggatttgtgaaacttaaataatggatgtgattttatgaaatttactatggattttaaaactttctatatatgcgcagaatattgtttaaatttatttttcaactttataatagtcaattcactcatacgtacccttaataattattataaaataaggtcaccatatcaccaaacaccaagaatttagtgagaccagatatttttcatccgtccccatatttttgagcgtgtataaagtgaaacaaactgacagatgtttatgtgtacgtcgaaatccatgagaaaacatatgaaaggtttgaccgaaaacagcaccgtcatttattttttgttctcctggggttgtaataacatcgtgattctttctttcaaaccaaaccgtactaaaatagccaccgatttcgtcattctttctgaccaaagagagtttaaaaacccataaatttcactatggtcccaagagatttaattagcgaggaccatggtctgttctatactactattttgaaaccttgccacgttgtgacgatctggaagcacaacttctcttcccctgtcattcggctccacgatccaagatctccgaaaatttgacatttttactctttctaaaaacttatttaaaatgtatttcctgaaaaaacttcaacaataaatgaacctcaacccaattaccaattacacaaactataaaagaagttgaaatgaacgtaactcaactggttagatttcttatggtgaaactagcccatccaaattcaaattatagatttaacacgtgcttgcatttatgactattttcttttagtgctagttaacgtatttgtcgatagcaagatgtccgtgattgcttcatcaatctcaagatatactcttttggagatacttatatagataaattacatgcgtatatgtttatagggatgaggttttgcgcgctgtgaacgttacatttgtagcaatgtttctggaaaaacaatggaataagatttggccggattcgaggggattccatcagctcacatgcactgttgccacgagagcgaatcctgaccgtccaatccggtggcgttggtggctagaaaattagctccgcagggcgtcttcgaggcggcagcggcagcagcagcttgcctgagctgacagatgcatgtctgagtatttgagtattggcgtttatgtgtgtacctatttcacgtaatccttccgtcgtaaagattgggctacatatctcatcgtagtaccgaggttgagttttttttaacgggaggagtaatcacgaggaaaaaaggtttgatctaaaacaacaccgccatttttagcgattattagcgctttcaacgcgtgtacactcatctctacaaaaaatacgcctatctctataggcataatttgtacctgcatatcataaaaaataattacccataagactaaaagaaacccataaatttcacaatggtccgaagacatttaggctcagtggaagaaacggctgggttaggaactaatttctcacgaacacacaacagaatgacttattaacgaatgattaattaagtattagctattttttttaaaaaaaactaatatagttttaaaacaactttcatgtaattttatttttaagaaaacatattgtttaacagtttagaacgagacagccttattactgtacaatgtaaggaccctggtctgttgtacagtatattgtaatcttgccaagttgtaacgatctggaagcacacactcttctctcttccccgtatcatccggctccacgagacaaccaacaagaccaaaaactttttttttttgggggaaaacaagaccagaaacttgatgagaaggcaaaaataaacccagaaaaaaaaacaaagggaaagatttggccgagttcgagtggattccatcagctcacatgcgctgttgcccgccccacgagagccaatcctgaccgtccaatccgcggcgtcgctagctagaaaattagcggcgcgtcgtcgaggccgcggcagcagcagcagcttgcctgagctgagctgacagatcagtcgtggg

SEQ ID NO: 67670 - DNA, 1601 bp, Oryza sativa
ttgtaagttttttaatagttgcaaggtgtatttaaataacaacaatcaagtgtacctggcgcttgaagtatgtataaatttagatagtacaaatgtaggtatacaactgactagatatatgttgtgcctaaagttttcttttatcatataaaagtatcgcagcaacgcgcggggtactcattccaattttcccttaaataaatgatccattcatgccaaaatcgatgtgataaaaaaaatttaactgggccgggctgagatctacaacaaccggacgggccaagagtccatgacaaaatttccacttggaagtggagactcaagcggcccaatacatacattacaccgtctcttccaaatttttctagctacgagtagctgttagctgctatgctgtacgtacgaacattcatggacacgaagctactaggtgtacggtcacaaggacaggtccaagctgacgacgctgctaagcatggccggagtactccgccgcgagcagccaccggcgacgaggctcgtcgtcgacgacggcgacgagatcagccagttgctgctgctgccttcgctgcagcagtatgcgccggcgccgccgctgctccggcaactgagccccgagtccagcgtcagtgacagcgagagctcgtcgccgtcgccgtcacgctcctcctcctctgccgccgccgtcgtacgcctggccttcctcccgtgcctgatcgcgccgttctccggtggtggcgtcgccttgtgctcctgcagaaattgcacttaatttgagtgattgagtctagctaggagaggaagatatgctgcagtgaccaaacgataaacaagagaaacatccgggggttttctggctagctgcataaggtggtgagctagatgacttgaactcgaagcctcaccccttctaattatttaatattaattatttaatattagattattctctaatattcgtgtctttaccaaacgacaaaaaaaaaatgcacacacaaacactttttcagtgatgagctagctatatacttcctccattttaatttataagatgttttgactttagttaaagtcaaactgttttaagtttgtagaaaaaataataacattttcaacccaatttcaacccaagataaatttattatgaaaatatattcaattattgatttgatgaaattaatttagtattatcaatattactatatttgtctataaacttagttaaatttaaaacattttgaactgaaatggagggagtagctgtaaatatacctcgcgagagccacgccttgtcgtcgtcgccatcacgacgaggcccagcagccttggcgggtcgtcgtgtccggcaccgtctgcggcggcaggtggtgcgccgtgcgccatgggcgtgtagtaggagtagtaggcagctgggacagggaggccggaggacacgtccctctcacatattccttggcttctgagaaagcctgtttgggtgctcgcctctgctcgtctcgtctccatctcatttggcctgcattggtgcaaacgaaattatttttcttatagtactattctagtatgaggttacactgcacagtgtttaagatgatatctcg

SEQ ID NO: 67671 - DNA, 1967 bp, Oryza sativa
ctgtggagagaacagagaattcaagcagcagtagtacttactgtgagcgggcgaccgtgatctgcgcctcgagcgtcatcaacttcccaatctgctctgctaatcaatacggagtactacactacaccgtcacacaaaagtgcacatgcaaatgcaattcgatttcactgcgcccccggttcttcaatcgtaagctgtccccggctctgccagtcctaggcaattaaggggaagaactgtggcagtactcctccactgggacactactagagctagtgtggcctactcaacctaactagaaaggttatatttttaggttattttttttacggagtgagtgtctttatttaggccatgtttaaatctcatcctaaaatttttcacctcgtcacattgaacatttgaacatatgtatgaagtattaaagataagcttaaaaattaattaattacacatattgcgactagtttgcgagacgaatttgtttttttagataatggaataaatattccggcctttactcattagagctacagccagttattacaaggaatcatacaaacaacgaatgaagttcaaataaaattaaacacacccaacaataaaaaaaccaaactaagaaaatgagcacacatttattcaagtctatttgtgaatctccatccatggttcgcaaatatttgcataaccgtcgtctccagtttacggcatgcaacattcgtaaactctccatcatcttcacgcttttgcagctttacctaaaatcggagccaatatgttgccttcaatattacctgcatatatgagatagatggtgatttgtcaaaaactatatcatttctactcatgctccaacaagtatgagtttactcattttcttgtcaaccccaaaaaccaaccatcaaacatatcttagatatggtaatagggaggtttaaaccaaaagaaaactgtactattctccaaacaaattttgcataatgacagtcaagaaaaagatgttgaatggtctcattttttatacagaaacaacatcttaaactgccattccagttccgtcttgccaaattgtccttagttagcaccacccctttaagtaagtaccacataaagatcttaatcttaagtagcgagatgaatctgttaagcctaattgctccatgatttgacaatgtggtgctacagtaaacatttactaataacgggttaattaggcttgataaattcgtctcatggtttactaacgtattttataattattttatttattagtgcttaaacaccctatacgacaccctatataatatctgatataacacactaaaatcttacaccattcgatctaaacaccagtacaacttctatggcaggaatgcaggatgccactattgctgaggacgacgtaaaaatagcccaggaatccaagccgcagctctctctcggctcgggagcccaagaaattctcgccaatccacacccgccactacaccgtcgcagcgcacccacgtgacacgcagccacagtccatcccccgttgtcccgaatccaacgcccggtcccgctgcatgttcctgcgctcagtccagctacaaccgcagctgaagcagcctacactcgccaacaaaagtactaccacctcacgagatcgatgtttgttctcggactctagtagtcgtaggcgtactccactgacgtgaggagtagtacacggagtgctcattctgtcttaaaataaaatcaatttttaaagtttgatttttgtcttaatttgtatcggaattttgactctgaacgatcacaccctagtttagtttgttcagtgtactgtattatcccaggggagtaggagtagattttagaacattcctgtttcttttagtcgcacagtgcaacgccagctcgcactagggcagcgaagttcagcgcttagtacgactgtactactacgagactactactacgacgac

SEQ ID NO: 67672 - DNA, 582 bp, Oryza sativa
ggggttcagttgaaccccaaacacttgttaggaatcatcaacctgttactattattaaggttaaggctaatttctagaacagaagatagggttaacgcaaattcgagaaaaaaagtgcgtgggtagagagagagagatgggaaagaggatgtaccgatgcggcggaagcagcaggatgagcgacggcgaccctcgctcgctcgcgcgatggatggggatcggagcaggcggcggtggcggaggatgtgctcaccaggatgcggcggaagcggcaggacgagcgacgaagccgtactcgctcgcgcgatgaatggggatcggagcaggcagcggtggcggaggatgtgctcaccaggatgcggcggaagcggcaggacgagcgacgaagccgcaatcgctcgcgggatgggagaaaattgacattttgccattgtcaaaacggggtttcgctcgaatgccactcccaaaagtggtttcgttaaaataccatcctcaaacaggggcaacatgttgtaatgccattttatccatttcttctcaatttaatgatttttgtagtgttttttttgctgagatgactaa

SEQ ID NO: 67673 - DNA, 2456 bp, Oryza sativa
gcagtatgcaggtggtgtgtgtgtttgtctgcgtgttagtgcgtttctgcttagaggcccgtgtaattaacggaagctggcggtgtgtttgggtggttagtgtggccgcgtactctgctcttcttggtttaactaggagctagtactactatttttggtgaatgggaaggcagattctgtactattatttctaacaccacgatttgcaagggggaaagagtgcttctttgccgttttggtgcttgctttcatgttcttcctctcgttggcgttcagcgttgagtggcaaagagtgccgatgcctgtcataagtgcaactcgagtcgagtgtatgcgcagcgaaattagtgaattagtgtgaagtggttagtactgaatcgaaagcttacgagacataagagcaagtttaacagtataagccaactaccagctccaattcatctatagccaatctaatagcttattcatacaatagttatatactactccctccgtctcaaaaaaagacaaaccctgatttccgtgtccaacgtttgaacgtccgtcttatttgaaaaaattatgaaaaaaattaaaaagacaagtcatgcataaaatattaattatgttttatcatctaacaacaataaaaatacgaattataaaaaaatttcatataagacggacagtcaaagttggacacggaaacccagcgtttgcctttttttgacggagggagtacactattaatatttggtcccacctgtcatacacacactgcgtcttagagtccgtactacaactgactataaatctgtagcccgctgctcttctctttccttatttatcttcttaaaatatatttacagctggcttatagcctgctattgtaactgctctaatattcccatcctcttttactccataccacgatgaaaagaaaaccgacaaaagagtatgccgaccagctacagtcgacctagttggcttgatgcactgcaagaattcgagaaactgtaattttttcaggcactggtttatgctgggatggaagttttgaagtcagtatatctgttttctctgcaatcctactccagtggtatcatttttttcttttctttctactgcgttcgagagaacttcaattcttcaaaaaatacacctatcgttcaatcatgaaggaaacacaccaaccgcgctcgaagaaaagatggtaatgcggttaccgggcttggaagaaagttgaagcggagttggtctgaattctgaaaccgagctaaagcatgaaggccctttccacaggggagttgataggggcggcgactgaagtcacaaatcactttgggcgaaaggcaagacaggaagaggacatgaacccacaacccaccgggttgttactgcagagaaagcgaaggaatctgccttcccatcaatccattcctctccgtaagctctgaccttcctgacgtcaaaaatcatgaatgccgatgtgcaacggctgtagtatagtccaatcgttcttggcagggctacgatcgagctgatcagctgagaaagttgacggtactctgctcggactgaaacattactgctaggtcaactctaattctatgccctttttcctaggactaaatatttttgtaaagaattcctaaatggagtcctcctagaaaattttccattccttaccgaaaggctcgaactttgcagaactcgtttttgtcgggcagaaagcaaatcccggcagtaattgcagccatgccactgagaggctgacaggtgatctccatgtaatgtaagaatatgaggcgtgatcctacgtacgttgctcgcatcgcatctcgcacgctgccatcgtcaaccgcgaaagcaacgttgcttgttcggccatgccctgacggcatgaaggctgccatccgaaacgggcccaattgaattggcctatcgttcgcaatgattcacgaatcttgttggggtgcaacggcgacgatctgtcacgctcatgcacgataccagttctggacagtggacactcgtgaacatgcatggagcagcagattcagctcaaacacaaccaaagcgatcatgaaaatggtccgacatcatgaaaatgggccgactggaggagcccaaggagtccagcaagtgtcttctcaaaggtaaggagtgctcctttcagcaaagcccatcgtatctcttagtattatattacggaataataggatgtgtactatccaatcttagattatattttagaataaaaaagtatttaagattcggcttaattaatttatttaggattatatgcaaaataaccatattggttgtccgttggcgttcgcttcatgaacaaataatgtcagtgttcgttcgaccaagtgacgttgttctcgcgtggtcctcgttgccggtggcgcggaggccgagcgcatcctagacgcctggggacgcggcgatggtgttggggctgcatggca

SEQ ID NO: 67674 - DNA, 1494 bp, Oryza sativa
cccggcaagctcgccacgtatacgcgtactgcccagattcccccaatccagtccccccaccaaacccaagcccggaaaccctctcccgcccgacacgtgctccccccgccaacccgtggtgcacgcttccgagcggatatttccgcccccgcctcggctgcacgtgtcggtctcctcgcccggcacctggcgcaccgtgaaaagcccagaatccggcacaaaaccgcggataaaaaaatttgtcgccgcagcagcacgcgcgggcggggccggcacgacgggggaggagacggatgcgcgacgcgcgtcgcccccgaaccgcccgactcgcgcgcggcgagcgacacgcggccggctgcgcgggcgccgtcccgaggcgggtgggggcgcgcgggcgcgggcgtttttttccctctccgggattcggcactgacacgtgtgtacctccgccgagtcggtctccccgcccatgaaaatggcctgtttcccggctcgtctaccgtctccccgctcttggggcgcctcacgagtcaagccggcagcacagcacgcccagctgctgtcgattaggaaaggtggcgatggagttaagtaatgtgacgtctgacagcggaggctcgtgtaaacaatgcgtgcgatgcttgattgatgcgtgggacgacatggacacccagaaatagagaagcaaatgcgtgtagaaatggcaactgccgggtcgtgtgacccggattttgtcaggtcgtgacgaacagtacccagattgggtatggattaggtggtatgattgagatgccacactgccttactagtgctgatgagatacatccttacgtttaatgaaagagctaatacttgattttgttgaagcaaggagattagagacgggggatatttggacgcagaaaaagttgctgctcgatgggttatgactttagctttggtcgtatctacgatccatctagcccgaggatggatatagggatcttgaagctcgagtggtccatttgtcaagcgcgcgaccgtgacacggctgcctgggcggtccgccctgccgcgacaccacgcctttcggggagcacgagaagcccccgccacggctgtatatataccgcccctcctggcgtctccgcctccgccgcgttgcgagctgcacattccgctgcttgcttggcctacgtgcgtgcgaaccgacccaagtacccaaccccaagatacctgtgcgcgcggcgctgtggcgtgacgctcgcgagggtgtgaagcgatgagcggaggcacgcggaacacgcgccagttcttcgaatcgtcgagcagcggcggcggcggcagaactagcattgacgaagggaggggcgtccgggatggtggtggcggtcgcgttgcggcggcgcggggcagcggcgtgaacacggggatcctggacgagcacgtgctgtccctggtgttccggtcgatcaactgggacccgcaggcggtgtgcacggcggcgtgcgtgag

SEQ ID NO: 67675 - DNA, 5382 bp, Oryza sativa
gctagctagcagctcgtatcgtatgcattcatccatgactggaaagatggagtgatttaacaagaagatggcagcgaaatagatacacgatctgctagccctatagttcggcaagaatgaagcctggttgttgaagaaagtcgcacgtgagaagtttgccgtcggaggcgagccgatttggctctccctcgtgagccagttttttctcgcccctgcaggctagctcgccctcaaaagttaggattttttcacgattccaaacacctggtcttgcctggctaggctaggcttgatctagccttggatccaaacgcaccctaagtaatttacaccatttctttccttacccagagaatccatcagggctgataccaaatctttcttgttgccttttacaggaattcccatcatcctttaaattcacaagaactaaattagagaggcaatcaattatcatcgactgaaaataaacgaaggatgtgggtatgtggtaaatctaaacctcgtgatttccctgagctccttcactgtcatggattggagtcgatcggggtcattcctaagttgctctatctccaatttgctttcagcaacatcctcctatagtcaaagcaaataagtgatccaaccataaacaagttacagtggataatgccacctgtttagtacaaagggcataaaaaggctaaccttttcaaggacatgttcatcatctttcttgatatcagtattcttagaggcagctcgacgcgaataggtggctcgtgtttctgccatcatcaagcttagtcttatcagtgctagtttgctgggactgaaatttgcgcttggaagcccacagccacacctacagtcacagaaacaagtttcaagtgattcttgtgccaaggactccaaatgcagaacaaaagcacagaatttcctcaatgcaaagtggcagaaacgccacagcgtttgacagcgccctgacctatccgtactgctaatatgagcaaacaagagttaactgtgagcgattcctaaggggattctttttttttttaaaaaaatgatgcatccccacaaatgcaatgaactcaggcctagtacgtagcacatttatgcgacaccgtctagaagaaatttgggaactcggatttcgattcgtcaccaaaggtaaaccctaggagcacgacacccgtatccagaactgctgcgcatcgaaccggcacgggaagaacaaatgcgcgtaagagcggggagagcaggagaagggaggggggacgggaaccgtacccgtagagacggaagagggagccgccgcgcaggagcagcggcatgggcgggcgagctagggcgcgaggcgccgcgacgtggccgcgctaaagaagggaaggggagcgtggcgatgcgcgccgtggcggccgggccgtgccgccggtgagcccccgcggagtctctcggtgctatccgaaatggcccatcttggtgttaatcggttatccggcccggcccatgttggacgagaaagcggtttctctgctggccgtccgatggtaatcgtgtggatcgtactagctcgagattattcacacggaatgttttctttgatctgcgcgtagtgcagatagacaaccaggaaaaggctattcaattcaatggagtttgtaacaggcgactggccgcacgaggtatgtaaacagtgtatcctgatgtgttccatgggtgcttctctcacctgttgttttcaggcaaactaacatcttgttatattttggaagtgtttttatttggcagtagtagtcaagtagagccctgcctttaaagaaaagaaaaggaaggagtaaagcaccatgttttcgtctctcggtgtcatactgttagccaaggacgatgactgtcgcctacttgcctttaatgaacgatgaatgaaaggtgtggtttacagaaaagtatgttatactcgttctcaactgccatcggtgttatacaacatcaacaatttgcagcacaggctagccccgaaagatcgaggactcgtcaaatcaaccgtttgccaaaatttaaattttacaatttattttgtgtgtagttaatttcaaaatatttccaatcagtattttctttttcaaaattaacttttaagtcgctaattacatatataaaaaatatctataaattactttttatcattaataaaccatttggacttgtaacaagctcataactgaaagatcgatgagaccccgagtttccaacaatttgcaacgttgaaaaaaacaacgacgacgacgaatatttggaacttcaacattgatcccaagaagaaaatagatagctagtagtactatttaacacgatttacaatttgaagtagccacgtcatgtctgacgatcggaaggagaagaagggcgtgcgttacaggaggaagtgttgcaagtatctgagcccatcgtcgatgctcacgtacctacactgcgccatcacaccgaacctcaccttctccaacagcctctcctcgctggacacttcgaacaccacctccgcctccaccgtcgcgccgccgcagccaggcgccgggagacaccccgtggcccaggtctcccccgtcgcgccaccgaacagcgcgcgcgccctcgccgccggggccttcgcgtccatcatctcgaccgccaagggggcaaacccgatcagccccgcccgcaaagccgtccaccggacgctccagaactccccccgcccgaccgccgcgttccggccggtcaggtcgacctcgaactggaaacggccggtcttggcgatggcgtcgcgggcggcgacgacgaacgagagggtgttctcgccgctggccgcgaagatgtcgatggcgaaggtgacatcgtcgagggcgaggcgcggtggcgggagcgcgcggcggcgggcggaggcggaccggaacagcgcgaacaggcggcggtacggcgacgagctccggccgctggcgtcgtcgccattgccctgcatgggaaggaggccgagagcggatgggtactgggagcgcaagagcttggaccagaggtcctcggcggtgaaggcctcgcggcaggcggtggagacgcaggaggccgccgcgagcgactcggcgtcgaggaagggacccaccagccggagcaccaaccacggaggttcagatcccagcattggcgccgtcggccgcgcgggctccgcgctcacgccaatgcgcggccttttccgcgcacgcgagaccgagccgtcagcttccaccgccgcgcaagcaagcatatcaatcaatctggaggtggaagggggaaacaggtagcggaaagaaaccaatcgattcgccgaaacggcttgccttatatcgacaggttggtgggtacagcacgacggccaaattggatgagattacggtttcatatccgtagttcgactagtttatcaacctgtttataggcgagtccggatgctgtacgaatgcaacggatatgaatttgaacagcggcgacgggggtggaaaggtctagagatcgatcagcggtgagcgcgcgcgcgtgcgtgcgcgcgggtggcgcacacgtggtccgagaggaacacggtggcgcggcacgagcaaggcgcgtggcgcggagttgccttgggaagaaacgtgccgagaggatggtcgccaagttgctcgttcccatgcaagcgtcgacgaggcacgagggttggacatttcgtcatttcgatggctttgtgcctttgttacttgttagctgttcttctgttctccacttctgcctctctacagaagagatccaatggagcacgattcgggtacgcgacccagcccaatcaaggaggaagtttatttgtccgatttcaaagcccaatggcctgcgattgtatttgactatttgtttttggtgttacatagatacgaaacaagtactgctgaatatccagtattgttttgtgctacaattgtcattttgttttataaaattttagtctccttaattcacacgctcaattttataaacagggagggagatcatgtgttaattctaggatcggggaagagcgacatcatggtttagtgcactgataatatgatatgattgtcataggccgaagcatataaggtgagacttactgaaattaacagattatgaaactttcatgtgtaacaaaagctatcttaacaggtttatctaacggtacagctagtgttccaagttatcattgtctcatgtaagggtgtccaaaacggccaaaccggaataacttaattgccattaatatttgcatccgtagcctgtaattagagaaactattttaatctctcgagaagatatctttcgttctttgcatgtcacgcaaatggttatgaaaaaatttaaaacaatttgagaaggtgtattaacatgtgatataatactccacaaacatgtaaattcaaattcaacttctacattttgtaacgaaaaaaataaattaaaccgcagcttgttaacgtatattcagagtcaaatttgttttttcgttgcgagatgtagaagttaaattttaacttgtatatttatggagtgatatatcacatgttaatatatcttcttaaattttttaataaccatttaagtgacatgcaaaaaatgagagtagatatcctctcgagggatcaaaatccacttcctgtaattaggaggagattattgtgaatttgtgatcgctcagcaacttcacacctcctgagttgcactaccagatcgcacaaacaacaaattgaagcatgtttgtgagaggcgtatttgttgtcagttgccatgagtggtgcagtggcgccgtggcggtcctctcgttccatgtatacttccatgttcggtcattggttaagattcaaactaaaccattcgcagcgcagtttaggctgtgtttagatccaaagttatttcttttccatcacatcaacatgtcatacacacataaattttcagtaacatcatctccaatttcaattaaaattcaaactttacgctgaattaaacacaaccttactatccatacagagagattgagagagaagttaaaactaagacgacttacaaagcggtttattgtccaaagagagggataaaactaagacgatttggccccgtttagttctcaaaaagtttttcccaaaaatatcatatcgaatcttcagacacatacatgcagcattaaatgtagaataaaaaaaactaattgcacaattagagaggaaatcgcgagacgaatcttttgagcctaattagtcaatgattagccataaacgctatagtaacccacatgtgctaatggtggattaattaggtttaaaagattcgtctcgcggtttccagacgagttatgaaattagttttttcattcgcgttcaaaaa

SEQ ID NO: 67676 - DNA, 3063 bp, Oryza sativa
ctccatccgggcctccggaatcgcgtcgccccagtcatcacaaccaccaggcgcggggagccccgcgtacacgcacacgcccatgccgatctcgtccgctttcggaatctccaactcctccggcaccgggtcaatcatcatgaattccgcaggcgcgaaccccggctcgacccgcgccagcacagccgtcaaccggacgcgccagcgttccgcgcgcccaactgcctcgttcatgtcgcccgtgtccaccccgaactggaacacgctgttcttggggccggcgtcgcgggcggtgacggcgaaggagaggacgttgttgctgtcggcctcgatgtcgatggcgaggcccgggggttggagggcccggttgccgggggaggtggcggtgtggggacgagtggggtgatggggtcctctggcgtcggcgccgccgtcggcatcgagcaggtgaaggagcccgagcgcggacggaaagtgggagcggcagagctgcgcccagatcatcaaacatttggaacgcagtttattatccgcatagagaacaactaagacgatttagagcgcaatttattatccagagagagaactaagacgatttacaacagaaacacggagatcgatttacgacgcaaaacacataggtacgttctgccgatcaacaacggttcatcaccgctacactgaccctgaaggctaaaagagaaacgcgcatttcacaggaggaattgctgcaagtatctgagcccatcgtcgatgctaacgaacctgggcctgtagtcaggctgcatcacccagaaattaacctcccgcacaaacctctcctctatgctcaccatgatctccacctccgccaccagaatgctcgtgccgcgcgcgctgcagccaggtatggggagcaccccacgcaagcgaatgccgatagtgaggggcgcaggcatctccttattctccgcgtacaccatcacgaacgccgtaggcgcgagccccgccccggcacgcacggccgtcaaccgcacgctccagcgttcccccggcaaaagcgccgcgttcctgtcgctcgtgtccaccccgaactggaactgttcttgggtccggcgtctcgggcggcaactgcgaaggagaggatggcgttgccgctggccccgatgatgtcgacggcgaaggagacgtcgtcgagggcgagagcgggggcttgacctgctggccgtgggaggcggcgtggaacagcccgaagaggcggcgatgcggggacgagtgggggcctctagcctcggcgccgccgagcaggtgaaggagcccgagcgcggacgggaactaggagcggcagagctgcacccagagaccgtcggcgccgaaggcggcgctccagaaggtgcagacgcagaaggccgccgcctaggacttggggtctaggaagggcaccacgatgggaagtgctccccacggcggcgttgtcggctcgcgcattcctcgacgtgcttcccagtggagtggttcagacattggatccttgcgtgacaacgggtagcggtggccactggccagtgggggaaatgaagctggctgtcctggctgtgggccggtgcgccgggtggagcacacgtggtcaggtgaagggtggaacaaggggccgcgtggcgcgcgaggagcagctgcctcccgaatggacgtgtcggttgccactatcaatgcagttgatctctccctccaattcattttatcatcatctaagatatttaagatcttgttacaataattatcttttaataagtatctctttatttatttgtgaaataaatgactatcattaaatacactacattcaaccaatcaagattaactcttattgatataattttatataatatttaaaacatgatgtaatacataaaatataaaatggcatagcaccttaaccgactaggatcgaaaaatttgcaaggagctctacaagagctgaatgggtttgggtcccggcacaatacagatgatctctcaaacttgtgttcattattttagtgcaaaaattgtgtttatacaatgaaacagttgcactaacccctgctcaaaagggttgatagaattgcaggtaaggtcaagcctatcatataccgttctcttgtcctgtcatgcattatgaatcatccaaaataaaagctagctaaagagatttgatttgttttatgtgcaccaaatcacactatatcagtaacaattaagtatatgaatgtacttgtacatggccccgttcacactgaccatctcgttaaaacaaattaaccacccaatattctgttaatgtatgatgaccatatctttcgtaaaatggcggaataacctaagttttaaataaatgaggaaatatacttagtagcagtgcacactaaaaaccaatcaacgcccatgctgccaccattaccagtgactcagggtgtgttattttctccatttcctaattttactctagttttcatgtgcaaccgccaaacaatgcttttttttataaaaaactataggaaagttactttaaaaaaatatattaatatattttttaagttttttatagctaatacttaattaatcgcatgctaattagccactccatttttcatgctagagagaaatgttgtgaactcggaggttcaaactcagccttagaatagaccgccgatgaccaaactctcaaattacacatctcaaaagacaaagccaatatcgtctctcccaatgagatcggaagacaaagccaatatcgtctctcccaatgagatcggattattgttgaagagaaagaattgtgtagtctgtaaccataattcaaaagagaaaaaaaaagcatgataattcaaaaacacacataaaattttttcatggaagtttctgtaaaagtttagtttcacacttggagtcagcctgaaatggcctcttttagtagtcaacgacatagttgactttctccatgctcaatgacttctcaatcgccttgggtcctgtttggggagaataagattctaaaaatcagggaagtcaagaaagcttctcctccttatatagtgcccaatg

SEQ ID NO: 67677 - DNA, 7753 bp, Oryza sativa
  unsure (1)..(7753): unsure at all n locations
atgctcttctttagaaggatttaatggtggtaacagtgaattttctacccaaacactcctattgtaaattttacaaaacacttcttaaactttttaatactaaaaaaataaatctaaatggatagccacatataaaatcaaaataaggtgaatacttcccttatcaaatacataggtagcacacttcaaaaagatattttattagtagtaaagcacggatatttagctagttgaaactgaaaaaagaaaagagacatggtagaatccaggatgaaaacaaccttcattcaaaattagatatcactttttcccatcaatctttcacaaaccctgtgaagtaccaccagtacttcatcaacgaatctgaaacaagtataggaaagtggacacagtgaaaatggatagccaagaataatggcattctatttctttttcttttaaaactaccaaatatactgacctagacctaactagcagccaaggaaaggcactaccttaactgatacactggtgctcgctcagtctcctcagtcctcccacaaccacaagtccataactccagagcctagcctaagaacttcatatttgagcttccatggtttctcaatcccagagcttctcttatcctgaaagcaaccgaaaggcatccttttttttctttcagcgtatgatttgatgaagatttgggcgccatctgttcaagtctccgtctcctgacaaaatctgtgacaaagtattcggtgtgtcaagggtggttgttctcttcaactcctcgccaattgctcagttcatgacagacgagctcttccatggcagagaaggtgccaaacaacaccggatagacaaaaagaacattttaaatgttaaatttgaagggtgagagtacaagacatgcctcaagaatgctttcaaacctgggatgcatccggttccacacctgaaaagatctttgcaaaccaatccaacaccatattcatatttataggtcagtcaatttaagcagaacgaaatgaaaggataagcacagtacagagtgagtgcacagaaagcaaaacctccatctggaaggccaattcagatcacttcatgtccacttaagcgtatatcaccattctcagtaaggatcgtcccagcgaccacttctgcaacctccatgaattcagtacagttgctacttgccaagctttcaattccttctagttttctttcatccttctcaaccacactttctgaaggcgcctgctctaaaattgtttgaattggatcattttcaacattgggcatcaagcagccaggtcagctagtttcatcaaccaaaccaatagtgccaactgctgcacagctgttgcctgatacagtggacccctcagatccatgtggtgaagtggagcaattagtcagtccaaaatttgcatcatcatgcaactgaattgatgcttcctcacaagccgggctaactgaagcccttctaacagatttgaatgagtcaacgtcagcacctccaacagaatgatactttcgcttgagctgacccaccagagatgctgtcgttgtgcaaacttcagagtcatttttatcagactggtcttgctgctctgcacatattggcgttggtggacgagttttctggcagccctgttcaaatacataaagggggatctccttcttacggacatgagtgacagctagatccatcccggatttccactgtgtatacattccaatttcatgcataaactcgtctactgttccacggatatcaaatttttgaccacgtattttcattccctctttccttgataagcccatgtagaaggcacagtgagcacactgtattgaaggatctgcatattcacatgggttaggatggcattgcagcatccctttagtgtcccgctcaatctgcatgttagaaagacaaacttgcataagtttctaagtatggaatattcatagacctcattttaatgttcacttcaaataatataaaaattgtagtttatccatatataggagtaataagaaactactgctactacaatacagcaacctttagagtcagctgtctcaatcgagattcaatccatcccttccaaagccgaagatcatcatcatcatctgcaacaatgtcaaccactagatatcttgtatatgcctcgaaaaattggaaaggctcaaacaaagaactccagctagccttgttaagctcaatttcctgcatcaaagataggcaatgagaccatatgcagaatttagtgctctgaggcataaagttgaggcatagataatgcacctgacaaatcttattaccaaactgaaattgctccataataaccctcaatgtgctagttgaaacattgtaactagagttcatgcatggatatgctggcgtgatgataggcataacatgtgatctatcacgaggattcttacgtggatcccacacagcaaagccaaggttatcatcgttctcaatggcacaaagcatcacaggatttggccactgccactgggtgaaaactctgaagaatcttgaaaccagcatacttggcacagcattgggataaagttggcagacacgagcaaccaatagggcccagctgacaccccccagcaaaccagtaacctaacaaggaaaccatttggcgtcataacgattcagcaccttttgatgctaatggttttgatccaagcacaaacacatttaagtgtatcatagatgataaaaccaggcttacattagaataaactcctcttctctgtgcccagtacttcaaacatctgagtgttttccggaagatctacatagcatatatttattacaatgacatggtttggactgtataataagagaaatggtgatatcataattaaattacctccgcatttggaacaagtcgaagaatctggtctgccaccctgcacccattgagacttcgaacagttgcttcatcaacatcacaaagtacagatccttgagagatgtcaaaatcctgcaatggtacattaaaaaataataaatatacaatttaacaagttaaaactccctcatgaagtaaaccatacagattaatgtaaacattgtataagctggcaaattaacttttgcctttggcgtcacctataggctatagctgctaatgctattaaagttagcttagacattatatatgtccttcaacaacacttccaaatagcagccttacatagtcaacacattggttgataaaaagtttcaacatagcagatccatccatagttgcagaaactaatgggataggcaaccaatgaagagaatggaaatgggcaaactaacagatgttggattaggcaatcataaaacaccatctcaagcgtgtgttattatgcatagcatgcatttcagttcatgtacgaaatcctaggaaatgaaaacttactggtggtattactggaagagatacactggcatagagaaggtcaattggtagcccacgaaacttgaatttcataactggtacatgagcatcaggtacaggttgcagttcagtcacttcttccatttctgataatgcgccatatagcatgacaaaaaattcctcctggagaaataatactgttaatgtccatcatgaagacctaagtaatccatagacagcatgcaacaaaaagaagacttcacctctcgtttcacatatgagggtccaatacatagtgcatcaatgtctgctccaggcccatgaacctaacaaaagaggccactattcataaagtacacaaaggaaaattgatctactaggaaagtacttacagcaaccaaaaaatattattaaatacacactcttgttaccgtgagttcccgctgataaacagaaacaccacttttcaattttggcggtttaataatctttaataggtatctatgattttatttgtgccaaacatgaccaggaatgattctcagcaatttgtgagattattattgcactaaacagtatattaggaatgtattgttagagaaaaggatgaaaaactttaaactgcataaatatagcaaattttattcctgttttggcatgttaggcttttagacctatccagtgaaggacaagagagatttctagttattaatcagttatagaaaccataggaagagcttccaaaatacattagtacgtgatggagctagtttcgtttgtggggttttttctgttttggtgcaaaaggtctttctctacccttgggtggttgtgtcgaaataagaatcgtatttcttcttatccactgaagattacttttttattctttctttctttattttttatgggtgttatttgttctttgatgtcagcctcttggacatcttttgcttaggttcagctaagtagtggacaaacggaaggaaatgaatatatggatctttcccaaaaaacaggagttgtccacactatcaggtttccttacaggaaaaaagctaccatcaaccaagcagcatctactacctatgcaatagattgtgaaccacaaatgaacagactctaaattctttctacacagctcttgtctcaaataataattatcagatattgttctactccagtctatcatcaatccagtaaaagctgcacaatttgaaaatagttgctagctccaaagaaccaagctagggtatgttattctgcttgaacaaatcaagaaaccaagtatcagcaacaacagtacttccatagttatattcaagttgtatatatatctaaatggaagctaaaaagactgacaatttcaggtgataacgaattggttgtgcttgactcactctagaaagaaacatcaacatgatcatttaactgtggtagaaggaaaaaggaacaaaaagaagcatttacccccagtctgtaagatccaaaagtgaaaaggactgcatttgcctctttaaccatttgctcactatatcctttctgaatagtgaccttcttcacccattccttgactatctgcaatatcacagacgcagagaagacctcataaaacaacaagaaagggctaattcttatacaaagaaaacaacatgtgagcatatacaaagttaatctgcattaccatgcgcaggtaatggcaagctccaaatcaagaatattttgttcatatattggtagttaggacttttgtgccccagaggaagcactagcaattggtatatcgtactcacgcaggcatcaacacattcatgcacagtaaatcattttggttagaataatataaaaccgaaacaacacaagcgcatgaaagcaatgctgcctaagcaaagtccggcaacaaagtgcatgaatttaagcgataattacatatccccttttgcgcccaccgcctaactcgtataatattcagagatatcaagttacattgggttaacaaataactagcactagccattgatagcaagtaagagtggaagcaacttaattacctgatcaatctcccgaagaacctcctcccgtttcgcggactcctcctccccttcataaaaggccggcttcaaccaagaactgaaaagcaaagttttcttagtgacacaaaagcaacatctatcactagtaaataacatatgcatacacctacgccgcaacacataatcaattactaacagtggatagataaataaccttctccaactcagccgtcttgtggagatcggcgacggtcggcatggccagagacaagggcggatccgcgccgccgccgccgccgctccgcttcggggacgaccgaggcttccccctgaccgcgacgaaagatcccgccattgaaaccaccacggaacccacccaaacaaacacacaaacaaaccctagacgcgcgagattaatggagtctccccccctcccacgcgcagcagctacctacctacctacctacctacctaccactctaccagtgcctcagagaccacgaatccccgccgggatcacggcgaggccgtggattttcctctcacgaaaaaccgaagccacgcgcctcaagcacacccctcccccacccccttggatggcggaatcctaacccggccgggttatccctaccgcgagcgagcgagcgagcactccggtatgacgagtgtgcaaaatcgcgccggcgagcaacggtggtggggtggtggcggcggcggaggaagaaaaaggtttcggttgcgttgcgggcggaggagaagagcatgaacagtggcggctggattaggacacgaggattgcacgtgacaaattttcatttttcctgttaagagtaagacccaatcgcttatatacaaagctgccgagaattgagcctcgaatcagcgtttgccgctggcgtggcccttgccggggcgtgacacgtcgtccggcccttctccggagctgaatttggaggctgcgcgttgcttgcttcctccgtcgttggatgcccatcgtgcgtccatgcctgcccgacgctgatcattttgcaaaaaagcccttaaactaattgataatttggttttagatctctggtatacagtttctacgttctacgttattacgtataggacctctaaaaatgaaatgttctaatcaaagaagcaaaaaacagaaaataggactgcgctcgaaaacatagaaactaaggggcttttctgcaacaacttgcatccctatcccggtccctcaccccacgaaaccctagccgccgccgttccgtcacctctctcttctcgctcgctctccctagaccacaccgncgnatncgcctncggctacgaccactcttnttgcacccagccaaatcgccgcacctcccccttgccaccgcgaggccagttccggcggagggtagaccgtgctcgccggattcgggtagccacgacctccttgccggcggatccggtcacccggaggcaagggcagggctagcacatgaggctcatcggcagtgtcgcggtaagctccatggggaaatctctgctccccaccctcatctttcttgttgctctccttnctaccccctccccctccctctctctctctctctttgatctagagacggcgatagatccagagccactggatctgttgatcttggcggcggcgatgtggcaccaatctcagacatttcgtgtcatcggtgttgctggcttgagctcaatggtgacacgctcagtcagcgaccgacgagtaccttgattcggcggttgcgctggagctccatgaccaggtgctctatccggtgccgcacagctcgatttggcgtgttgggcggtcaatgatgagttcgtcgatccagcgacggttctctctgtctggttgcacgctactctgagtattccaacaccgtgctagatttggcgaaatgagtaatacggtgctgcacggaagcttgaagccgctccgaccggcggcggcggcatcaagcaagagtagcattgtatgcggccaaaaaaggtcgtctccatgtgcctctccactgccaaagccatacaggattcatgtgtatctgagtcccttgctgtcgttgccgccgttatgaagtcgttctcatatgtgacggtgaccagtgggcagcggcacagacaatgtttcagatggctgcctgcttgcctcttaccaccactcctttccttttttgtcatgctttctctttctccctttgtatgtgtgttgcagccttgcaggttctcacaatcatgtatttctgaatttgtgcaggttcttagcaaataactcagatttccttgagcatatcgtttcagaataaaaagcataag

SEQ ID NO: 67678 - DNA, 10127 bp, Oryza sativa
cctcagacagtccaattagagggtgtttgcaattagagggttgcaaacaccctctaattggatgcctgaccaaagcgaccggtaaaagagttctcacagcaacaagttggcatttttgtgagagggactaaagtttagctccactttagtccctccaaccaaacaccaccttactccccggtcccggatcacgattccaaaccctaacgcacgcttcctcttttgattatgcttgttcggctgttgctgatgctgattctaaattttaaaggtttaattttacatagatttctttgcttgcctccttaacagtaattaaaatagagctatatgtagtgaaagcgatgaacgctgagattataaacttgaagctgaacactgagactactagatgtctagatccccctccccctttgacaagttccatgctggagtattcttttcaacttattgacatgtgtgtaactgtcaacttgattaagatacagatttttttcctcgacttttattagcacatttttcaaactgctaaataaatgtatttagtgcagaaacttcctatgtagaaattgttttaaaatataagataaacctatttagtttataataattacaacttaattaatctcacattaagggctttcttattttacgtattatcacttaatttttatcttcattacattcaaacgggacctctgtgccatggttctcgaattacaattctttaagaacttgaagcactttctatatcaccatttattagacagcttgttcgaaacttttttataacatgctgacggagcttggggctcctcaccgggagaccgcgcaggcccccctttgccggttcggccgggggcgctaagtgaggttcttcgccctcgatctgaggaacgtccgcgagagagggagtgcacaagacacgggcgacgtagacaggttcgggccgctgagaagcgtaacaccctactcctgtgttttggtggatctgtgtgtgaaggaatacagagagccggagagcgagagatagttcaggctctagaatcccctcgccagagtcccaacccccctcttcctaggcctgggcctcctttttatctggtcaggggtcaccacatggggctctagctgcctaagaagggaaacatgctttttacaaagagggctagtctacagccggaagtgacctttgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggtagctctcatcattccgacgggacggggcgaggcgtgtgacaggccgcctgttgccacctaacccgcgatctgaccggtctgtgaccggtcacacaccgcgaccggtcacggaccggataagcgctcgctgcgccgcattaaatgcggcgtggcgcgctcgtccaacctgctataaatgcggttaggtgagcccgctgtgcttacctaacccacacacgtggcgccaaaaccacagggggtcggggcgccccagccctcggggccgaaacgggagcggcccgacccctcggggagacagagggaggggtggccacgtcaccctcaggcccgacccccccgagggggtcaggccacgtgggtgaccgcggctacccaagcctctagtcacgatacccccggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcggcaagggaaaaccgaccgacgataatgagcggcctctttaagaccgctacattactcgagcagcgcgcgaatcgggacgagccggttcgtttcgcctggggacatgatgatggcgcttttcacggttggcgggcgtagttaatgcgcgcacgatctgccccatctcaaccgccacggccgcacatttgccacgtgcgccgcaaacgggcgagtgggtttagtggaggcgtgtgcgcgagaaacgagggggcgaggtagtgggcgcgggaagcgaggagccgggcatagcgttggcaagggtgtaaagacgccgaggaagggatttgtttctttcctctcgccactcttccccttgccttcgccacttgtgccctaactcttcgtttcctgtgccctacccttgccgcactcgctcgctctcaagctcctcctccgccgacgtcatggcacggggctccgcaccgctcgacggtagcgtgctgccgccttcccgcatcgtgagcgagaggcaggccgggctgccgcgccgattcatgccggaatctgccaccggccgggaggtggtcgcgttgggcgagggacgcccggcgccacagtacccggggcggtccgtcttcttcctctttttcgcaatggcggggctggtcccgccattctctatttttttcatggatattctggagttttatgatctccagatggcgcacctcacccccaccgcgataatgacgttggccatcttcgcacacctgtgcgagatgtttattggggtgcgcctatctctccggttgttccggtggttcttcaccgtacagccggtgtcgccgccgacggtagtcggtggctgctacttccagccgcgggggcaggtgctgaaccgctacattccctgcgtcctccacaaaaagtgggacgactggaagagcgattggttctacacccccctcgccgacgaagcgcgcctccgacttccgagccagcccccggcgcaggcctccagctggcgggcggtggtagatctgggagacggctacgacgccattcttgaccgcctggcgggtctgtgatccctggggctcacgggggccatggtgctcggcgactaccttcgtcgccggatcgcgccgctccagcggcgcgcccggggcgcctgggagtacaccgggcccgaggactacatgaggacccaccaggggtgcaaatgggactgggaccctgaggacttcaggatggtggtccaacgggtgctgaatctcagctccgtggaggcatccctcatcccccaaggggtcctccccctctgctgcgatccagagcgcgccaagatcctgaccatcatgcaggtggtcggggcgtcgggggagcgggccccccggggccacgatggcgcgggcgggagccgcaggggggaacaatctaccccgggagggggtcgtgcttttgggccccgcgacgggggcccggggagcagccgccctgccgacgcccgggggaagaggaagcaggagggaacccctcccccatctcctccccgagggggcggggcggtgcgtgctagcagcaggcgcccggagggtgccgtgccgatgccgcagcccgagggggagcgaaagaagaaacggctccccaagatgggggggatcgcgccatgacgggggaacctcatctcgcccccgaggtggtcgtttagccgaccttcccgcaggttcgtccccgcgcccaccgcggccgtattcattctcccatctcccaaggcgagttttcactcacccgcttctttttgtcttctggtttttcttctgcctcagcgagatcccgtcgcccccccccccccccccccgccattccaagtccggccggtctgaggccgaggagacggcgaccgcggaggtccgaaggcgggaagctgaccggcgagaagccgcggaccgcctccgggaagccgaggaggctgcccaggaggccgtccgtgttcgccaggctgaggaggccgctcgggaggaggccagactccgctgggccgtggagtccgtccgggaggcagaggcggcgcgcgcacgccaggcggcctgccaaacccccgacccgactccgcccgaggcgacgccgacttccgaggccacccacgacgaggccgcgggcgcgccactcgggcccgacccctcgggcgacgtttgggacgagccagcttcgggagacgcccccgagtccggcacgtcgatcggcgggccgagccgcgcggcacccacaccgaggcggctctcccctctgccttccgctgccccactgagcgcggagcccctcctgcaggccttggccgccgcgaacagcacagtgctggacgggttaagtgcccagatggaggccctgtaggcggagcaggcggagctcgacgcggcgtgggcgcgcgtcgaggaggggcggcgctcggtggaggccatggtggaggcgggccgcaaggcacaccgccggcacgcctcacagatcgaggcccgtcgtagggacctggcggagatcgccagggaggtggaggaggagcgggagactgccctcatcgccaccgccgtgctcgacgaggcgcgggacgacctccgcctccaatacgggagccaggcggcggagctagaggagaagctcgacgccgccgctgcccgagaacggcgggcggcggagaacgaggcggcgtcccggcagcgcgaagaggcccttgaggctcgcgccacggcgctggaggagcgcgcccgcgccctggacgcgaaggagagagacctggcggaccgcgaggccgccgtcgccacccgggaggcaacactggcggcgcacgaggccgcctgcgccgaaaaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatctggaaggcgcccacgccgagagggccgcactggatcagcgggccgctgagctcgaggcgcgggcgaaggagctagacgcgagggcgcacagtggcggggcggccgcgggccacggcgacctagccgcccgcctcgcagccgccgaacacaccatcgccgagctgcagggcgcgctggactcgtccgccggggaggtcgaggccctcctcttggcgagcgaagtagggcccggcatgcttcgggacgccgtctcccgtctagaccgtgccgggtggcaggcgggcctctggggcgggcggtacgcgaagtacgccgccaaccaggagggcctcgcctagcgcctctcagagatggccggggccctccagcggctcctcgaggagctcgaggagacgatcaagtcatcctcgagggacctcgcccgggggggggggggcggtggagctcgtactggcgagctaccaggccagggaccctgacttctccccgtgggcagcgctggaagagttccctcccggaaccgaggatggcgcgcgcgcgcaggtccgggacgccgccgaccacatcgtccacagcttcaagggtacggcccctcggctcgcgttcgcgctcgactccgacgaggagggcggtgacgatggtgcggacgacagcgacgacgaggccgacgacccgggcgcgtcggagtgagcccccaggcccccgccaatcttaataacttttgcttcttcttccgaggccttcgggccccctccttgtatagactgatttgatctgtaatcaagtaaagaggaaatttctgcgtcagttctgtttgttgtgtgtatgagacgaggatggtctgtgccgcggtccttctatgtcttggcttgaacaagggctcgtgcccaggtcccagcctcaaacggcgcgggtcggggctagtgcctggggagatcctcgtgtcgagactggccaggccgggagcgcggtgaccgagggttatggatgacccgattgtgggcctttgccgattccccccggagttcaccatgccccggggcacggctcggttatgggccccgtttggcgattttagccgacccgggccaccgagggcagggtcgagcacgagcgtgctaattcaagccaagattcttcaaaaggaaacgatggcacagacacagtcctcaggaaatcgaaaatgcttttattgaaatacggaagagaaaaaaggtgagtatatgcatgtggtagcccccggccaaccctgcacgcccgggggggtgcggggttggcccgagcctgagacatgacacccgacccccactaggggtagaagcgatgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacccggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcctctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcgtcgttaagagccgtcagccaatagaaaccctgacgaaaggccttgccaaccaaggtgcgtgaggcggagtaggctccgcactcgccttcatggacatcggcgagaagctcgacgccttgttcccgaggaatgcacttcaggaggactccgtcagccgcgcgccgatagagggtcccttccaccagcacgtagcgcttggagatgcgccggacgcgttcactcccttcgcggtcctcgggtagagtcttatctgcgaggtacgcctagatctcagtgatccaagcaatcaatctaggggagctgggagcgctcccctcgggtcccgaggcctggactccgacgggcctcgggggccgttcaggcgcgtccgtcccccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcactggtactccttacagacctggttaatgactaactgggagtcgcctaacaccaggaggcggcggatccccagtccagctgccactctgagtcccgcaaggagtccctcgtactctgccatattgttggtcgcccgaaaatcgaggcggaccaggtatctgaggacgtctccgctcggcgaggtcaacgtgacccccgcaccggcgccctgaagagacagggagccgtcgaactgcatcacccagtagacggtgtgaggccgctgcgaggggcccgaactagcctcgggggcggagacgggctcgggagctggggtccactccgccacaaagtcagcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggcgtcccggagggcctcgctaacgaagtagacgggccgctgcacctttcggcggggccgatcctcttcgccaggggccgcatctctagggcgctcttcgtccgagaggccacgcggggcgcactcggcttttgtgccgacgacctcggggtcagagggtgacaggcgcggccttcccgcagtggccccgaggccattctgggggtcgggggcacctggcaccgtcggacaagcaggcggagggccagctccggccgtcgggggcctcgggccgccgttcggttcgggggcctctcctccctgctctctcccgggtcgagtcgacacagggtggggacgcgcggagtgagggttgtcctcgtcgcgctccacgaccaacgccgcgctgaccacctgcggggttgccgccaggtagagtagcaacggctcatctggctccggggcgaccaggactgggggagaactgaggtacgctttcaactgagtgaagacccgctcagcctcctccgtccaggtaaacggcccggagcgtttgaggagcttaaataggggtagcgccttctctcccagcctcgatatgaaccgacttagggcggccacgcagccggtgacgcactgcacatccctaagcttgctgggggggcgcatccgctctatagctcgtatcttctcggggttggcctcgatgccgcgggggaaaggatgttgagggctgcacccccgtctatgaggacacgccccaacctcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcagcggtggccttctgcttggcctcacctcgccggttgccggcgggagccgccggggtcttgccctcacggcgctcctgcctcttctcctcctcccacttcctcgtccgctcagccaaacttttgaccgcgcggcagtccgcgaggtcatggagggcggtgttgtgcacggtacaccacttgccagtcgggcgctccctgccgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgacgtcctgaccgagcggcggacccgggggcggccggagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgcccccctgaacgcgtagatcaccgcgtgtgcggggatgcacggtatggtgttgcggacttgacagaaccgctgaatgtacaagcgaagagactcatcgtcccttcgctgtaccgcatgcaagtccgcttcttcgcctgggcacagatatgtgccctggaagttcgtggtgaactgctggcacaaatcctcccaagagtggaccgacgcgggtggcaagttcattagccaaccccgcgcctgacccttcagggtcatggggaagaaattcgccat

SEQ ID NO: 67679 - DNA, 9296 bp, Oryza sativa
  unsure (1)..(9296): unsure at all n locations
ccacgtacattatttagggtatacactacacggcctacatgccattgccacgcgtgcgcagaaatcgacgcacacgatcgtaagcaagcactaaatttttctcttcagatgattccaaaaaaataaaagaaatcccctctagatgagggatggataatctactccctttgtttaaaatatattttcattatttaataattataaagctaatcatatgtttggaaaagaaatataagtacttaaaatttaacaattcaaatgattataaaggaatattttgactttaccttcatatttttctaaacaacctatagaatccttatattttcccacggggagggagtagcttgtggaagccacagccaaatacaatatgaaaattccaacgatatgtgaaatacattagttaatttcaaatgatagctatctgataacttattaaagtattagaaaaaagagcatctacgttcgctctcacagcttaaaagttctcatgcttatcggagaaacagtaaaaaaaatccaatccatatataaatacaatttaaaattagctaaaattcagaataaaaaaaaggaaatattggaagagaagaatagagtccatacaggtacacagtatagagctaattgaaattcggagttgaaaataagaaaattaaaagtagatgttagaaaccatatagaaatacaattcataaataactaaaattcgaaattaaaaaataaggaatattggaaaagagtatagaatccatatatgaatacgatttagaaataactaaaattcgaatttaaaaatttatgctccaaagaataaattgtttggtcaatttcatacataatttgaaattatgtttgtgtgtgtgtaagaaagtatattgatgctaagtgtgtaatctgaacggttcaccatgctagtttagactaaaagaatagtccatataatttggaagaattcttcccataagacttttatgattaaataagcaattccaatgtcatcagtaaatataaatttttctcttcttttcagaatatgcattatcattttacgatggtttaataactctgaggttcaaaattattattaataccttaataattttatgtttttcattaacatttaccaagttgtactttataccaactcattgtacttataacggttattatttagtcctaaaatcaaaattacaaatattattggatacaaatatcagtcccttggatgaaaaacctaaccaccacttttaccagctgcattcatatattaacttattaaagtaataaagaaaggagcctgcacgtttgctctaacggcctagaaattctcatgttggaataggagactagagtccatacaagtatacaattttgagcaaattgatattcaggattaaaaaataagaaaattaaaagttagcgtccatatagaaataaaatttagaaataactaaaattctaaattaaaaataagcaatattgaaataagagtctacagtccatatagaaatataatttagaaattaccaaaattcagaattaaaaataagaaatattgaaagaaacatctagagtccatataggaatttagaactaattgaaagttggaattaaaaaaataagaaaactaaagtagagcttacagtgcatatagaaatacaatttagaaagaatcaaaattaaaaagaaagaaagattaggataagagtctagcgtccatacagtaatataatttagaaataattgaaattcgaaggtaaaaaaaagaatattagaagaagagtctatagtccatataggaatacaagttagaaatacctaaaatttggaatttaaaaataaaaaatattgaatgaagaggtagaatccatatataaatacaatttacaaataacagaaatttggaattaaaaacaaggaatatggaagagaagactagagctcatacagaattacaatttagaaataactgaaattcagggtttaaaaataaggaatattgaaagaagggtttagagtccatatatgaataaaaaatataaattgtgaaacttaaaaattttaaaataaggaatttatattagaagaggtgtctagagtccaaattggaatacaagaatccagaaataaaaataataatgaaccactatcacgtatatatataatacattatacattggttagtttggtcaagttcatacataatttaatattttgttgccattttaatatattttaataataaagtgtgaatatatatgctattatgtgaaaaaatgtaacgatgctaaccacacaatctgcgcgggtcaccatatatggtagtttacatgatgtgattacaatttttagataatacacgatgtgattacatgatcatgatgtgatatatattgtggttaattagatgagaaataagttatttattttccttccaagtgataatcataatatattccaagtgattgtcttccactactctaagaaaatgattatgatttgcatgatgcttattatcactactagagaaaatgacaattttggaaccggcactgatgtgttccccccgagttaaaaaaaaaaggaggccaccttgaagcatcggctcgaatcgagctgatgcttcgagtgcccccattcccaaccccatnngcnatntnnccccccctcccccccccccctctctctttttttttttgaggagaacgacggcaggagatctgtcggaatttaattagaaaggggaaaacaatacaaagccagttcagtccagaagaaattaaaagaaaaacagtacaacaatacacggcacgaaacaataaaatttaatgggcctaaaagccgaggtacggagatcaagatcttgttttacgatatatgccactgctctctctctctgagattgaaatattgttgaaaactcttctgtttctttctaaccaaacgttccaccaagtggtaagcagagctcctctcgacgtcttcttttgctccttcgatcccacgcaatcaatttgagcccaccaatctgaggttccgacagaagggccatgcaaaatcaacaagagcacacgagcatatgcacatgtcaaagaagcacatcacatactatgaagacaagaacaagctaatcacatcatatatcagaacaattcataacatagatcaaaatcttgcactatggctgaccattgcatgttcaacatatcggactcaccatcccagaggatctgtcatcgtcgttgtagattcccttgctgctcatctcctttgagtcgccgctgtcgccatcaactccttccggtcagaccgccagcccccaagcacgtgcgaggtgatccatggcggtgaggtcagaggcggttggattcggcaagccctggcctcaagaagaacaaatccggtggtcccggcctccaggtgactggatccggcgcagctacggagaaaaagcccgaaggcgacgaggaaatggcgaggaggagagtgcaccgccagggagagagctcggaggtagcaaggaggagcgggcaccgttatggacaaagcgtggaggagcagcgatgtctccgggggagaccttggaggagagatctgaggaacagtgagaagatgttgggatggcattcgcaaaaaaaggagatggggagggcgaggagataggatgaggctagaagacttgggctctgtttgtcggggagacaggggagattgagtctcgttttccacgcgcacgcttttcaaactactaaacggtgcgttttttgcaaaaaaaatttctataggaaagttgttttaaaaaatcatattaatccatttttaaaatttaaaatagttaatactcaattaatcatgagctaatggctcacctcgttttgcgtatctttccaatctcctcaatcatcttctcctcaaacacacccttggggattgacgaaaaaaggagtaggccggagttaatttttttctcgccgccacctattgatgccggtttttctctccatttagtccatcggtgccaagtttttttaaaaaccagcactgatgtgatcagggtcgggttttttagaatgcacacgagtttggagggtacgaaataatctttatcagtgccgggtttaattaaaccgggaatgatagagacaacactgataggatgttctatagtagtgttatctcatgaaaactagatagcgtagtgctgaattcacatgtttccatcagatcgagcatcttttttccttttgccttggcaagttggcatcagagtatcattcactggagtatcggagaaaaaattgggttcgtcttcctcggcagtgcctatttaagctcaccccaccccaccccatgtcttgagcatccaagaatgaacatacttcacacaaaaattggctatctacaacattctcgccatcttactactactgtttctccccttaaagtccagctcccaatcgacggtgcagcccaacaccgactgttgaagtgtataaaatgaattgcccgtctttccctatcagcttaggcttttaggtgcaactggctggtgcatgcaacttaatatggtatcagagccagaggtctcgagttcgaatcctagctgacgcgcaattaaataaaataattgtagcccactctaatattccacgcttgagacttgagggggtctcacctcttcctcccaagtttccacatagccaaaccaattccagcctccatttacagcctcaagaacctgacttccatagacctctcttacaacaatctcaccggtgatttccccactgtgctatacgcttgctcagctttagagttacttgacctatccaacaatcaattatccggcagactccctgacgacatcgacaagctgtcctcagatatgcagcatctcaacctgtccaacagcatcgtgcccatctccgtaatcgctggtggcgtggtcatctttgccgtaggatgtgttgtcgcatcctgcagatgcagggctcgcaatgacgacatgactcctatagttttaagtgataaaatggaggatcatctagtccacaacgctgtggacgtaaacaggatcagtagcacaggcacaacgacaggagacccactgtaccgtttgggggttattaacgacagcagcgacacctacaggagattaactgtgaagaagatgcagaacgagaccaggagtgtggacgccgaactcgagaaccggcgccaaacggaggagaccacgctcggcatgatcgtccaccccaacatcattatcctgttaggctacattcggaggaacgaaatgatcttgattctgtacgaggacatggagaacggcagcctggacaagtggatacaccacaacacgcaggccggcgagaggcgcctgcgcccgccgctgggctggcgaaagcggctggccatcgtcattgacgtcgccggagcaatcctctacatgcatcacggttgtcgaaggccgatcattcacggcgacatcaagccggccaacatcctacttgacggcaacttcaaggccaagatctctggcttcagttatgcccggatcaatcttgccggccgcaacacgctgttgggaaacgtccgtcttcatgcaggggccttcgggtattttgctccaggtgaggcagcataattaattaatgcgtacgttcccaattcagaaatcgttaaactagttaacgatcatgttacttcaggattgactggctgccatttaattttgctgcagagtatgcggacaccgaagtgagcgagaaggtcgacgtgtacagctttggcgtcgtcctgctggagatcgtcacgggaaaagtagtcaacgatcagcacggccatctgacgacatgggcaaaagcctacttgaatacatgggcacggcaaggctacgacgataagttattcaccgacgatgtccttgacaacgatatcgcctctgacgcggcacggtacttgaaggagatgaaggccgtgttcaagctcggcgtggagtgcaccatgatggacccgcagcgcaggccgtccatgcagactgttcttcgacgcctccgccagtgtgcccgctggtggagacgattcccctgtttcgtctgatcgatcacttccatatcaaatcgtcttgtttattacccctccgtctaaaaaaatcaatcctacctacgaacatgtacacacgtgttcactagttgcatcattttctttctgttacaagcaaacattctcgtgcattgaggaggacgggtaaaatgttcccctccatgctttagcgtattcagatttctagtgtcagctaaactagatgttacctcgtatgttgctgtgagactttgtgtgaacaaaatattatatgatttgtgaaacgtgaaaacaaaaaggtgaaaaagaagccattcaataaagagttctacatattggtgggaacataatatgcaactctgagttgtttgtgcttgcgtggttagcgtgtagtgcttggacatgtactggtgtactgtcgtattttttcttgtaactttttctctttcttaatgtatccggatgggcggtcttcctgccgaaaaaacttaagcaatctcttagggttgccaatatgcataaaggtaaactgtactgttgaatttaaatcagagattgaatagaaatacatcatgctaatttggtaaacagcgaatggtaaagtggcaatcacttaaaattttattgaatgaacggatgtcaatccatatcatgactcatgagtgaaactagcagggtgccctgcgcaattacgtggctagtatccatataaaattatctattttttaatatatgatattacttaaaatttgttaaatagccttcacgttgtcttagaaccttaaaagattgaaccttatcatcctttaatttttaattttattgtttttagaagtcatattagccgctacctcttactcttgtatcatccttctattttgtttgcctgatctaccacagcttctacttatccttcttgaaatcttttaaaaattgggttaattaattggaccttctagtttctagagtccattgtctcatcgggttctgttattataatttttagaagtgtcatcaaacgtcgccattgtactcctccataacacgtccgttgtctcccctatttactgttattgggattttaaaaattaaacataattatcgttgggattcatttttttactttatagaagtcccgccaaccgccgctacctccggcactatactcctgtatccatatggcccgcgcattgccttccctatttattatcattgagatttaaaaatcgaataagattgtcattgcaatttattttttactttctagaagtcccgccaaccgtcgtgaccttgctacctaccggtctatttatcgttgctccagttaatcgtcattgggattctatttgtggttttgcttatagtttttagatgttccatcaaccgccgccattttacttttttgagaaaatcccttgtgtacccctaaaattttagctaatcccttctatgcccctgaatttttcttacttccttatatacccccataatttgattttgatcccttccatgcccctcccgtcagttgaccgtctaatttctataaaaatgatcattttaccctttggatgaacatacaaatttatgaattacattattggaaatgtaaaagtttgtcgcactagactattatagtcatgagtttgatgtgtgatacattatttatgacaaaatttacttttagataatgaaataaaatatatgtatttattttatttttaaaaaattcataaaaatgaggagcattcatacaaagataggactacgagtgctcaccatattctttttatgaatgctcccggtaaaaaaatatattgtcctattgaatttcaaataaaaattctttttttattttcaaaacttttgtcaaaattttccgcactaattatttagtttcattttctacctaaaatgcacatattgtgcactcaactgaaattttcaatcgttttcaagcttatattcaaacctaaatcatcaagggcattaaagatatttgccaccaacttaacggtgaattgaaggaaaatgtgattgtaggggcatggaagggatcaatttaaattttcaggggtatagaaggaatcaggtaaatttgagaagtataaaaagggattgagtgagttttcaaggatatacagaaaatttactctactcttttacgagtatattgcttctctcctttttatagttatttgtcattgttgagttttagatgaactactttttttatgaaaatttcttatttttcattgcaatatttttttattacttataaagtttattcctacttgaactcctataattatttttatattttttaaaaaaaattattttttatttcaaattttaattaatctcgtattccgttctatataaactcttcttccaacgttacttatttttagtccgaatttcagctattttaaaattgtatttctacttgaactcttataattattttttctatttttgaaatttattttattttttattctgtattttgatttatctcctattcgattctatatgaaatcttcttgccgcctctcaccccgctgctaccggtgggtaaagaagagaaaagtagacagaacaaaaatgaaaagagagaatagaagaaaaaagagatgctgactaggatgtgggtcccacatacttcttttttctttttgctatctagcatgccacgtcaacgaaaccgggcatccaaactgtcttggaacctttttttgaacggttttacatagttgaggggtactcattttttgaacggttttacatagttgaggggtacacatttctggtattacggttaggggatcccacagactcctcgtacaattgagggacgtcagataaacttattcctcttacaaaacacttcttttttttgagaaacacagtacaaacgcaggcgcacactcacccctatgaacacacacatgcacaccctacccctatgagcacctccggaagactgggccggcatatcttgagattgtttttttagaaacacagtacaaacgcaggcgcacactcacccctatgaacgcacacatgcacaccctacccctatgagcacctccggaagactgggccctatgagcacctccggaagactgggccggcatatcttgagattgtttttttagaaacacagtacaaacgcaggcgcacactcacccctatgaacgcacacatgc

SEQ ID NO: 67680 - DNA, 2507 bp, Oryza sativa
caaaatcgggttaaattagatcttattgcggtatgaattgatttcgctgatataacatcctaatcaacatgagatagatctacgtgaaagtggccacatcaaatttctacttcccctcatcgtcctcctcttcccaagtagctcgccgacggggtaaggggcggcggccggtgagcttatatcagtttttaaccccccatggtttttcactgtgattaccactgggtaacggtgatactcctattcatcaaaacggtaaaggaaacccggctaaaccggggctgatccgccactttgcgggaacacgatgctcccccacgtcgaaacagcgcgtccccaacccaacccaaaaaacaattccccccctccctgacatgcgtcctactcctccccccccacccccactttctccccacattttgccccctagaccaaatccaactcaactcctcctcgcccccgcgcccgcaccaccgcacgtgcacccctcaaactcgccatcgcccatccccggtcaactccacccccacccgccacccagcccccggcgctccaggcaaatgcagagagatcgcgagttcgcgacacgcgcggatcgaatgcctccccgctcccattctcccacagtccaatccgctgtactaggcttgtagcccgtgtgtaaactattccctacttccgttacagctgtctcctcctcctccttctccttctccttctccccccgggcttaaaggatcctcgtcgcggagccgtgcggggtccccctcgccctcgccccaatggccgtgcattcctcggccgcctccgacctcttgccgggatccccgggtggatggtagcaggggtggaggtaggaggaagggcgcgcgctcctggctgtctggctgcggtgcgggcaggggcatcggtagctgcggtgctgctcccttggggggtgggtttgggtggtttttggatcgtgggggagaggagccgaggtgggtatatcttctgttgcattgcattgtgtgcgtttgggattgttgcactggagagtaggtttggggggattcaagattgcatcgtcgtgtgacgtggcgtgtggtttttgaagaacttcggtttcattcagttgtgaaggttggtgtgtgtgctctcgtgttgtttctttctttgtatagcgggtgatatatggatcgtccattcattctattttagttctttttactgctagtacaggagtaaatttgtgtttgctaactttgatttccaaaaatgagaccaagactgaagtttggatttttatgacttgtttagtgttcaacttaaccgctttctcgctacgcttttttttttcaattactgcatggttcatctttgaattgtccatttggtggcattttacttatatatgaaaactatgatgtactgcttgcagattctttgtgatgcactgggctcgtgttcatacttcaaactgacaaacaaaaaaggttctttaaccggcttcagcgattaatggccttcactggggaggaaaaaatgaaggtgacttgctaattacatttccacggttgctttatgtatagaaatgaaatactcgccttcagaaaataggattgtgttccagggttgtcgcccaaaacttttcggagcaaaggagaataaagtctcaaacagaacagacaaaccaagttgcaacaccggttggttcagatcttcccttttaaaaagtttctgttccctttttgtttcattttggatcgttgttttaatggcgttggcagttaggcttatgtattcaaatatcctttttcttaatgcaatgatacacccatcttttgcatattcccgggaaaaaaaatgtatatacagtttcggatgctagttgaattgttccttatctttgccaattgaacatgattaggggttatttggatctccaattttaggaaaagtaaatttaattaagcaagttagcttgcctaaaagtctaatgccttgttggttaaacaagataagactaggatagcaaagttcatttgagttttaaagaaaacagctgcttcctgtttttttcacaaaattcaaaatatgaatatagtaaacaactagaagaaactttatatggcatcattttcatcagtgaatcccttcttgtggagggcaatcccttatttgccgttgtaaagttcatgcgatcccatgttagttatttgcaactgaagtttcattggcatgtgactgcatggcccatgtcagagagggagagagaaagatagacttcttcaattagataattccattaacgagtttccttttgccttgagatcatagaaggaactaactgtgttgtatggccttacataataacagggaagtttggtccaagttcttctaatgctgcgtcatcttcccccctaagggcattttcaggtacactaatatctagtaaatctggctaaatgtttggagatggcccaattttaattgttagtgggctttacttgtcttatgcttttgaa

SEQ ID NO: 67681 - DNA, 3636 bp, Oryza sativa
cgactaaaatagtattataacatatcttatagtgaaaaaaaaaagcttatactccccccgttttttaatagatgatgccgttgactttttctcacacgtttgatcattcgtcttattcaaaaaatttacgttattataatttattttgttaggagttgttttatcattcataatactttaagtgtgatttatatcttatacatttgcataaaaaattttaataagacgaatggtcaaacatgtgagaaaagtcaacggcgtcatctattaaaaaacggaggtagtatattaaaactctaaaatcaaaatagttctttatttgtcaccctagttgatggcttgacgccattgcaaaaccaaaatagtcttctagttatcattcgcaaccatgaatggatcgcggggactttggggctgtttggttcgtgtcctaggggccacgcctgagaaaaacttacgccgaataggcagcgttgggagatgtaacacttgcctcatcaggcagcctgaagctttgtgtgtttggttcgcacacatgcctgaagaataataaaatatcaaaaagcaacttttaccagagcaaagtatggaataaatgacacatgcatcattaagagtagctgactgaagctcaggcgtccaaattcgatggcctggctcaggctaatgaagttgcctgaggatttagcaagctaatgaagagtcaggtcaggctagctcaggatataacagcgcacaaaccaaacacatagttgttggagctcaggcggcgctccggccaggcatacaagcatcaagacgcgaaccaaacagccccttcctccctataaaagcagaccaagaggagttggtctcattttcttggtaacaacaaccacaatactccatttgtcctataatataaggtattgtgttattttttagaaaaatgaagtaagtgctttggtttagtgctaaatcttgccctaccaaattgtttgtacatgtgtaatgtttaaattgattccaaaacttgccaaatcaatagaaatatgtcctaaaatattggtagttccaaaaattatctaaaacttggcactaggtaaggtggcaatccaaatatgctcacagtaaaaggatatgtcctcgaaaaaagtaaaaggatatgtgatgttacaaaatgtgttaggtgaataaataaaatactagtaaaatagtgatagatgtgaaataaacagtataaagatgataggtgggggagtaaagtactagtatcttaggaccttagagcaagtagaataaaagaattgagtaggctataatatctccaccatgataaaaatgatgagccggagagaataagaagagagaacttgagagggcgatcatattagcgtcgactgtatttagcctttgagactaggtgagaccattgtaattggctaaacttagcacatgtcggtggatctggatcatctaatttactaaaggaacgttacatgcgtgcagttatgctatatttgccatccattttcatctgacagctcctgctggctctcctccttgttcatatgtacaaaagaacttctgacaacattattggatttaggttaaatcatttagcatcatctaccgtgaagtgcgaataaaattacatcacgatattgtcccaaagaaaaggcagcattttggttcatgtacaaaagaacttaaaaaattaatcagtgtaatttaaaattagattaaaaaaacctctaagccaattctaaaattaagctctaaaatttaaaatagatttcctctttgtaatgttactggtgatatttattttgacaagtgcttttatttgtaagtttgatttacaagtgctttcatatgtatgtttgttttaagacaataatcacaggctacaattaaattttaactattaatattatattttataaatattaatattagttttacccgttacaacgcgcatgagcaatactactagtattaaataaaatacaaccattaaccctgaaaaagaaagtacaactacaaattggccctaatttgttaatctcggggtaggaaaaccaaacaaactctaatccccctgttgcaattccaaatccccgaatttgcatcgccattcgcacatgccacaacatgtgtagcactagtacaccggtagacgtgacgtgagcaatgagcttttcggccgtcgcgtgcgcgagccgccggctgctatgcctatgctagctaacccaagtcgagtagtagtagcaaagtccgacccgttcacaccatcaccatcaccatcaccaaatcgatctaaaaatactcgccttcttctccacccgagccgagcagagcagcgaagagggcagcgaagtcgccgacgaggaggaggagaaggagccatggccgccaggagcttccaggcccggtcccccaaggaggagtccgacgccgccgtccatggtaatcaaatcccatcccactcaccaagctccgaaatccccatccatggtagcgggatttcatcttcttgcgcggaggaggaggagggatgaggtttagatgtagtagtagtaggaaggacggtgtgagatttcttgggagaaagagagagagagagagagagagatcagatcactccccttgattgggggtttttgggttcgccgcgttgtcttcccaagctgtttatagtggctatctgatgatcatggttcaattcggctctgtttatctaaggcttcccacttctgggtgcctcaaacacaaattcacttgtgatgttgctagattgtgtgtgatatatggtatgcattgttggttgaggagaaggcaatgtataatgtatgtagtgtgcgtaatggttcggtgaagtaagctgcctgagttccgaattccgattcatgtatgcgcggttgcgcacaatgccagtatggttgatttctttgtgttctgttcattgcagaggcagtcacgctgggattgaagaacgcagccatatctggtaccgtggttgcggtccccacggtatgtactagctgtttgtcatgccaatgttatgtagtttcattctttagatcaatagtatatagtttcaagtgcaatttcttcctagaagaaacatatgtacgttggccacacattatgttttttttttcccacctttacaaatcattgtttccatcaagtgtttgcatcttcgtttcaagtatcaataataatgacggaaatggaaatctagtctaaattactactactaatttattacaatctggctcaatacctggtcatatgttggaacactttgattcatctggctgcatatattctgacatctgcaaaaataacatttctgctgcagttggttggttgccgtgtccttccttgggctaaggctaatctcaactacaccgcacaagcactcatcatatcagcaggtacggtttactatactactgaaagttatcatttttcaaattgtattatactagttattatgaccgaagacctactataaagtgctaacatctcgtagaacttattttactggtaccttggatattgggctaaacctaatggagccaatgtcactattttaacttgctggatatatactgttttactccctccgtttcgaaatgtttgacgccg

SEQ ID NO: 67682 - DNA, 1495 bp, Oryza sativa
cttacaacgatggaaagttcatttgtaataatcattttactacctcaataggaaaaacaaaacatagagcgagcttttatagcctgaggctgtgtttagttcagcgcaaagtttggattttggttgaaattggagatgatgtgactgaaaagttgtgtgtgtatgacaggttgatgtgatggaaaaggactgaagtttggatccaaactttggatctaaacacagcctaaatgtgaaactaattctgtgagtagatgaggttctgtgataattttcttgagcataagtgcacgttttgatgttctctatctgcattttcttgtatgctttccccttttgtgcagataaataactggcaagatattggaatgcctaagaatggtacaaaactaagagcaagaactttcggtgccaatacaacactgccagcctttggtcatgaaaacattagagaatcaacttagacatcaccatgtacgttgttattagtaccatcaacatcctaattaactcatcttaattagctggcactacaatactatatttttctgagatatgttatctctgttctacagaatttaattattgttgtatagtgactgctttcatttgttgcagatcttacaggtgggcttaaagtatataataaacaaagtggaacaagtcatgaatgtcatgcctaattgttgttgttttaaccaggcaacaaactcaggaaatcgagatgcacacttcaaatgatctggtagaaatccccaccttaaatcctttatactctacaaaccacaactatctttaatcatttgttgcccttattttgcttatatctacacatggccatggtgcttcatgtttattttctgaaaatgccaacaccaaagattttgaagcacacaactgacaaagtggacatgctacaacaatttctacaacaagaagcaccatttatagaacaaaatgcagtacacatgtatgttgattgcagtgctaggagtgcagtaaatttttttacatgggtgtattttttgcaatgatggatgttaataattgagggatatgatgagttagatgatataaacaaggcacaatgaatgaattgaggccatcctgatgttgggttgcacatgtattatattttattggatttctccttttatgcactatgtacaatagttggtcagagaggaaaggctagagctagaagactttttcactttctttttttccctctaaatatgggctgttagacagagttttactaactgatagcaataacaacactcctctgaaaataagagagatgtgttcctctgtttgctagatgctactggccagcctaatggtaattgattaattccatgcagcaccatatttatcttgtatgtgacagtttataatatactgcattgcatttgtccacagtttgatcatgcagagttataaaaaaggtggcgtggtggtcttgcataggtgggtttcaaagtttctatatcag

SEQ ID NO: 67683 - DNA, 1794 bp, Oryza sativa
atatgattggttaatcaatagggaaggtagttcttggctcctgagttttattggctcgtgaatttcattacttcatgcacagttgtttgtatttgatatctagtcgctaagttggctgaaatatgagccgctgaacttttaatactctactccctccatcccacaaaatttcaaaccctagcattccaagatgaaattaaggaggaaggcaaaataccaaaatgtccctaattaataggaaagttgtattgatggatgggtaggtgaggggtatttaaaggataaaatttcttgatttgcgaactggtggtaggtaagaagatagaaattggtttattttgggacaaaattcaaacatagaagttgatttatttggggacggagggagtacatgtcagcaagtgcctccgcaacagtgtggtaatactcccaagtgcctctgaaattgtttaacaattgtttgtgccctatttttgcaatggttcacaaaatatgaccagcggttcagcaccatgttttcttttagttgcacttctaagtgaactcagatgtcattgtatttattatgttaactgaagcacataattgttttgttgcaggggccacaatatgtatgtaccaatttctggaccttcatatgcttgtcatgcagtggaatacagtaagtattttgttccatttatcttgtcgtacatgccaatttctggtcctcagctgatttccttcttcgttctagtttagagttaatgaaggtctattcagcttttgctcatgcaagaaaatttgtgttcacttatctattgagcaatgatacttgcaagaagatgtgtgttgtggtatctgatgctaagaatgtatggcatggggaaatataaagcattatttatggtccatttcttacaaatagttcacaatctaatatcacagattcacagttgtttattcagctaatgtcactccatatatggaattttctatttcattatttgcgactccgtggcatgtttagctcaaggatttcgattatcctaggatgggttggcccatcataatgttaacccattccatagtttttgtgggaggaccccgttacttagtttccattattattgcggctatgagaaaaaaggtggtgatgaatctgtctttcattcttgaaacacgtgttgttagggtttgactggtttaaaaaataattttcaaaaataaagaaagaagtgaatgaatttggcagagaagtacttaatcggattggaccactgacccacgtcttaccactgcattaatctaatatacattgttgctatactgttggtatttgataggagtagtaatctcttttttttatgtgttaaaacagccgggagtttacccaccgtgtcaagtcagtgtcaatggctaaattcactactcaagaagtgcggtctcttgaacagggagggaaccaggtaattccgggaattactttgttttgtcctctttagactttagagtgacctggtcatatgcttacatggaggtcatgggtgcagcgagcacgtgatatctacctaaaagattgggattggcaacgaatgaggttgcctgacaataggtgagtttgttttcattcccatgtgccgtggaaacttctagtacatttctttataattattccgctatgttttgttttagcaatccagacaggataagggaattcatcagagctgtttatgtagacaagaagtatgctggtgggaagtccacggacaaaccagtcaatgatagtgaggtaatgagtttataaatctcaat

SEQ ID NO: 67684 - DNA, 4381 bp, Oryza sativa
tggtcaaacagttcaaacaaaaacttaaaatcccttataatataggacggagggagtataaggatttctagaatttaaattttataccataatataaatgtatttttgtgctaattccaatgaatcccatcatttcaatgattccatagccaatcaaatgcacaatgtgaaaatatgagcggatcttaggacatcaacaatgtgaaaatatgagcggatcttgagcccctaagacgtacgcaattcaaaaaaaaaaattgccaacctcagaactatttactaaatagcctaaatatccttataatttggaactgaggtagtactaacaacaatcaatcccaaattttttaactgatttttttactgcagcctactcaactgaaaactcagcaattcgcatcgatctcccaatgaggtgctcatgatctaccgcgaaatgcgatcactgcaccggcagcttttatatatactgaaaccatcgaattaaactgagttacaattggtgatcgataaatagatcaatggcattgattgatcttaatccgcagctaacatcgccatcaaaccaagccaaagctctaactggttaactgaccacatcttggctgttcatatgctccattgctagagcttgatttccagcaccaccacccgagctcctcttcagctcctcgcacatctcctcgatcattggcttccatagccgaactcgagcgtttatgaaccaattcgacacctaccatcgccgcgcaaatcgaccgaatcagccacggaaaatcaaaaaaatcatgctaaaatgtagtacaacaaatgtgttttcagataatataattcagccaagaacatgatcactgggtctatgatttatcatctttgcagttttgtttcgtcgaaaatgcggagaagcgtttggtttacgaatcatttttgtttgacaaaagtttggaaatgagttgtatatagtactcccttcgtttctaaatatttgacaccgtttactttttaaaacatgtttgaccgttctttttattcaaaaaattaaataattattaattttttcctatcatttgatttgttgttaaatatatttttatgtacacatatagttttacatatttcataaaaatttttgaataagacgaacggttaaacatgttttaaaaagttaacggcgttaaatatttagaaagggagtattacctggttcctgctgaggccgctccttgctgcgagcatctccttctcgctgtctttcggatacctgacgcaagaacaccaaaaatgaatcgaatcagattgtttgatgaaggtgttcgatcaaatgcgtgatgtggcaagatcggcgtcaatggcggcgtgggtggtgcttacgggcggaggaagttctcgaacatccaggccttgaggacggcgacggacttctccgggaggccgcgctgcggccgccagcactgctgctcgccgcgccgcagctgctgcaccgcccagtgcttctggatgaacgccgactcccagctccgctccctctcgccgccggtcaccgccgacgacgactcgccgccgcggcaaggcctgccggccgcggcggcggcggacatgatctcgccggcaatgcggcgcctcaggccgtggtacattgccgacacggcgcggtgcgcgaacggcgcgcagatgctgctgctgctcatcccggcggcgcgcgccgtggcgtgcgtcagggtgttgaacctcgccgtcgtgctctggatctcgtcgaggcattggttgtacttctgatccatctgcgcatttgaattcgtatcgtcgtcaaaagatggtttcaaatttgattcgaaatggtagtacgaaatttgcttgaactgatgcctcgggagtcgtgtggagaagggcgagctcaccagctggagcatggtgaggagctcgctcctgagccgctgagccgaagcgtcgccgccgccgtgcgtgtgctcgccggaggaggcgatgagctggttgttggagctcacggcggacgacggcgcgccgccggccaccgagcagctcgacggcctcgagctgccgctgtcgacgccgctggccgagtcggcggcggcgtccgcgacgccggccagcacgcagccgacggcgtcgttgagcacctgctgcgccaccgcggcgtatcgggaccgcgccaccaccacggcgaagttcgccgccgggtagtacggtacgagcggcggctcgggctccaccaccaccaccctgctcatttgcgtcagcccggaacggctcgccgccgacgagcactggtcgccgccggcgttgagcatgctgtccgaggacgacttggagcacaggctcagcgacagctcgctcgccgccgccgccgcggacacgaagccggcagcctccggcaccccggcgaggtaatacgaaccaccgtgcacaccggcgttgctgctgctccagttgcagctcggcttcctcgccgacgtcgagcaccaccccgccgccatgtcgcccggctggccgtggccgaggcacgcgaggctcaccgcgccgccggagctgtcgccgacggcgacgtcgtacccgccccccatctcctcctccggcggcgtcgtcgcgccgaggtagtcgccatgcccgtgcgccgccgccgccggcgcggcgccgaacagctgggtcgccagggacgcgagcacgaggttgttcgccgccgcgaagtgcgcgccgacgtccatcgccgccgccgccgcgtcgccgtagccgaagctcccgccgtgatcatgcggcggcgccatggccggatggaacagcggcacgtcggcgccattgccgctcgccgccatgaagtagccgccgttcatggcggcgtccaccgcaccgagctgcgagaacgatggattgccgctcatggccgcctcggaaatctccaagaattgcagaaactagtgataataatcaaaacctgagaagaagaagaagaacagcagcagcacacacgcatcagacattcagacacactgttcttcacgagatttttgttgttcttttgacaaatcaggcttgtactaggtgtacccttgaaatcaaagtttttgatcttttcatctactaccacttttagtttttaccttcacagtagcaaaagaatcaacagtacaagccacaaatagatcctcacagaattgttccattggaacaaaaagagattcaatcttgcaactaacatacaactgatcttccaacttttaaaacaagaatcttttctttttctgttctcatttgataaattcataaaataccagatgaactgatgcatggtgaataacacaatgcatcacaaagatgaacaaaaggagctgataccagaggtagaaaccaagaagacagtgaagcttgagttgttgagcacacttgcaggacctaaaatggaaagatgaagccttccaaaacccaaagagaccagcttccagcttctacttctactaggaacaaggaaacaattggggcagggagaagtgttatcaacttatcactcactcactacaagtagtatcaggtaggcctaatgaccaccaaagagaaagggaaagggaaaaaaccaatgcaaacatctcaaggccagcaagggagcagctctccctgaccttgacactgggtcagaaaattttttggccttggaggagaggctatcaaagaaccaatgggccctactcaggaggcaaagtgccaatgacaaggtgttggtgcccatacacaactagtagtagctcactcattatactactgtaggagtattatagatgccgagtgattcactatccgattaaaaccatttataaaccgataaaatatagataaatcttgacaaaaatttaaatttagtttgaaaattttaaacttgaccaaaagaccgagtagtttgtagctttctgacctggtcaagaaagtttggatttcaccggttttcatcggttttctaaacacagggcatacacctatggcttattactacttcctctgtttcataaaagataagataagacattttatagcataatgaatctaaacatacccaacatcacatctcatcttagataggagtagattttttatgggacagtgtaaaggaggagtggtgacaaaagcatatgggatttatcacctaatgattggtcactggggaggcaaaccataggctcattggtcagttatcctaatccaaaatacaacattgcattataaaaatgtggatcatgcatgtgcctaaaatctactaaatgactgtcccaccactcatcctttactacagttaaacaggtgctggcattgagagacactcaaacaagcaaggtaggtttcgcttaaactaatcaaaatccattcatggaaggaa

SEQ ID NO: 67685 - DNA, 4310 bp, Oryza sativa
tgtcaaccttaatttctgctaaaactctagtatttccttcatcctgtagtaagtttattttttctatttgttccaaaataaatttatactttaaaacaatcattgcattagagtttgtgagagtagagaatatttgtgattttgataaagtagggatattatagtgtttttattttgtattggtatgtatgagatgtgtgagtaataaatttttttggacaaaggtagtagtgttcatatttatgaattgatggctcttggtgctatcctaaatccattgagtttgaacgcactctactaaaaaatcaacccaaaatccttaggcacatcataaaaatttgtcaaatagttcgtcggtactaagtcgtaggtaaagttagttgcgcttaatttccaacatgttctaatttttttctttaaccccattcctttggtgaacgctctcctttttttctttctttctttctacctcagcctcttgcacaatcactgtctccatcgttgatgcagatggtccaataattcgaagtcaaccttagcaagcacttctatctaggaattatattccatcacacaaccgacattattccacattttatttgagagatgaggataacctcaccaacgcacaaccccactcaaaacaacatcgaaacatggtagtcgtcatcaatttttctcataattcggcatgatccttctccttggctgatgatgtatcataggaccacgacttagggaaagcagccaagggatagtgataggtgtaccatgctaagatttgatcttaaaaaggctatgtgagtcaagtaacataagtatacaaataaatttggattgtaagttggaagtcccattccaagtcgaaagtctattgaaaatagcttggccaacgatatgtgtacattaactttagatggacacattgaacgttgcaatccaaaatatgcgcacacaaaaaataacttccatccggtgaaattcaatagcttcggccactgttacattgtaccagcagatgccttaaatttcaagtccctccagcccgtttccacgtaaggtttgacagcgcaaacgcacaattccatccctgctgcgacagtgtgcaaccgttttccgtccccacaaaacgggagcagaaatgacgccgccgcgcggaggttggagggagcaaatcatctcgtctcgtcaccaaaaatccgaaacgccacagcagcaccggccccgatcgaaacgctaggccggccggccgccctccgaaacggcgcgagatacgttaactcccctgtcgcggggaatgaaaattaccgccatgtggacaccccactgacagccgggccccacagcgccagcttacatccatcgggtcaaggaggcccaggacgtttccacgcatggcctttgcctccggcttcgccagtttaccgggcagcgagcagtaaccggcggtaacagcaccggccgccaccacaccattggcacggacaagcgacaattaccgcgataataacaacgacggcggtggcggcggcggcagcagcagcagcagccgcaccaaccacccttaagtaagacgagcggaggcgggccgcgggcgagggaaaggaggaagccacgggtcgctcgctcgtggtagtggtggtggatctgacacccacttcgctacgacttcccccatcccttcctccctccctccctccagtcctcttctcttctcccctcctcccacacctctcccctacctcgtctcatcgtgctcttcgcacccgcgcgattccgccccacgagcgccggcctccgcttcgatctccgcgacgggggccaatgccggcggcgcgatgagcgtggaggaggaggtggtgggggaggaggaggaggaggagctgttctacgagtcgctcgatcgcatcctctcgtcgtcgggctcctccacctcggcctcggacgacgatggggaccacccgcgccgccgccgcgggtacgacgcgggggcggcggccgcggccgcggcgctcgacctgtggacctccgagccggcgcccatccaggagcgacggcggcggctgctccagctgatgggcctctccggtgacccgtcgctcgcgcgattcgagaggggccgatcggctccatgcgacgccgtgggcccgctgccgtcctcgccggttgcgcggtccagatcgagcggcgccacgccggcatccgccgcgaaacccccgctcggaggaggccgcttgcgcggagcctcgtccgatgtgtcagatgccacgttggaggctgttgaggaggacccaaggtgcttgatcagaaacctcgacgacggcagcgagttcctggtgagagaggagttcggtctccgtgaggtcggtacggggcggcagctcaccatggaggagttcgagttgttcatcggccgctcacccatcgtccaagagctcatgcgccgccagagcgtggtcaattccaactcaaactccaattcccaaagtggcgcttccactcccattgagaggtccagctccggctccagcaatggtggggcgcgctacaagcggcgcaacagctggctccgcagcctccgcagtgcagctggctccatggttacatacactcgtgaccgccgcagcagcgacgagaaggatacatcctcagataagggtgggcatcgctccagctcggctacggatgacagccaagatggtgttgcaaaccatggcccggaccgtgttaaggttcggcagtatggtaaatcctataaggagctcagtggcttgttcatgaaccaggatataaaggcgcacagtgggtccatttggagcatcaagtttagtcctgatgggcactttctcgcaagtgctggtgaggattgtgtcatccatgtctgggaggtgttggagtggaagatgatagaggagaaggggttggaagaaaatggggtctttgatccagagtcgatgttggtatccacggcttcagagggaagccatcgggagaagaagctgcgggcaaaggcagtacacaatcagagatcagtaagctcagaccggttgatggtgccagaacatgtgtttgcactatcagagaaacccgtgataacctttgcagggcattctgaggatgtgcttgaccttagctggtccaaatctcaggtaacactcaaaatgctgctatatgcttgtcaattcgaatatgcaaatatttgttttttttggtatactcctgtgatacatactctgctggattgtagtatgtgtgccatcagacatcaggataatagtcacaataattaggtcttaactctttaaagttaaaaacttatgaagctattgccaaattagcagtaccaatgtctcatctaaccttgagaagtcatctagatctctggtatactgcaatgctactgaaaagggaaaaaaaggatgttggagatttgaacaaattggaattacacaaattgattgctcgcaatgttctgttattcgcaaataattctgttagatggttgtttataatacatcagtgcaattgtaccctttccaacctctaagtcatgttttataaagcatgcaacttttttgctgcttcatggtgacttaagtttttcatgttgagaacatctagaaaatccagcacctgttggtcaaaggataaaacattttgaatgtcagttcattcagttccatataactactaatctgttgatttaggtctctctttcactgcagtattaaaaacttttccattgataaatagattcaagttttttgatcatcaggtcaaaggagatattaagtttttcaatagattctgtagtctacagtgtactccaatcaacagaagatatttattccatcactaattagtatcacccagaagtgattgaatgtcatgagctaagtagctaactattttatgtgttgacatgacatgaggtcagtctttattgttcaaaggtgtgatttaatattcattatgtttttagtggagtttcaaaaggtgaaaaaaatagtgcacaagaatatttatgcacggttctttgaaaagaaatatgtccagcccccaaatgctagatgcatgattacagtgtataacttcagcaaattttgttaagcaacataaagagttaattgaagtttgtcgcctgccagattattgatgccaatctaccaagctagaagtcaatttcaatgtgttgttttaccttttgcattagacaagtgggcgcatatagtattaacgcagtaacattccttcaagatattgtatgacgttcataaggcttctgtatgctgttttaagctaccagtaca

SEQ ID NO: 67686 - DNA, 1571 bp, Oryza sativa
tgcacaagaaatataaagtaggatagaagaggtctctcttggaaacagcattaaggtggatgtagctaattaagaattaaccatcttactgaaaaacttaaggccttaaactgttaaaaggtggacaatctacttatagtataaaacttgaactcagtccacatgcaaggccaatcaactctccaaggtttagaaatctaaacttatgttattgcttatcaggctccgtcactaaactttaggagtctctttggcagcaaaactccgtgctagtttggcagtctgttcaatttgtatttctgattatgtaggcctgtccaactatttattagtggaaataggttaaggagatgatttgtaccaaattttaacactagcatattccacctacaaatgttacgatggactcatttgtcttcaaagtgcagtttttcacaacccaaagctaaatttgtagctcagggacctcatcagacgttcatgaaagctttaagggtgtaggaatatattagcataattcattcattttattatgattttgttgtatttaacagttaccccagcaccccttatctccacttttcaatttctgtgcagtacttgctttcatcttcaatggataaaactgtacggttgtggcacgtgtcaagcacttactgtttgaaaaccttctcccacagtgactatggtaagagcatcgctttcaatagatcaatatctcttcctcaccccatgtattgtccttctctcatatcaatttcttgattcagtgacttgcatccagttcaatcctgttaatgataaatacttcattagtggttccctggataaaaaggttcgaatttggagtatacaagaacgcaaaattgttgactggattgatctgcatgaaatgatcacagctgcctgttatacccctgatggacaggtttaacttgcttcttgttctacaatttttcagcaggggtttgcttgctttttttcatgttcattcaaacaccttgttttttactctttgtgaagggtgcactcgttggctcccacaagggcaagtgccatgtctacgatatttctggtaaccctctctctcattacttaattgctgcacatgtaatctcccacatctttaacttatttattccaagacctggtactgatagttggtactccctcctttccaaaaatataaacacatctagcatttgaaattcgtaccaatatttaagcatttctagcactttttagtattacttgtcccattaatcaccttcaattcaattttttcccatcttatttcttaccccccaagcatccctcatttactgggaggcataaagtctcttgtccttaaccttattatgtactaaacaacctagaaatgcttatattttggaaacggagggagtatatgctatgttaagcttccatctactgccattgtcatattatataaattgcctcctataccttgcaaacttattttatttttgtcttttgcctagataatatgcttaagcacaagaaacagattgatctacatattaagaaaaggaaatctagccagaagaaaa

SEQ ID NO: 67687 - DNA, 700 bp, Oryza sativa
aaaaactgaattggagatgcgggggatcgaaccccgtgcctctcgcatgcaaagcgagcgctctaccatttgagctacatccccacttgaactttatccaaaaatcatatgatctttacaaaattgtccagtacctgtggtcggatcagatgagcctttacgtaaagaacgtgtaccattttctgtagactctgaagtttgatccagttgcaaatgctttgcttggtttcatcgacataacgaaactgacgtcacaattcacctagtcacctctccgtcggtccaggctgtgcaaccaacgacccgcggcgttacacgcccacgcccgcggcgtcggggagtgacgcactggtcgttccttgcggcctcgaagcagccggatgcgactcctaggtcctcgcggccgcaacgaacttggcggccggtccatgattttaattggaataagttcaccaaccgttaatccactttacatacatcgagtctgtatgatatccctaatctctaatattagaaatctatatccctaaactatataaaatcatataaaaataagatcctataacagtatagatgtctaattttactgacgtggcattctagtcaacatatcttctagattatgggactcacatgtaagcgagtaacgtggggtctacatatcttctttcttctattttcttctcttctcttctcattt

SEQ ID NO: 67688 - DNA, 666 bp, Oryza sativa
cagttacccactcccgcttgtggtaagcacggtaagtttcccagggtttcccgtgaaccggtctttaattgcaatgggtgcgaccagcaaaaccatgcaaccccaacccaccattcaatgtattttaattaactaacaccattgcggtggcaccaatctaaaggtatgccaatagacaaagtctatgtaataatgtgatccctttttgtgtgctagttgagctaagcatggctaagcatttcctaggccaacatctagtcattttgatccccaagttatcaatggcataaggtaaccaatatgtggctgaggaataggacccatcccacattacattgtaaaacaatgcaatatttaatagaaatgcgggacatttgtaaattgggtacaatatgatcaattgcaatgtatgacttgccttgctctcgcactgatgagatcacagcaacgtcttcgagaaactgcggatcgacgaaacggccgaaacctacgcgacaaacaaagcacacaagcaaaacatgtataagactacagaaacaggaaacaaaaccatttttaatggattctttgcatttttcttgatttactgagacttgaatggacttaaacggagctcggatgaattacttatgaattttagaagataaactgtgtttatttctataa

SEQ ID NO: 67689 - DNA, 841 bp, Oryza sativa
tccactatttagttaagtactcccgttgtttcaaaataattttactttttacccatacatgccaatacaaaagaaaataaatagaatacccatactttatcaaaatacaattattatctactttatctatttccaatacaattattgtatttttttactttcacaaatcccgatacaattactaccaaaaatgaatttattttgagacaaacggaaaagctaaaaaataaacttattatgagacggatagagtatttggcttgttattactaaaatatgtcaataacacacataagttatacaaaaaaaatggcattaccgacgtttcagtaagatgccaaaattcgattgtggattgatcaccagatggaatatcccgtgtacgctttccactgtgcaattagcaaatctggcaccaccatccgttgctcatcatctgaccttttcctgagtggataatcatgccctgcacttccaacttccagcacaccacacaattcaagtattcaacctccttttcataagcagaagtatctttgtcacactctactactactagtctactagcactcctaatgatcgatccttcccacgttcgaagcttcccctgtcactgtccatccatggtggtggtcagacaaccccagcacacaagaaatctgccatttgcccagtccaccgctgggttgcagtttttgatgaagagattgacttgacctgagcacccttccgattgtaaatagcagtttttgtattgctgttggttgagtgattgggcaatcatccaatacatatcttggcttcttggctggactccagtacccgaggtcgcgtgcctccg

SEQ ID NO: 67690 - DNA, 1205 bp, Oryza sativa
atcgtattcaaaatccaaatcatgaggtttaagcattcaactaaaaaagcgccagctaatatcacctaattagctcggaaatactaaaaaaaattccccctaaatataataaggtacctacaaaatacaaatgcagcagcctatttcaccgatatacaataccataatctccaacacgtttgcagttatattaaacgagaaaacgctagaacacaagcctatctaataacgccagaaattagcgatacgatccggtctaacctttgcgaccatgcgctggaaggtgatgtcctcatcatcaatcttgtccttccccttcccccacttcctatctgcagaacccaaaatcaatattgaacaaccgaaagcgcacagaacatcaatgggggagaataataaaccgggaagaaggaaggatgcgccggaatcgcaaacctttggggtcgctgagattcgtgtactcgcggacctcggacctgacatggctgccggcggagaggaatcggaaggtcggaggctcggagacctaaccctagctcctgttacaagaagcttcgagacgtgtggcttggctgatgcctctgggcttcccgtttcgcttgtccgaagtgacgatggaataaagagaagaggcgatccacgcaggctcgagacgaagggggtatgatgttaggcaggccggaatcatccgctagagcctcaggctgggcctgtttatggaaggccacatgggccatggcccagcttgaagccacccatctcagcatatttggcagaaaatctaattataacgcattttctagagataaactttaggtttttctttggaagggagtgttgagttgtgatccaaattcatttgcacttaataaaaaccagcttctgctagagcgaagtggaggccctgccggatcgtatcgtaatcccttttaaggtcccacctcatatatatacctcttgtaaatcgtcgtgcggcgttgtaaccttaccctgatatagtgaagatattttgctggctggtacccatggttttttctctccttctttaggagggttttccacgttaaatatcgtgtcatctatgattgatctattgttctttatcgtttgtttgcctatcgtttcctaacatggaggatcttcaaaacgaattcatgggagatgaactctgaaagtcttatgaaattatgtgtttcagaggattt

SEQ ID NO: 67691 - DNA, 6251 bp, Oryza sativa
ttataaatttttcaaataagacggacggtcaaacgttgaacgtgaatagtgcaaaactgcacttattttgggacggagttagtacatatatatacacattacacattgcatacataaacatacaaccacactgccctctagctatacacatgccatgatgccaagagccaatgatcaccacccaaatccttctagcaatagctccctatggcacaaacagtcacagctgcacaaacacacacacacacacacatatcacccattcatctactctagctaatctaaaggcactagcatagtactacaatcaaccagtagtagtagccctcatttgcatgtttttatttcgcccaccaatccttggaatgttttagattcccccctctcactctctcatcaaggaatgagcatcccccattctcccccaacccctcatattttcagtttctcactctacctttcccctcctcccctagctaacccctctctctttctctctctaaagctccaatctttctacctttctctctctaaaagctggagtagcttaatttctttctttctttttctttctcagctgggattgcacagtgaagctagggagaggctatagctatgggggtgatgtagctgggcagtgaggctagtgacaatctctctctcacacacacacacacaaaaacacttgtgtatttttggcagatgatgtcctgtcaaggaagctgcaattgcaagcccagatgttggacgtgcacgctcgccctccctattaaacccgccctcctccgatgctccctctcctcctcccccctcgccgccgccgccgccaccttctccggcagctcaccgtcgttgtagtagctctggtggtggtggtggtgacgacgacggctacggcggcggcgacggcatgctccggtcactccactcctcgtcgtcttctgacacggataacaacagcggtggctgcaagaacaatggcggcggcggtggcgaggccgccgccgccgttgagggtggcggtgatcagcgtgccgttgcggcggcggcgccgtcgacgcgggacttgctgctggcgtgcgcggacctgctgcagaggggggacctgccggcggcgaggcgagcggcggagatcgtcttggcggcggcggcgtcgccgcggggcgacgcggcggaccgcctggcgtaccacttcgcccgcgcgctggcgctccgggtggacgccaaggccggccatggccacgtcgtcgtcggcggcggcgcggcgcggcggcgtcgtccggggcgtacctggcgttcaaccagatcgcgccgttcctgcgtttcgcgcacctcacggcgaaccaggccatcctcgaggccgtcgacggcgcgcgccgcgtccacatcctcgacctcgacgccgtccacggcgtgcagtggccgccgctgctgcaggccatcgccgagcgcgcggacccggcgctcggcccgcccgaggtccgcgtcaccggcgccggcgccgaccgtgacaccctcctccgcaccggcaaccgcctccgcgccttcgcccgctccatccacctccccttccacttcaccccgctcctcctctcctgcgccaccacggcgccccaccacgtcgccggcacgagcaccggcgccgccgccgccgcctcgaccgccgccgccgccactggcctcgagtttcacccggacgagacgctcgccgtgaactgcgtcatgttcttgcacaacctggccggccacgacgagctcgccgcgttcttgaagtgggtgaaggccatgtcgcccgccgtggtgaccatcgccgagagggaagcaggcggcggcggcggcggcggcgaccacatcgacgacctgccgcggcgggtcggggtggccatggatcactactcggcggtgttcgaggcgctggaggcgacggtgccgccggggagccgggagcgcctcgccgtggagcaggaggtgctgggccgggagatcgaggccgcggtggggccctccggcggccggtggtggcgcggcatcgagcggtggggcggcgccgcccgcgccgcggggttcgcggcgcggccgctcagcgcgttcgccgtgtcgcaggcgcggctgctgctccggctgcactacccgtcggagggctacctcgtgcaggaggcgcgcggcgcctgcttcctcgggtggcagacgcgcccgctgctctccgtctcagcgtggcagccgtcgtcgtcgtagccggcgacgaagacgacgatggcgacggcggcggcgaccacgggctagggtttgccaagctcgattgatcgatcgatcactactgctcccatatataaatagagaatatatatatatatattatatatgaacatttgcatagatgcaataatattggctactcgatctctagttagcatgcaagatctcatggaggttttgggaggatgtgaactagttgggtttgcaaggaggaagaaaccctaaccctagctagctgcttcattaattgctgttaaatctttggttgttttgcttgcttggctagttaatcaaaagctgttaattaatttcgatcctgcaatgggatggagaggaggatttgagaaatgcatcatagcttaattagcatgaggatggcaatggagtttgaagtgatcaagaacatggtgagaggctactactacgtactagtaccaattccatgttttttctctttttttttccatttttttttgtttctgcatgtctcactagttcctgttggagatttacatagttctagggagattttgtctatatgttggacctaaatattgcactactattaatataatttgttaattttgatgtgaggatttgttgctacacatattattgcttctatatatattctcagtgttctattatttatttggatctgtagatcttgcaaaatggatcatatccaccatgcatgcactttttctatgaccttcatgtttttttagtcatgtgtgtgtaatattaatttcttaggcatggaggccaggaggggatcttctagctagcttctatagctcacttgcatggcctcattttataatcctacatttcacttgcttgttggtgcttgatgcccttgttagtattataactaatcatgcgttctttggccagcactaaccataaactaatccctattttgggaggttgtttatgtgggagtaatgatcactcctgtagtgttgcaacttgcaaaggcaaacaaatcaaattgtatatatatacagacaggttttgtatatgatgctaattaatacacctagctatagctagtgttttctttttcttctaatgtgctcttagggagaaattaaagaaaatgttgtgtgtctcctctcctgcccagggagaaggggtttgggggtcttgttttctgtgacacatgcccctgatatgctggtaagctgtctttgtgagggcatggcatgatcccatgcatcaatgccaccctaatccctgccccctgtcccctcaaacaaaatcatgggatttctcaaaaccaagccaccccttttggtggccaacttgcccccttaatctctctctctctctcatatatgtggttgcaagagtagtttctctctctaagagtgaaaaagatcattcccttttggaaggacccatgttcctctctccattgccttgggatctttgcatgcatgccttcttaattggttcctcaaagagagccatgccggccatgccctacttgattccctttggttgcctgtctctcatgttttaataatttaattaagtatagattggtacctcttcttttatatctgttactaggcagttgtttttagagaatttttgtgtgaggcgtgtggtgggtatatatgtctgtgaaaaaaatatataaaaccaatcacacttgagttcagaaaaccaaatcataaaagtgttttattgttcgttaggagaggtgagtttatatcatatttatcttcttaataatagaggtaccacaaattaacaatagagtggtataccatggtacaacaagaaccatgaaaagctcaaatcataatgttgcccttttgttataattcaaatcatcagttctttatgtgatcacttgttgactgctttcacatactccagcctttccctattaaattttgtcatgatttttcatgaatggatggattatcaactagctatttttagatccgatgtaatctgaggttcctttggggggcataacttttgatagaaccaaatctagcaggtgtggtcaaaacattaattttgagataattaattatatataagcatattggttttagtagtagtatatatagcatttcatgtcaacttgttgtacaacttactagcgatagtgaatagttgattagacatatatgatataatcgataatagtatattgtagatggatgggttagtggggtacacgttcactatgaacaaatttgcatcgaataccttttactgccttgatatatttgtctgaaatcttgcgccagtgtaatgtggagtcgtatatacttgctactatataaattaaagaagatattgtagtatgcttaattaccggcagtaagattaattaataatgtatgggcccaagctgtccagctcaatgccatcagtgggagtgtcaaaccttatcttaatttcggtgcatattacaattatgctgaccttaatcttcctcgcacacatgctgcattgcatcatcctcacatctctttgactttgattaggctataaacaattgattgtagcttggtattttaacctcatcaatcttttcctcaagaaaaagtgacattgactgatatgtctgcagtcaggccctagctttctttgccttccaaccaatgtgtttggcataagaaaaaaaaatcctactactacaatgcctagtattctactacctcctcccataataagcgcagcggtgggtttcagtgcccaactttaaccatccgtcttatttgaaatatttttatgattagtatttttattgttattagatgataaatatgaatattactttatgtgtgatttaaattttaaatttttgttcataaatttttcaaataaaatagacggtcaaatgttgggtacggaaacttatggcaacatttataatgggacgaagagagtaatgataacatagctacattcacaatgtactgtaggagtatttgtgtttgcatggacatggcatcttataatcttttattcctagtatatgctgccccagctatgcactatatctatacgcattccataccataggtatatatatcataattaacctaagggagcatatgtaatatcacatccactccaaactactcctagctaggagtatgtactgcctacctcttgcttactctacttgccttccttgtagaacacctacaaaaaaaaggtggttcaagaaaacattttttttccttgtaagaaactcgaattaatagcaatgcaacaaaggtaagtgtgcggtgcagcacaaaagtttgttagaactgtcgtcgatcgatcatgtagctaggccttttgattactccctggattttgcgagagtttataggggaatctcttcaacttagtaactttttggagaccgatgttacatgacattcagcttcgtcaactccaatgaatctcatctgcaaaaatttttgtcaactacttaccggaatcatacgactttgtaatcttcctaaatgattgccatcttactagctactactaactagctagcatatatagctatcgatcacaaccaagctaactatagatcgggatcgctcaccagattcattaacctttttattacacatcctaatcaacgcataaacgttttcacattcatatatatgttcaagtgctatgaattatacatgaagataaatattgcgcgttgattttcgtttctttgaacatgaatcgggggggggggggtgcattcataggcgtgtgagtggatgtagcgtgtgcagtgatgtgtgtacatgtgcatgtactatgcaatcaaaaaaataatactaggttcaagctactccatccgtcctctaatataagggattttgacattttgtttgcactgtttaaccattcgtcttattaaaaaaaattgaattattatttattttatttgtgacttactttattatctaaagtactctaagcacaacttttcatttttatattcgcacaaattttttgaataa

SEQ ID NO: 67692 - DNA, 1323 bp, Oryza sativa
agtgcgccaaaaataaacattgtcagtgttatcttagcttgaaaaatgctttaggtttgaaaataagttttaggatgttttacttttaaaaataaaaattgaaaaggtttttaaaaacagaaaacctagacagtttcctgttggaacaagatacccttctatgagaccgtacctgatacatgatacctgttgtggtaccagctgcatggtacccgatatctgtgatacatgttacccggtacctgtgatatctaggatctgatacctgtaatatttgtgcaagagaatagttaatatgtctgttgtaacgggatcccattttataacagccgtctttaaaaaaaattgtaaatcccagaaataccagagtcaaccggtgactgcccatcttattattggggattggtggttttagccaatggccgtctcctctcctcacggagaactgactcgaaccgctgagaggcaacagagaaaccgcacggactgaacgaggcggcggaaataaaacaactcgaggctggaggctggctggcttccttgccgctgcccggctgaaaaagcccccgaagcagaggcttccggttgaagcaaagcaagagcgcgagggcgccgtcgggcatggggatcgtggagacgtggatgcgggagaagcccatccgcaccttcctcgcccagctctccacccgccgggcggcggcgggggccgcggccctgctcgcttcctcctccgccgccgcggcgtccgccgacggcgagcccggcgaccggagcatcccgcagctctcctccatcgccaactccgtcgtctcccgctgctccaggtacgccgttatccggttccggggcgacgaatctgttgttctctactccactcggggtttggggttgggggatggaggttgatccaatccatttagtgactgttttgcttttgctcatccgcaacgacggcagcgcttagctcggccgatctgggtgctctcgatcggtgtgggttgcattactctaccccgcatgatcacgctgaaatagtactgaactgccagagattgcataggacccaaacttaactcgtatatttgctggtttgctcagcggatgctaaaatcagtgtatgctaatccatcattgcttattaggtaaattgatttggtttaccaatagaagagtagcgtgcttctatagttatattctcaaggccgatagacttgatttcaatgtactggcatactctccataggacaatattgtcactcctggaaatggtgagggtaatattagctttttttatttctgagtaaatttcacgggctgcaggaa

SEQ ID NO: 67693 - DNA, 1620 bp, Oryza sativa
gaatatattaattaacacgcatacataacaccctatcagtaaccagctagtattcatataatgtaatttgtatccccagagtatttgcttttcatgttcctcttaaaaaaatgattgggccgtgttgctattacaatttcagtaagcttccatttctctctttcagcacaagttaattaccaattgcagtgaaggtttgatgaagtgactacttaatttgcctgggtggccaagatgcaaaacaacagttggtactcacagcattcactgccatgatataggaggataggacagaggatgcatgcacacacatcatcatctggtaaaggggcatgcagcatttgtgtgtgcaatagagatcccaatgctgatatacacatttgacgattggattctagtagtagtgggaggaagaaacacaagctttggttttgcatatctgtctcatgcaggcagtgcaccccagctgaatctttgggagcatctctgtcatctttttgtgtgtgtgatgtgcatgtttctgctctctctctctctctctctctctctctctctctctctctctctctctctctctctctctctctcttaaatgccaatgcatctatgcatatgctttgtaccacattcatatatatggatttattgcattgatgtgttgtgttgtactactgatgaggcaagcatcatgagatcatgctgaaggatgagcatttgggcatcaatgctgcccccctgtgtgcatgtttacccatgcacggttcctacagggcatcacatgaatacatgatcaaaccatctttattacagattttttttataagatgctcacctaagagtatggccaagaatgcttaaaaatctcccccccccccctaaatctccttttgaattctgtaacgatgatttaaggattaaaaaatatacttctttcccatatatagcctaaatttgactctctaagataaaaaaatgtggccacctataaatcccgcgcacgatttgcctccctcagcgctagtcttgctcgctctttctctcaagcgataccacacagattgcagattggaaatgagtgcgagtcaacttgtgtagagcgacttggacgagctggaagggattttcaatttttggacaggtggttaggctgttggacccatgttttcaactaaaatcacctaattttgggattgagaggagttttggagaattgttggccatgctctaacaattccaatggaacttcgatcgatatcagctcgcctttcaaataaaacctctaccattagttatctttctttacatttaggttgaagtggtgcattatttggacagattatttaatttgacctttaggctgctagaatttagataaactgcattccactaattatattaattgatatatacaaattctcgctcagaaaagttggtgattttatgtggcattttgcattatcatgtgtgtgttttttaggtgtagctagcctagctacatatatttcagtttgctgtattttcttaattaacctaaattatcttccttctaaaaaagattatcgtgatgtcgatcacgtctttgtccaacgaaaattaaccatcagactctggtgacctgaa

SEQ ID NO: 67694 - DNA, 3365 bp, Oryza sativa
gggggcagggagatttggaggcggacgcgcgggtggtgcgacgaggaggacgaggaggaggaggagaagatggagcggagggggttgtggccgtgcttgcggtggggcgggtaggcgtggacgacggcggcgagcgggagggcgcgcgcggagcgggagggctcgtggaggaagatgaggcggtgggaggtgaggacgaggaggcgggcgcggagggggccgaggcgggggctctcctcgggctccacgtccccctgcgcgacgaggtggcgctcgacctcccccgcggtcagcaccggccgccccgccgccgtcacgtccgcggccgggagccagtcggccgccgcggcggacatggtgatgactactgctgctgctgctgctggtggtgacccgggtgagctcgcgttgggtttttgcgtatttgggcccggattgcaatcgcacacggccgccgccggagccggacgagtcagtactcagtaccaggcagcaaggttcacaatttggataaaaaccggtcgaatttcgtgcgcttcgacatggctcagaattaagtttcgattaaaattttaaaggttaaacaatatatttggtcaaaattcagttaaaatttatcaaaaaccgtgatgtcaatgaggctcgaaatttagtggtcaaccggtaatgtaaaccctgagtcagtacacggcctgacgtcagcccgaaccgcgaagggcaacccctaaggctggattctaagttcactatcctaactttatcttcctccgttttctgcgcgcacgtttcttaaacggttaaacggtatatcttttataaaaaaatattttaaaaaaaatcatattaatacatttttcatttttatttagctagtacttttattaatcatgtcttaataagacatgcatacgtcattttgtgtgccaaaagctcttggattgtgcaaattccatatttccgccctaactcgaacacaaaaccatcttctcccttgatcttaatgtgtagcaacttatggtaaaattaaaatcatcttaaaactatgaatttggacatatcttgtctagattcacagtgctacatattgagacgaatgtagtatttatcttttgatatatttagagctccaaattttaaaaaccagtaaccaataaatacaacccattcagaatgaaatagaaaaacgaacatgtcaagaaatcacaagtccagacaaaaaaaacgtaaaaatataattttggtgcgctgcaaaaggttgtcctagtatctcgtgataatactatgattttatcaagtcgaaacgataccaatcctatctagtatcctactttttataatatctcgaccctcctattcatttctacacgattatatgaaatcttaagtattatctcgattctatgatccctaattccctatgatcctacaaaatattattcaaaataacgtggattgataataatataaataaatatgctcaagtttacatcgaaaccaattaaatttatcaaaatcattattatatgctttaatttatataatatattataattgctttgtaacttaacgtaagtctgacgtatcggaatacaaatcttaatacaagatcctaatagaagcctaaaaatctatagtaagtgaaataggaaaaccgaaatctagtgatgagctcgtattgatttgcgcaataccagcggggcaacaaagcgagagagagttaatatagcacaacaacacgaataagcatgcagacattggattctgcagataaagagtactccctccatactcatattagaagtcgtttaggacataattgtgcatactaaggagtgattaagtagagatattttttcatgtctgcccctaataaatagggatgtggatgcattctgtacgataagcaatcatagctcaaatggctagtgcagagatcactttctttttgcttgcaataactacgcatacgtgatgacgagcgcaacggacggcgagcgcagagccatacacgaccccgcgggcgaacgacgacatgtattgtgaaaacggaccaaaggccttagaacgacatctaatatgagtatggagggagtatacgattttcagttccgtcacatttctttattattcatagctcggctaccatgttcatatgcgttctgctgctgcctctgcacaacacatgaaccagagttcaatgtgtctaggcgagacaaagattccagcttttgtcaccgagaaatttcttgagcgatttggttggccaacgcgagagatcgattcactgcggagcaatcagcacgggatccttctttcccttgagaaagtccgagtaccaacgagcggagcgcctcgctcgccgcggccgcgcgccgtcgtcgaaatccacacggtacaggccggatcgcgactggtagccttccaggagctcgtacacgtccacaaatgaccaaacgaagtagcctctcacatcaaccccgttcctgcacaaagcagagatcaatcagaacagcatgaggcctcatgtttacgattatcagctaaaatctaaatttttaactttaaatttaaagttaaatttgggattatttttattgtatattatttttcagccttcgtttttacaccgttaagaacacatatataaaagttttattcgaggaataagccaaatgatggggctggaagatggattgaagtgaaactcatgtagtttgacacactgatactgatgtttggagatcacctgattgcatccaggacacctccaatgtagcccttgatgtaatccaccctatcagggtcgtcgagactgtcatttgtagatcccttccctgaagaaaaagaaaacaggcaagtgagaaagagtattgtgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatgaatttgatctcccgcgagaagaagaagacacacttt

SEQ ID NO: 67695 - DNA, 7476 bp, Oryza sativa
atcctggaattaaattaagcccactatgtggctgcaggaaaatataacaaaaataaatcgtcgatcggtaaatttattgcttcgaaattaaacaatatacaataggatgcctctagaaacataagcaacttgcatcaaaaaatgttgagttcatcgatcatgacacataaacgtacaagttaagcattaaacacacgagcacaaacaaaaataaatattattgttagcacatactccctccatcccataaaaacgaatctattatcggatgcgacatgttctaatactataaatctagacaaatgtatgttcagattcgtagtattaggatgtgtcacatccgataataggttggttttttatgggatgaagggagtacttcctctgtaaaaaaacaaaccctagcatatcaaaaataatttaggaaagagacaaaaaaaactataatatccttaataaatgtaaaagttgtattgattaatatgtaggtgagaagtattgaaataataaaatttctcgatttacggattggtggtaggtaagacggtagaagttgatttattttgggacaaatttaaactctaggagttgatttattttgggacggagtgagtatattttcctctggcggtttcaaaacaaaaaaattcctctggtagatggtgcacacattaacaagtatagatatatccatcgctgtgaattattttgagtgtgattctaagcaacttgcatctaaaaaattgagtttatcatgacaatggcagatatctgatcattccataattatgtatatactgtataaaaaaatccccatatttttttaataatttcgtaccattagtgaatcctagtagtttctagaaagaaccacatgattcaacgatatatacattgctctcgttgaatacgattattatattttattagttgctacatgcattatcaccttctgcattaacgtacactttggacgtgtacttattacttaatctactcattgagcagtagtaatatacacccgtacgtgcaacttataattaagataatctcgtttcatgcggtagtttcacacaaggagaatactgctacaaagtcaaaaaactactttaatttacaatttggtcagattccagctagtttttacttaactggtccatcgaatctgccgcaaataaaggatgtattttgtagggggaaaaataaaggacatattttgaccatgccgtgtttcatgatgtatatatatgaacttgcagttttcaagataataaaaattaagttcgcagtatttaaaacatttcagcaagtttcataacttcaaacttcagtagcctgcatgcatgcaattaatctcgcaaatgatcgatcaatcgagcgtgctgttttagggctggtttggtttgaggcctaaattaggcttaccaatatttgacaatttcaatagtgttcagtatctatttggtttgaagccaaattttgacatgtctaaaaaaatagaccattttcaatagtgaatttaggctattttggcttcaatctaaacataactttgccttaccaaaattagtcatgccaaaacttaccaaaatttagcattgacaaaatttggtaagacctatttaggccacaaaccaaaccaacccttatctgccgtcagatgtcctcgcgattcgtgctattacggccccgatgctctcttctttctccggcaccctcggctcgtgatgaggtcagacaaggtggcagggggtgattgtcaaaaggcccagtgggacccacatgcagagacactcaagcaatgatcaatgctgacatgtctatctcgcaacactacagtgatgtagaaacgataaattggagaaggtacgaattaccccctcgaacaatcgtggtcgtctgaattacccccctaaaccacaaaaccagacattcttcatcctcaactatgcaaaccggacgaattaccccctcaacccaatacacggtggttttggtctacgtggcgtacacgtggcagtctagtcagtgttttttaattaaaaaattgtaggacccgcatgtaattctcttattcctctctctctcgcgcagcgcgcacggcgaggatgagcgcggggacgggcggtcggcaagaggctgcgccgcgtcggcaagaaggctctggctgccgaggtggatctagacgagggccacgcggcggaagagcgcgatgatggtgcggtggtgctcggcgcgttgagcgagaggtagcaggcgaggaggtcttgcaggtcctccaacggccggacgccattggtgcacaacatctcgatcatgctgtccaccagctccggctccgtcaactccatcaccaccgcctcgctctcgtgcagccacatccgtcgccgccgcggccgtcggctcggcttccccatgcttactgacgacgacgacgccggcaccggcgccggcactggtgtgccggcattgttgctgttgtggccaccgccgttgctgccgacgcgcgcgcggcagccgacccgagctccatgcctcatcaccgagctcgcctttggatctggggtggtggagcgggattggtgagtagaaggggctggtggagcgggattcccggtcgccatccatgcctgcgtcctcgatggaaccgcgtccgccagtctccgtcgccgatcctggcgcagggaggtgggatggggcgcggcacgaccgctcggaggaggagccgcggtggcggcggtgtcccaccgcgcgtccctgcgcgccactgccaaggaggagcccgctgcccaccatgcgtcctagcacccccacgatgaggagaaggagcctacggtggcagcggtgtcccaccgcgcaccacgcgtccccacgcgccaccggcgagtaggagcccactgcccaccgcgcgtccccgtgcgcccacgacaaggaggaggagcccgccgcccaccgcgtgtccccgtgcgcccggttggcctccgcttccttcgccggctgccgtcgtcctcgggccccctccgccacccacaactggctctgccccccgcgcaccgccgccgtcctcacctcgccaatcgaatcaacgatgcctccgcctctgccttcgcgccgacgtccgcgccgccacgctcgcctcacctcgctgaccgctcacgccgaccgcccgtccccgcgctcgtcctcgccgtgcgcgctgcgtgagagagaaaagagcgagagagagataatagagagagaggaagaagagtatgactggcgtgccccacaatttttttattaaaaaaacgctgactggactgccacgtgtacgccatgtagaccaaaaccactgtcgattgggtcaagggggtaattcgtccggtttacatagttggggttgaaaaatatccgattttgtggttcaggaggtaattcggatgaccgcaatagttcagggggtaattgatactttttccttaatataaagttagggcacgaaagaaaaagacaataacacatgattatgattaattgagttttagttactataaatttgaaaaaagaatttatttgatattttgaaacaactcctatataaaataatctcacgtaaaatatgtcttaacagtttttaaaaatatgctagtaataaaaatcgagctaaaatctgcaggttaatcaccaccgtacgtgctcaatgcatcaaatgaatcgcatgaacgagtctaccttaaaacaagaagaaaaaaatacagagagggccacttaataacgtgattagcaccggattaattactgcattcccagctaatgacgcatctggtggctcagctaatcacgtgattagcccttgccaatctcgtacatcctgcgtgccagctcatcgcatctcgaactggcactggcagctcatctatcttcccgcgaattgtgcgaagaactgggccgggctcatgccctttggcccattaggcctttctccttacagcaaaagtttaatagtagaactcaccacttactacaaatccatggtatacctaacctgtataacaggtttgctagtataaggttagctctatttttttttcttttctctctttctcacactataaattaaatgcatatttttgaagcatgtctagagctaactcttatatgagagccaacactctcatttttctttatctatcttacacacaagcatataacttatttataagtcactattatctttataattatatcgtctatgtaaaatgtgtgtcagtatgtgtgtgtgagagagtgtggtagcacggaatcctgcgcaagtaaaaattaggtggatttattttgttgctttgctagacttaaaatgctaagtattactttcgtctcaaaataaaattatttttcacccatcttacacataccaatacaaaacaaaaaaaaaagaaatacccttataatcaaatcccactacaactattactcaatttatctactcccaatacaattattattttttactttcacaaactctgatacaatgattacttaaaaagaacttatttttgtgataattgaaagaaactaaaaattaacttattacggaacagaggaagcaacaatttgcatatagatcaattatccagcggatagaaacgaaacagatgagatggcagagcttattattataaattttattagtagagagtgtgtgtgagttacaccatgcatatttaatcatccaaagtttagaaaaaaaaattaagatagcatactcgtgccatttcgaaaccttgagggttaaaaccacgcaactcttaccactacactatcaattgcatcttcaaatacaactacctttatatatgaattaggatgagtagatttatgggagaatatctaatatggtccctaaagtttcacttctgggtcattttagtccttaatctttcatattgttcaaacaagtcctttaaatttgttatgtgggctaatatagtgcttggtctcaccaaaacgccacatggacatgccatgtcaccttcctatgcaaaatctatatgatttgtccaatttacccttacgcatagaaaaataaaaaacaaaaggaaaattttttaaaaaaatatatggtatatgtaatagcaaaaatatacctcaaaagggtgaaaaaagaagtatttttttcctatggttatgtctaattcaccattatatttatttttctatgatatatataagggtaaattggacagttcatcatagattttgcatgaatgatgacatggcatatccatatgatgattttggtggatccaagaactattctaggctttatgacaaaggttaaggatttctttggaccatttaaaaggttaggaactaaactgatcctacagagaaactttaggactaaagcagctattctccctagatttgtaaagtaagctaagaaaattcaatagcattaaataaatacacttagtatgaagacttttggataagacattgcccctattattcttaacagaccactatgttttaatggtagcgggtatcttactaccaccgttaccaaacttaccaccgctatttaagtactagaacttaaaatggatctacagaggccaggaagaataaagaggggaggtagccaacaacaaggagacaatagtcacaagacggtgctcatcagtgtaccgtgatgcagactgaggatgaatcacatccccgttgtatttggacccatatatatgtgaacaaatgtactctccattcgacgacactggtagtacactatacataaaacatgggtgaccatgccatcctatcctcctcctgctgctgcatgacatgagccgtcagctcagaacacaacgctaacaatattcctgcacggccaagtggcatcacatccctctactgcaccttcagttggcagacattattatatcgttcagatttttgggtctttcttttgccattgtttggcacctttttttaggggaaaaaaaacctagaaatcgatctatattatgcatacagtaaatatccgtgatattattatttatccgtaaataaagagatttgcttcggtcaaaaaaaatacctcgttgtacttatcttgatgttcgttttgctggaccagagtaaatctcgtaaataaaacactaagccggcctcttctcatcatctttagacactacggtttaaatggatatggatcctccacggtattgtaggagtatttaaagtcaatgagatgggagcttagacgatacaagtaagcccacgtatcagtggctctcattaccctaatagtattgtaaagagtccttcatgaagatcatgaaatcagtttcacaggattttatagttcgatatcaacaggaaccatactatgttccagacaggctaacagggtctattgctaaatgaatccctggtatttttgctccaatgaactgtcaactctaacacgcattacgagtgggatgtttgcttgagacatgagaaccacgtttgtggcattcacctttaaccaagttagcctaggtccacatcggttgtccatattctctaataaactaaaacagcttataggggaataaaaagtaatttataggtaaaatttttatatatgtgttattagcgacttaaaaaccaatgctgaaaaaaaactatgttgaaaatatcttaaaatcaactgcaaaactaaatttgaaaatttaaattttagcttttgctttagcttgttagggtaaccgatggggctcgttgtatttggctgttaccccactttactataatttgccacatgtgtggccacgtaaatgcatgaattgccgcactctgccaaaacttttgttgtaaagtgagaatatcatcaaaacaacatttaaaattgttgttccctccatgctaaaatataaatagttcagaattttttcatgcgagaactaaagagaggggtgtttataattggttaaaataagaaagtagatgggcaacatataatggggaaattacacatgtatcgagtaattcccatggttttattctccgtaggattaatattgcaatcatgtatttttttggattcttattcttttttggattcatataattcaaagaagacctaaataccaaaagttgctatactttgaatggaggtagcacggttcatagggccgaaaccgaaaacatcacatgtgctctcatgtggcgatccgtggacgaaacctggaacaagaaatactccagctagctagagcctagatgttcaggtagctggattcagtgctgcaaatgcagataaaccagcaccacatttttgtaccttggcaatcccaaatccattcaaatttcacttcatagatgcatgattacccgatggatccatgctaaagaggtcatcctcccattcgcgctagctccagaaatactttactgctccccttaaaaaatattccctccgtcccataatataagggattttgagttttt

SEQ ID NO: 67696 - DNA, 15204 bp, Oryza sativa
ttcctgcacccctaacttggcttcaacgaaattggagctagtgctcatctagtggtaagtaaataaatgtagccataacatgcgaactcctagatgagttctggaacctctctttcgagggattttctaagattttcctatgagtagaagtgtttctatagcttggttcttgacatctatcccgagaggcttgcccactatcaggattccttaaaccaaccaaaacaaaccaaacaacacatcacgtattttatttgaacttctaaagatgcatcctactaatagagatagcaatctagcatcgaggccaagttgtttatctagtttaactttttgagcctcttgtcgctgtaaatttatctggcaacttcaaaactgcactattatgtccagaatttgttttggaaatttaaattatgttcaaattatatgttgcaaaattaagtcaatatttttttttagaaaacacattataaacgcaaacgcttacatacacacgcataggggttgacaaaataagaccgaaccgaagaaccgaaccgaaaagaccgagaccgagaaattcggtctcagccctcaaaagaccaaatttttttcggacaattcggttattggcttcagttaactaaattaaccgagaaaaccgaattgtggcccaataggcctaggaggcccaataagcccagtaaattgctaaaccctagaagtcaccgctcctagtcatgagtcacgcgacgccctcaacccatccatcgcgccacctccgcctccgatccccatccatcgcgccgcctccgcccatcgcgccgcatcgcctccgcgggcatccatcgtgccgccgccgcctctagccagcccacctacgccatggccccgatgagcgccgcctccagccaacccgcctccgctgcaaccccgacgagcaccgccgaccgtcttggcgccgcctccagccaggctccgccgcggcccggacgggtgccgccatccgcctcggcgccgcctccagccgagctccgccacggccccaacaggtgccgccgtccgccttggcgccgcctccagccagcccgcctccgccacggccccgacaagcaccacctccagctgggctccgccgtggcctcgccactagcccttgtcgccgagccaccgaacgtctccagcgaatcggtctgaccgagaccgagatcgaatttgccggtcctgagtttcttggatgaaattccgtcctgatttttcaaaaaccgaaatgaacgaatgaacgaagaccgggaccgaatttttcagtcagaccgaacgcccacccctacacacgcacactcgctcctgtcaactcacaccctactatataagcaccttcgagagactggaccgatatattttaaaattgacgatgtacattattatcggcggatacgtcgcttcctactgaaataataattactccctccgtccataatatagcgatcgaaccggatgaaatgaagagagtagctgtaaatgtgagcattcacatcatgtgggtagaaaattcgaccatgtgtctccatttgtaggcttcaatttttttttggcaggccgcttccatttttgttaagatatttggacggcagataatgtgtatactggtaaccagttctaatcgtttggttagtttagtgctcgaactcaaaccttgtcatcaagaattcggacttggggaagccggcaagtaaggttatactattaatttttggatgcactgttccattaacaagaggaaagtgaaagcgatgtgctactactacatccaacaaattaaagcaattataatgcggcgtgatgatataaatgatggcaaccatctacacaataactctttaagttttaaatttaaatatatttaaagctttgcttgtcactctctgcaggcgccttgcctccttttcatatgtttccttgaagcaatctcgccgcgtgtaacttttctcatcaaaagataagcagcttgatcatgctgatctccttaataaaacagagcctttcttcaaggacgccaggccggcctgatcctaccacctgattattttttaaaaaatttggatgtatcactgtatcatcgcgcacaatgattatattattgcgttaagttctcacatccaacacaaacaatgatggttaagtccaacgcgtgttcgtgtggcagctgtgtcgagtgtttaaaaaacaaaaaatcttcatgcaccttgcctgatgcctgctagtcccgtgatctctacgtgatttgtgacacgcttatagcatcaaggatcgcacaacaaattggcgtgtagcgcgatagcgtcgtccatcggcgagattttgtcggttcgagacctgatctcgtgtgagctaagattaccacgatttcatatcacggcgacgcaaacatgcaatatactgcaaactgcgtcccctcgatgcaaccgcgctagtgccggtttatgtgttccaactgacgcttcccatgttgccggtcgctgtcaacggcgttgttccgctggtgcatggtcggtccgatccgatcgcaaaaccgagtgcgccattcgcagacaaagccggccgggatcatctcccctctttggctccggtcgtggcttcgtcgtgggcgtccaaatgggggcgagtcgttgtgtcggctgctgccactggccaggctaaggcgcgcgagcggtcacttgcgcggcgcgcgtaggatggaatgattgccgcgacgtcacccggccgcacttgcgcttgcgcttgcgcccggtggtgcgtcgaggtgaaaggtgggtgaattggtggtggccctgtcgcgctcgcgtcgtccgtccgatcgacctgaggaggtgtggcaactgggcattggcaaatggcaataccacggcgcgagaccgaacgccgccggcgcgcgtacgcctcgttgcgttgaggtggtttggtacttggtgggggcgattgggcagccagtacgagtggcgctcggctctgcggttgattggcccccaggttgtgaaatatggctggaactgattagctatgtgccttttggtacggcgctgccttttacaaaaaaaaatgctcaagtttatagaaataacatcatatgataatagtagaaataacgtctaagatagctaaatgacaagtttatagaatttgtttttttatcgatcattggaaaaggctctaaatgtggtttatgataattcaaatagtatatagattgataatacaaaagtaaaaaaatagatggtgtgacttaatgagagaaaaaatgagataaataatttggactataaattaatcataaaaaaattagaagaggtggatgatgtgatttaatgagagaagataaaaaacattaactaagtttggaattcgttactaaaccccaatactaggtataacccacccccgaactaccaaactgtgtcaactttcatcccaagacagaatggctcagtgactccagtttcgtttgatgtgacgctttgactctggccaattgtatttaatcagcataagacccatgtgagcctaacatgtcagcaaccaactatttccttctttctctctcctctctcccctctcttccccatcctcaccagggggaggcaagccgtggatgacatggacaggggcgatgaccggcatccagtaggagaaggaggaaatggcaaagcgaggaggtggtgtcgttgtggcggtggcgggagggagatgagggaggtggcggtgctacaacagctaatcggtgaggtgcaggagctctagaacctctaaggtgctcacttcgttccccctccctaggcaagcaagcaacaagtcaacaaccatctctcctcttcccccattctctaactctcttgttcgtcatcagcctgcgatttcctcgctacgcttctccttcgcgtacttggtcaggcaccgacactaccacctgctgcccgtccgcgaacgcgcgcctcagtctgcccaccttccacacgggatgacactgctgccgatttccaaacctccttcgccaccacctcggcaatgattcgcacttcctcccgacgctggcgagtagcagacattagccgacgaggcctacaaccctgactgtctaccacccaccatcaccacctcctccctggcgcatctccgtctcgccgactctaccaccaccgccgtcgacgatgacgatgatgaaagggataaaagaggggaaagagggggcgacaagtgggtctcactgtattttttaattattaatcgaacacttactgataggtgggtctcatgtttttttttactttaagtgccatatcaaccccacgtaggcgtcatgtcagtcgaaactgtcgttcaaaccaccttggaatcttatttgcactggttttgggagttgagggacacatcatatctgttattgtggttcatgacgaatttcggactcggtgacaattttgagggacctaatgtgaacttattcctcccgggaaaaaaacgagcccaataggcgtgttacttggtccaggacaggcacgcgtatgaagcctgcagtaggcgggccaactaaacatataatagtcctcttaacgttcaggcccaatagctggagcaattggagaccagtttagggtaacaaggaattttctcgattaatgttatcgagaatatagagcggtattctcaaaaaaaaaagagaaaagaatatagagcggtaagcaggtgaatcacggtaaaaaaaacgtaattgtaggaccaaaccatccctaactttaataggaaaaaaatgactttgctagtttcaaccctctttgaaacatttcagtacaggatttacaaaaccgtacgattaccacacggttataatggttacaataattatcatgcacggttactttttcagtttttaaaatcacgatatgtctcgtggttatcgcgcggttttcacggtaaccaccttatcacggagtgcgatatccacgtcgaaaacggtagggaaacctgaccacgacacgtcgagacatgttcttttcctttccgcgcgcggcaacgcggctgtataaatactcacctacgcagctacgtccgcatatttgcctctgccacacacgtacgcgcaaacgtgtcatcgtgcgacacagacgcttggcccccgcggagacgcatgacggcaagagtcgcaatgcgctaagcaaacctctccttgtgcagtggagtcccatacagccgcgcgcgagtggtggtgcgcacctgcatggaggcaccactccacttcacggcgcgcaggtacccagcattttccgagaccttgaccgtaaaaacgcccgtcgcccccacacgcctggccacggcggcgtcacgccaagtgtcgtggcgctcggggtggaagctatagtgcccagacctttgcctcccttctcagatcactaggagtactccagatcagtctcagtagtcagtacagtcctcctccttgcttccctatataggcaggttcacttcaccggtgacacccactacccttgtctgttgtctttgttgccaaggaggaaagcaaacaggggccttgcaggagctatcaacaaaagccatggtctccatgaggaagaagaagaaggcctttgctgttgcagctgcaaccaccttgctttcccctcctcggtcctcctcctcctcctcctccacggcgtcctcctgcattgtgccgccgcgcactgagagcggcaagaagaagagtaagcacaggaagagggccaaggatggcaccggcggtgacgacgacgacgccgccgttgctgctgcgccgaggaagggatcctccatctacaagggcgtggcaaggtctgcgttttcgattcctttttcttgctctgatgatcagttcgcagttgtttgcgtgatctttgcttggtttctgatgaatgcgtcgtttgttgtgtgttgctggtgtgtaggcacaggggttcagggaagtacgaggcgcacctgtgggacaagcaaggctggaacccaaaccagacaaggaagagaggcaggcaaggtgagaaatacaaattctacgagcctcgggtctactatgttttctgcagctaatgggacaagttgattgccattttgtttttctttgttctctctttctttggttattgttaggtcattttgtattcctgctagcttatgtgctgatcttttttaatttgtgttgcaaatgcggtgtttccttctgcctcggaattcgtgtggtgatcgatgctcatccatgtctgatgtctcatcgcctccattagtctatctgggtgagtcaagatcctcttcacatcgtgggaaaagttcacaaactttttcttcgctatgattcacaaattatcactagcgtgtatggctccgaattccattgccgtcctagtaccatgcacatattctttcttcagaataactttgaatccgcagctactttgttctttctttcttggaaaagagagtaattctttctttcttggaaaagagagtaaagaagaaacacttttgggtaaagtggaaaagtactgcattttgcctgtccccatgcatgcgtcaagatacattttttacaacttcaacagaatcatcaagatcatgctctcactcgctaccagtacatttttttttatgtagaacatgctgaaaatacacggattaagccattagcattgtttctttgcaggagcttatgacacagaggaggctgcagctcgcacttatgatcttgcggcactcaagatctggggctcagaccatgtcctaaacttcccggtaaagttcagagtgtttcagcacctgtcatttcccagtagcactaattcgccgttactaattaaggaggagatgatgttaacttgttaagctcccatttgtgataaatgcagattgacacgtacaggaaggagcttgagaggatgcagcgaatgacaagggaggagtacctggctactctgaggcgcaagagcagtggcttctccaggggtgtctccaagtacaggggagtggcaaagtaagcatacattgtcatgcaatatcactgtactgtccaatcaagcactagctaagcattgtcctttgcatagcccagtagtactagtacctcttttccgtccaaaacccatttcttggttctccaaatggcatactgtgatactggcaaatctggcatgagaatacggtgtgctactagtactgtgaaaattgaaatgccaaaaaccgggttgaagttcttttgccttggctaagctctactagtaggagtagtctcaacatttgactgcaatgcccatgtttgtcaccgcaggcatcaccacaacggccggtgggaggccaggataggccgagctgtaggcaagaaatacctctacctgggaacattcggtaacgcgttcttggttttgttcaccggctacattctgttcctgacgccatgaaaactgcagtttgttaacaatggacaaccaatgcacatgtatcagtaccaccacatatgttcgtgtcgtatgttattcgctttcgtgattgttaatttgtcgtgtcatgcatgcaatgctgcctttctctttggcacaatgtgatgcttgaagaatgctactgctgcagtgctgcgtactgcacggctactgttacaaaggcccacagaatgtgccccctgaaagatggatgtttcttttgctctgtacgtgcagatacccaggaggaggcagccacggcctacgacctggcggcgatacagctccgcggccgcagcgcggtcaccaacttcgacgccagctgctacacctacacggaccacctgccgccgccgccgccgccgcagccaccgtccgtctgcaagaccgagccggagctggagccgccgcagccggcggcgcctccaggctcggagtcacttctccggcccaagatggagccctgcgacgactgggagccgccggcgatttgcccgtcgctccgtgacgcggacgacgcggaccacgccatcgccgagatcctgccggcgctctgcatggaccgcgccgacttcgaggccaggtaccctgcccgccgcgcccgcgacgccgccgccgacggctggtcgacgtcgtcggacgacgtcgccgccgcctccgtcgacgatgacgtgctgcgtagcctgccagacgacgtgggcttcgtcgacgacgtcgagagcctcttcctggacgcgcccggcccggccgccgccgccgccgccgccgcgatgccagacgacgtggaacgcgcggtgcagcgcgcgccttctgccgcgtctcgtcgggccaacgccgcggcggtctcctacgcgatcagctcgttggcgtccgggcgctggtggtattgacatcacgtactgacgtacgtgtcggtgtcacgccatgtcgcgcatgcatgcactgtgtttgcacagcttcgcaaagttggtgaaactgcagctagccagctatagttagggtgttgcgttttggtgggtatgatgtgaagtgaagtggagtagcttgagcttgacaagcgtggtccaatttttggcgagtaattgcgggcgatatgctagccaggagtatctgcgtggctgctcgatctcattgtagtacgtgaaagtggaagaaacaggagaaggctcacacttttgggtgtaactccactgtggtagcgagctggttttggtacttgcaccctgtcggattcgggtataattaagctgccgcttgtccgagttgaatgttggcgtgacaagttgacaactccacgtaagagtgtgacaatcatgttaggccattcacaatacatctacatggcatttggcctcaattgtccagctaagcagattgtatacgtggagaagaaaagaaggtgaggcccatatattcaccagctccgcgcgtcctcatttggctccgagagcctcgtcagaaaaacagcttttttaatcgtatttgcacatgagaaagcatgacacagagagagaagggggagaagctgacccaaaaaagtaaatttttgtggtggggcccacatgagaaacagtttggtggggtccacctaaagacacgcgtccacgccgcattgtggagaggggagcttcacgctgtttcttcgtacgtggctgtttaggctcctcagaaaaacacgacgcagtgctaatgcctttaggacttaggaccctttgcggcagtagtggtaaacagaagtcatgggtgatcattggtccgatgcttcaggcgaaaccaattcccgggcgaaaccaattccaggagtgtgatagggacagaaaaacggtttacaaaattatcatgtgcggtaatattatcggtttttaaaattactatgatatacctcgcagtaatcacatgatttcacagtaaacacaaagttactgcggtaacagcattattttcgcgtttctaaaactactgtatatctcgtagtaaccgattttcacgagaaagaaactcacggttaccgtgataaccgttaaactttgagtgatgataaactcatctaaaatatatagtttggtgtaccttgttcagtaaccgttaaatcgtagggtaacggtaaatatctaaagcagtttggttaaccctactagtagctactattactgcaacaagctagctacgtgtacatacgtgtcgcgtgtgagcagaatgtatagtattggttaggagtacttagtagtagttggtacagccgtatttggctactccaagctcttgttgatttgacaggagtgtatagttacgattccatcaatgcatgttggtggtgagtgttgcaccgacgaacatgcgtgacattaaaatcttgtcgcctgcagtgcaggctacaaaatgaacctgtctagagagatgcggcaggctgcaggctgatcgctgacgtctgtaccggaggaacagtagtgagtagtctctctcgtgtggatgttgagcagcgctctggagataaaaggagttctaaactttttcttgaaacttttaatttttctatcacatcaaaatttttttacacatataaacttttaacttttccatcacatcgtttcaattttaaccaaacttttaattttactgtgaactaaagacaccccttgggttatatctaaagccttccgttgtaagcaaggtctatatatgaaaaaggagcaaaatttggtcgtgttggggtcttgggggtggctagtcgctctcttaagatagctgcattgctaagcttcctccagctatatattgaaacattctgtttttggcgaacgtacgtgcgggaggagttcagccaacctgcatgcatgtatgtatgtatacctggttcgcgctaaataaattaattcttactcgtcgaataaacgtatatacgtataaagaaaagtaagatatcgatgcttcaccataaaggagctttgtgttgaagctaggcctctagaaaacagaatggtcttaaattctgtcaaactaaaattaatggtctgtctgaaagtggtggaatttcacttagaaaagtcctgttttaggcattactcaaattttataggaattaaataaattaatttctagagtctgtacatataaactgtgtgtataagcttaaaaaaggaaaccgcatggtgcacgcgcggtgggcatgcacatgaaataaattttgaataaaaactatatgctcttaaaccacatactaaataaatgtttataattaaaaatgagcatacgcatttttgaaagaaaaaaaatgagcattcatatcataaaaagaaaaccaacaaacagatgagaagtcaaacaagttcaacccaactgacctgttgggctgggccgggtcaaacctgtcaacctacaccatccaccagcccaaagcgaatcctatcccatcattccttcctggctcggggagaaatgccgcccagaatatcgatcgcatcgaatccagtcaacttgctcggtgtgatcccacggcggcagccgcaagccgaagcatcggacggacagaaacgactgcatccgtccacgcgtgcggctcgtgacgacggtggtggggctcgcgttctctcccccagctatattatctcacacgactcgtgccacaccgcaccgcaccgcacccgcaagcgcaagcccagccgcctcgtcgtgttcgcgttcgtcgcgcggctccgacctccaaagccgccgctacccttcccgtcttcgtcgtcgccgcgcacgcagatcgcgaaccagcccgcgcgccgcgcagcagcgccgcggagaggaaaggagagctccgccgcgcaccccccgccaccatcttggtgagttgcccgcgcgctctgctcgatccctctcgtcggagctcgcggatctgcccgctccggtggatttctgttgcgctctcttttttttttttctaaatgaaaattccgtgcgagtctgtggtcgattccgtggagagatgagtcgttttcgttgctgattcggtgatggaggcatgccgcgtagtctccacgctactattggcggggggaatctgttcgagccttttcgctttctgcttcgggtgttggcgaatctgattcgattccgcggctttgcgccccgtcgtttcatggatcgaacagcacgctatggggatgtgggtgtttagatctcccggatctcgtaccttgggctcatcaatttccgcttagttctgtgtgctgtcaagtgagcatgggcgcgtggggatcggcgcgaagtctgcggtgatctgtgttgctagctgagacttacctgtgctgctgaatttttgttttggagcagtagggagagatggggctcacgttcacgaagctgttcagccgcctcttcgcgaagaaagagatgaggattctcatggtcgggctcgatgcagccggtaagaccaccatcctctacaagctcaagcttggcgagatcgtcacgaccatccccaccatcggtaagcactctgttcatgtccttgttcttcttaatgagctgtcttagctgtaggaaggtactatgctgcacgtttatgtacaggaacgaacttttaattacatggagtgatggagtgagcactagttctgtttgtagaaacaaacttgaatttaaactctacatggagtgagcactagttctgttatgtagaaacaaacttgaatttaaactctagtaaggaggaatagttagcacgagcttgttcgtattataatcacatagcaaactttgatgttaaggtattggatatcactttggctacaaataaatttactacttgaaactttggttagaactaagccaagcatatgctactacacttctgtagctcttaatggaaacatctgtaattctctatacttgtgattattcttaatgatacatatgtatgcatctgttcatatggactccttttattgggtcattatgataatgtatttgtatttttgccatgtggcttcattgcattatagttttaataaatgaaactaccttattctggaaattttcaggatttaatgttgaaaccgtggaatacaagaacatcagcttcactgtttgggatgtcggtggccaggacaaggtaatagagtcagcttatagttagaaatcataactaccatttgttggctgttcctagcccttggggtaaaccggaattgaacttcttttatgcattgatgttgtcgtgctaagctgctaatgctgtcatgaactttcccaacttaattcttttattgatctataaatcaaaacagatcaggcccctgtggaggcactatttccagaacacacagggactcatctttgttgtggacagcaatgatagggagcgtgttgttgaggccagagacgagcttcacaggatgctgaacgaggtaatgatttttgttgtagacttgtagatatttggttgttccatagtgttcccagtctgcatatattgaatctatttacgaagcgcttattcgacattattgcagctacaaaattggaaaaaagtaagttgcttgtttggttcacaaaaatcttaggattttccatgaccttgtatgaaaatgctaagatagtagttgaaatgctatgaatcagtagtcatttttgttcaacctatttgtctgttgatttatttaaaacttactgttagaaataccagttccctaaattatcataaaccaattaattccatgttaataatgagagacccttctgtgtcgcaggatgagctgcgtgatgctgtgctgcttgtatttgcaaacaaacaagatcttcctaatgccatgaatgcagctgaaatcactgacaagcttggtttgcattccctgcgccagaggcactggtaaggaactccatatgaacaattcaaaagttatttaccttctaattgcttggtcagagttatgcagctctgctattctgcaaattatcagggtttacatattggacatgctgaaaacaacacaactagatctgtttgcaagagtatagtgcattttttaatgggttaattggatccatgccattacaacttcttcgattttgaaaaacaccattactattcgtctatttggagacatgtatgtgacacactctagatgtttttgatggtttatttagtcttgtggttggggttgaatgttacaaatgctatttgcatctgcattatggtttacacatctattgtgacactggttaccttttgaaatttatgaaatatgcatcatgtcattaaaatatttgtttcctggtgtcgcaggtacattcagagcacttgtgctacatctggtgaagggttgtatgagggtcttgactggctttccaacaacattgccagcaaggtatgttggcctattctaatgtcttagtctctgcttttgttgaaggcctattctggcctgaactttggcgtttaacttagggatagaagaaagctgaaccatgttactcgagcactgcctttatatacctcaataaaatcgctccgagtacttggccttaaaccttaagcatctgcagctgatgacatgcattttcattatttttgtgcaggcttgagcgttttggcagctggatatctgaacaattcactagtgccggtttacatattatataacatatacaccctaccacacatagtgtgggtgcctgtgaaggaaaaaactcctttgtggaggctagtaccagattgttccttttcgtgggcactataagtgcttatattttgtttggttttacaacatttactgtgctgtccatatgtacccgtttgttctgagatggtctagtaaattgatatgctttgtcacggacttggtgtgagcattgtattttagtttttctatgatctagtgccagtgtagatattattttcctcagcttcaaacttccgtttttggttgtcgacatcgttgttgcgtcacggatgcttgcggtgaggaaagtgatgaggtatatggttttctgactgcatatgcccattggtaattgtgacattgatacgccattgctgggttgccacaaaccaacaggcccgattgcccactgggtgcgaggtttctgtgagacagaatcacaataagatgacatcagtcaagaataatttgtaggtcatgtagtatgggtatatacactatatacgttgagtacaggaaacacgcattcattgggatgttgtaggccttgtgcaaaatcttacgaaacaaatgccaaattgaatatctgtgtgtcaagtggtattcagtactaccagttttctgtattgagtaatgactggcaaagataaaaggttgcctcagatcattacatgtctttgcttgacggaaagacaagcaaaagctaattcaaagcatcacctcttctgtttaagaaaggcagtcacgtcttatgcaagtcattcattcaagcaaatactaatgaatttgttacaccacgctttggggtgttgtacaaagtcgtcacggcagaatatgcagacaaaactgaacattgatacgaactgccgagctcgtcatgctccccaatcaaccgaagatagtcactgtgatgctgccgtgacagatatccatgtgtggtatactccatgagtttttggcctggaaagcatattaccaatgtaaaagatatttctcttttccaataataaagctatatgttctgaatcaagtaacagcatggacaaaatctaatgatgaacatgtattgatattcattttaccaa

SEQ ID NO: 67697 - DNA, 8928 bp, Oryza sativa
attatatttctacttttttttctccttttatttttttctaattttgaattttattttatttttatttcgaattttgattaatctcgtattgggttcttatatggaaacttgttcaatattgcttctttttaattccgaatttcagctatttttagattgtatttctacttggactctccttccttttttgacaaaaacttttggtaggctacagaattatttccagtgatctatcgtgtaggtgttgatagcaagatggatgaatgcacgtgattttagagtggcagcaagattatctgggcaagtgaacttttggtagctacaaaatactcttccgtggactgtgcatcttttttgttttcctttccttctgtggattgtgtttttttttcctttttgtccacacccaatcggacatacccttgcctagatactattaggactctgacatgcatgatgcatgctcgttagaatttttgtttcgtacttatacctttcctatttatgtattatataaatagagtttgtttcgtaccaatagaaatattgcccaacaaatctacaccctttaatctatatgcactatataatctaaaggtgtagcttttttctctttttctccgattaatgtgggaatttctagcctcaacagcgaacgtgatgcctcctttcaagactgttttaataatataatagatagattcctggtaaattacggaaactatatgttgtctaaaatttttatttttgtttgttctacaaaaaaaagtgaatacactgaggaacatttagttgtttccaacaagcaggttcgtcaaggatgagcttcaaacaattggagcatttcttggtgttgttgaaaacatgaaggaggattccccgaagtatcagatggctagagtttgggcggagcaagtgaaggatttggcttatgatatggaagattgcctagaggaacaaatcactgccctcactactagaaattcaagttggtctcaatatgtaaccaattacagagctctccgtccttttgctgccaagttaagtgatctcaaatcaaggatagttgaggtgagcgagagaaatatgcgttatcatcttgtcattgctgaccaagtcatcgacaatcatatgaattttatggtggctttgaacaaagtgttgtctcgctctgtggaaggcactactgacaattggacgcaaaatgtggttacatgggctgaagctcctgaagaatctgcatcaaacgacaaaacctgtgctcccaaagtgactgcagtagttggcatgtttggctcaggctctactcgtgtttctgagatatacaagaggcataaagctgataaaaaatatgattcctatgtgtggatcgaattgtcgcaagatgtgaatgtcacaaaggtattcaaggatatgatgaagcaactctttgatgattcttcaagtcagcctgaatatactggagaagatgagctagcccatggtattcaacacgaactcaaacaaaaacggttcttggtcgtgtttgatgagttgtggacgacacatgcatggcatagcataaaaaaggcactccctcatgttagtagaagtggcagccaggtcattgtaacaacagagatcgttcatgttgcaaaaggctgcaccgaatcagatgatcatgtttattgggtccaactgttatcaaaacaagaatcatttgagcgttttaagaatttgattcttgtaacagaaaactcaaaaatgactcatgaagatagagaggacttcgaagacctggacctaaaggaactagacagactcaaggtacttgaaccgcccttcaatacaattgaacagatactaagaaaatgtcgtggactagaattggctataggaactgtagccaagttacttgcctcagtctcctcacaagtggggaaaactatgtgatgatcttccttcattactctacagtaaccacccaatgctcaaagatatatggaaagtaatgattcagaggtacaaagatctaccgccttatctcaagccatgcttcttatacctgagcattttcccagagaactctgacatcaatgtggagactataatagaccgatggttagctgaagggcttgtgagggatagaactggaatgagccctaggactgttgcaaaatggtatttgttgtggctcattgatcgaagcatgattatggtatccaacctgagaaagaacagatcatttaagacatgctggatccatcccatgatgcgagatatcctggtcatgatttcacaagaggagaaattttcaatcactgttggtccaagaaagagttcaagtttgttagtaaagcgtttgccccatgtaacacttgatggtgggagtggcaggaagttagctagatatgtggatctttctggcatcaggtcactaacagtgttcaacgaaccatcagaatccattgctgcacttatttgctcctctaaacttagagcagtacgcattttagatttgtcaaatgccaatgagtttaaaatcactagaagagatatagagcgcgtaggagaactgtgtcacttgaggtacctaaatctttacaaaacaaatatttgtgagcttccttcgtcaataggcatgctcccgttcctgcaactgctaaacgtgagaaagacaaggatcacaaaacttcctaatgaggtcactcaactcggcaagctacaactccttcgtgctagcagaagaacagaagattcctgtcacaatagaaggaaccgatgctgcattgattcagctctaacagtgcctaaagggatagagaacctgcaggacatagaaaggctggatatcatggatatcaaggacaacagtggctcagaaattgaagctttggggaaacttgctaggttggagcaccttggattggcaggcattacaattggcaacagcaaacaagtctccaaaaccctaaaaaggatttcttcttcgctgacctatttgtacctcggagcatgccaaagtgatggaacacttgcttgcctgcccatctctgaaaagaaaaggaagaagccactggagtttccacgcctccaaaccataaagcttgacggtcatattggaaaaatgccatactggatttctaactcatggacacttgcggttattaaactttacaggactaatctccaacagaatcatataatgtcccttgagaaactaccctgcttggtcacacttgctctcctagacaattcatatattagcgagacattggttttctatgataaggccttcagagagctcaagaccctggagattattaggctaaccaagttgaaaacagttatatttacagaagaagcagtgccccagcttcgaagtttagccatcagatgttgcgaattgagattaaaaggaaaaaacaaccttaaactccggaaggttgatcttgatgatggtgtcgaagaggtataactgaaaaggagaatgcactgtgattctctagtgatccgttggtcccgaaagtcagtgccccgcataataataatagatttggctgtatttctgggttcctttgttttggggggtgggggaagagttgattgatgttttgatcttgcagaaagtgtgtatggtcttgcttttctcgggggctccattttttttttcttaaagtgtgctttgtgtgttgtcaagctgcatttcgttttagtgagtttcatggatttctcttgatggtctgtaaaaattactggatttgttttcaatggccctttggccctctaaaagagaaaccactgaccgcaacatcagcgcaaatacaatgtgaccatcatggttgaatgtccggagcattatgcagaagttgcttcatgagaaaagggacagttatacaaactgaagagaaaaaataatttggtaatgggtacagcttgtgatacctattccactggcatatttacttttcctttttcttgttactgtgataaacactgaaacatcaacaatatcatgctttattttgacaacattgtacatgcttgttgcaaaatgtactgtcattatttatgttagttcgtgcacacaaattagtaggtaaaacaacacatttcttattccttgcaatcaaattagtatttttctactagttcatatcctcaagtaaaatgcatcacgaaatagcctactactactttcaacaggaaaattggggtttcagagaatcatcatgtatcttcagaaagaacaaccacatgaatttgagatacgataaaaattctcgaatcacttgctttatcaatcctaatgcgataataatatttttaatcttttttgcggggattaatgcgataattcgtttagctggaataaaaaaaattacctcatatccacaagcatattgaagtacacttggaagctgttcatcaacttgtcagcctcggtgggactgatgagctctggattggagagccccggcccggatacgtacagagcattagttcctccgctagattcagatcgatagatgcggctactcgagactgcagctgctagctagattcaagtgagcgatttggggatgtgcagatggcggctgggatagggtggttggcggcggcggcggcggcggtggcagcggaagcggaagctgaggcggcaacgctgcaatggaggcgtaggacggaagagaggttaaagagagagagaggatgtgatatggcaatttttttttagaatctattcgaagcatattttgagtttagtcgatgatttatcatcgaactttgttaaattttttctacaatataccaccaaggtggatgcgttttaaaaaaaataattaaaatgttctccaagtcattcaaagttgacaattacttggctcaagatatgtcacccagtctttcggagttgcttacaaaggtaggtgtccgtgtgtatgtttataggggtgagtgtacgcgcgttgtaagcgcctgcgtttgtactgtgtttctaagaaaatgaattggctcattaaaagtttcgaaagatatgaaagtttgtttaagccttcttacccaatatatgagttcagtttgtgtgtgtatattaagatttcttccatgttttattttgaaaataaaaattatgtggtatgtgaaagaggaaccatgtacttaaaagatagccagagaagaaaaataattatgtggcatatgaaagatgatttaacattaatacaagaatattttattagcatatgaaatataaattgtattttcgaaaaaaaatatatgcaaatttaaaatcttgaaatatacccacacttatatgtaaaagtttcatatctttttcgatatttctagtgagtccatcaattgcccaacctttatgtctttaagagtagtttaggttttttttttttaaattattcattccaatagcatattgttaaaaaaaaagttgataaagtcgatgtcatattatagagggagataaagtcgatggcaaatctttaaattggagtacatgatcatagaatgattctctcttttttttcatgaggaggttgatcattttgccattttcttttttttagacttttgttatattttttaaaatatagtacaaatgcatacgctcacagcgaggcaaactcacccaaatgaacaacacgcacactcttccatatgagcacttccaaaagactagaccagcctatcctgaaattgacgaaataaccatgggcgtctcattatcgatgagtatatcgtctattactgaaagaataactagttgtcaatacgagcatctctatcacgtctagaacttgaatctagatggactggttccaccgtaagaaacctaaccaaaccaattgaactacactcgctttgctttttaaaaaaatctgtaagaaaagaaaatggtgtctaacctttttcatggacgcatattttaagatgtgattttgatcataattttatattatatattgagcttataaaatatagtataaaatctacgagagagattatgagaataaaacttattcagatcactcttacgttttcaaactaggttaatataaaagtatcgaaagtttgataatatttagccaaaatgtaatgaatttcttatatgtgagaaatagaccaatagtagtatccagcaattatggcaataagggaaaatcacgacaggtttataattggacaattttgtagcgttaaatatgtagaattcctaaataggcatcgtcacattggcttcgacgagccaaacttgtaaatatcccatgccaaaaattgatccatcaatgtgttacacgaaagttgaaactctgctgccctactgggccatcaagcaatgacaaaactcagcccatgtgcacccagaaagcccaagaggactgtaaagcccaaccttcgccaacaaataagctactctttctatgaaacggtacgggcgttttgatttggaggaaaaacataggaatattataggatttctatggatgcctttgaaacaaaggattaaatcctatattattttgatttgtttaagtatgcgctctattcaaaagctagctagctaccaactttcaccgtaaccatagcaatctgccgcagaattgaatcaggatcagtgaagtggctgcaacaagtgcaacttttgcagttgttgtaaccattgttggatcgagatcgaatagtttagatttctgtaccatcactattcatatgagtatgtaattaagtaggtattataatatactatattaattattatcttcgtcccaacataagtttatatataaaagtgaacttatgtataattctcttgaccaaaggattctccctgcttccaactactggatctagtggccccaatgagtaaagtttaaaacaacattaacctttccattacaccgtgcaacatcaaatcatctaccatcaacccaagtataaccacaatcataactaagagcgagtacaatagttggctacaagtcatacaagtcagctataagcacaatagttggctacaagtcatacaagtcagctataagcacgtgtggaggagagaagagaattgaagagagagaagaaaagcgggctacagatttaaagccaatacgttggaagtgtataagaggtgggaccatatattaacggtttagtatataattacaggtaactattgtattaatgagctattagattagctatagataaattggagctagtagttggctatactattaaacttgctctaatgagatgacggacataacgcgtctgtgttatgcggtatgggttgggtccgacacgtaaaatgatgtaacggtttagcacataattaattacatattagctaaaaacttgaaaaatagattagtatgtttttagagcaaaattcttatagaaaatttttaataaaaacactccgtttaacagttggaaagcatatgcgtgcgaaaaacgaaaaagaaaaagttgggaacttgcacaaaagaacacagcgatgtaagtctcacctctagactagaaattgtcttcaaggacgtcctcaatacttatctatctactactacttaaaaagtacaagaaatttccatcgtccgttaaaaaaaaaagtccgactgaaaataaaaagagagaaaagaaaaactactgtcgcaaaaaaggaaaaaaagtatcgtccgttaaaaaaaaagtccgactccttttaaaaaagggaaaaataagtcttgccgttaaaaacaaagtccgactactgaaaaagtgggaaaaaaaacttctcatgtcgactcccgtaaataaagtgaaaaaatttttcgtccgtaaaaaaaattgactcccgtaaaataacagataaaatttcgttcgtaaaaaaaatatgactcccgtaaaataagggatagaaaacttctcacatccgactcccgtaaaaaaagaaaacatggcctcctatgtaaaaaaagaaaaaaaatctgactcccataaaaaaaatagaaaaccgagaaaaaaagccatttataaaaaatccgattcgagaaaccatccgaactcaacacgagaaaataatctaccatccgaactcaacacgagaaaataatctaccatccgacacaacacgagaaaaaaaaccatcgtttgtaaaaaaaacggtttgaaaaacatccgactcaatacgagataaaaaaaccactgcaaaataaaccgttaaaaagtgttgttaataagaaagcgaatcggaaaactgactgaatccacgcgagaaaaaccggataaaaaaattgtccgaccctactcgagaaaaaaaaaccgtttattataaaaaatactgctccaaaaaagttgtccaacccaacacgagaaaatacacgcatttataaaaaaaatccggttcggcaattataaaagaaaaaaaatcatattccatgagaaagaaaaactgtgcatttataaaagtattgtttgtatagtctaccacgttggtttggtttttccaaagcggttgctgaatgttcttatgtgcgaatgcatgggcttgagcttggttttatcggaacgagatcaaattgatctgatgcttaggtcggataggatccttaattttttccatctgctacgtacatggattgtgttgctcctgtattggagaccctacacgactctgtatgcaattatcagactatttagataagtatagctaatattcttaatagcgtatcatataaaataataataataaataaatttttgattgttgttaagagaagaatgcactgtgactctattttgtctagacttcaccatgccagacaatgtaggatttgattgatcctattattagttacaagaatgagattgaaagagtatttcggattatatgtgtacaaccatataaataatacaactctttttgtaaagcatgcattggtaggttgccatcgt

SEQ ID NO: 67698 - DNA, 4220 bp, Oryza sativa
tattctaagatcaactaagcatgtcgacagattaaaccaagaacaccaaagatggactgaacaaattgtttcaagcctcactccttattgccaagccaaccggcttatcatctacagagctttcttggcccatgtccaagaagccgcaaacgaagcttgagcgatgcaagcaagcaagcatatgcattatgcatccactcacttaccctctccatcccttcccgcgccgacggcgtctgcggcaatgtcattgcccacggctatcaacctctccttctcctcctccgcagtcgccgaggcggccggcgcatcagacttctgcgacccggttaacctcgcgagtagcacgaaggacatgccacccagcacgttgtttatgcaccggagagcaacgacggacaccttgaacaccgacggcggcgcggcgttggcgagcaggtactcgacgccgttcagcgtctggtaccgcaggttgctgctgacccccatgtggatcgcccaggtagcggcgttgagcagcgtgggcggcgccttgttcggggtctcgaacgccgggtccatgcgtttccgcagcgagatgaggccgttggagatcgcggtgccggcgagccccgcggcgaaccccacggcggcgaacgtggcgcccttggatagcagcgtcgcgacgcgggagcccaaggagtaggcgccggcctcgaacatgtggctggggagccccgacgcggcggcggacgcggcggccgaggcgccggcggtgggcgcgaggaggtacatgaggacgaagttgaggatggatccgacgacgagggtggagaagacgaagtcgagctcgttgagcccgaagttcgggcgggacgccatgtcgccgagcacgcaggcgctgacgccgacgagctcctccatgagcaccttgaacgggaactgcggatccgcggcgacgcgtgccgcccacccggcgaggaagatgccgaggatgccgccgctgctgcccccggaatccgcggcgtcgccagatccgccgccgccgccgtaggagcgcggcggcgggggcagcctgccacctggcccagacggaccagacggggacggggatcggaggcggaggaggagggcggacgacgacgaggagagcggggagaaggagaggctaccggcgcggggcggggagaggcgcggggaggagtcgaggtgcgtgggcgccgtggcagggaggaacttggcggcggtgaacgccatggaggccatggcgatcgggaggggagggcgccgcgcaggcttggcggcggcggcggggaggagagtgagatgggctttcgatgggggaagaagggttttggtggttggttggtgtagtgcaggctgtgctgtgcaggagtggtagtgaaaggtgtttggtgggggtgggtggccattttgtactgtacaacatgcgatgcgcttgcaacagaacgacggctgcacctggacgcgacgcgagagcgacgagacctactccttctgattggaaaaaatcgacgcatatgattctcgaactgcttgaatgcaaaattggaattttgccgtttcaaaattgaagtacggtgatttcttctgagattgtctctgattccaactatggctcaaagccagattgctagttatggctgtgtttcggaggtatgggttgggaaaacgacgtaattcctctgttgcatcaatatgaatatagtaaatgctagaatgatttgcattgtgaaacggaggaagtaatagtttagcaaataattaattatgtattatctaaaaaaatgaaaaatggattagtatgattttcttaaagcaaaattcatatagaaaatttctaaaaaagacactctgtttagcaatttgggaaccgtgcgtgcgaaaagaagttgagaacttgcaaaaaggaacacagcataattagaatgtttcacagtttcactgtttcaggctgtcgcgttttttttttgtcaagtttaggtagagttgtcaagcactctggcataacatgcgaaagtcagttatctagcaggaattgtcagaacacacgcgaaaacatttctgcattctttcagggataacattcattcagggagaagaaggatgctcttgcggctgtcaatagaaattagccactgcttcagagatcaatctgttgacatggctatgttgtcgcaaacaggaaacggaaaaccttaagaccagtatatagcagttacagagcacataccataaaggaaactgctcatcacatcagatggagataaagagaatgttaccggttacattttcataacagagcacctctttgggaatatacaacttatccaggaggccagttcatctgacgtccccctagaagatgaatatggaggtgatatacagactgacctacataacacagaaaaagtcagtccaactatcttaataagaaaggcctcaccgtctcaatgggatcaagcttatgctcacatccgttaggcccatcattgatgacaatcctgaatccatcatcaaggttctcctgctttgcaatggtcttagcagcgtaaagaagatggcccataacctcaacgtgtctttcttctgcctatgacaattgaaataggtgccagttgtagtatcattcagcaaaataatgtggctactcaaggatcatgatttgttgaaatgtgatatcatgattcttataaattattttaccacaatcaacgtgtacacggcaagtcggcaagatatattaacatggtagatgagcggatgacctgcgtggcagtgcccggcctcttagcgagttggtagagttttatagttactaatccgtagtatgttacggacatgaggatgaaaaaaaagtaaaatgttgtgttagatccaagaagcctaaggtataatattgaacttaaggtacaaagctacagagagagagagagagagagagagagagagattattatccattagtaaaaagaggcaatagtctactattttcaagcatctaccactctgccataacactcattctagtgaactgggtacatagctcactgtgaacttcacatatgaagaattcaagatggaatcaactaaatagaacccattacgatgtttaaaagataagatgaaactaagtacctttgagagcctagacaatccatctttaaccttgggaattattataatatgtactggagcttggggtgatatgtctctgaatgcaagggtctgcactgataagattcaaaacgtgacctattagcagctcattttcattcacaatcatgttcaagcaaacaacaaacgaattagttagtacatagcagtgattactaattaatgcagataccaaagttagttatcacggggaccgagccagaaaactagaacagttcttttcatgaacactgaatggagagaggataattaaccttccatatcaatattagctgtgaatgtgaacaaagaattcgaccacggcacaaaattctttcaggtgactagtgagataaatataaatgaaataacatgtacatctcgaacctttctttggaaccttcatttcatctaatgtgatgacacacaaatctgttgtgttcccagaagatgagtaatgctttctcccgcattaaaaaaaatcataaaaccggttaaaaagtatactttttttttatttaacttcacgaaagcacaactttgcaagaataaatattgaaaaactaaaactaaatcatatgacattggtcccactagtacgacaaacaatcaaacttccattagcacatgctaagttgctaactctggaacggctctctgtgataatgcctttgttgagcagcaccgccttgatgattctcacctgctccacctttgagccctctattttgaaatgcgaactgaagggaaaagaacatgtatcgctatggttgataagtacatccagatgtagcggggatagggggatgagttggcatggccgttcattgtgtgcagcttgcccagttattgtgtactaagtaggaggtggggtgtggtaacaggatgactccagatgtccgataacaggatgagtgacagtgttgtagattttcaatagttactgttccaaagttgtagttttgtgaagttggaacagaaggttgtggttttcttatgacaattttgaccccaaaaaaataagtcgttgctttgtgaaatttactctttcccgttttggagaa

SEQ ID NO: 67699 - DNA, 6178 bp, Oryza sativa
ccgcaaaattttgtcaaaactgcaaggaagagaaataggtgtctgaatgaaaggtcaaaggtcatccatggaaatccacatttcatgaaggggataaaatagtaaacacaaccagaacaactgtggtaaagccttctcaaagaaaatagatgaaaattaatattcagcaaacgctgactagtaggcagattttagaaatgtaagaagcttgacctgctatgttatatagtagtagttatcgcagaacaattctctacaattagatatcatgcaagaataaaaaatgcatgttcatataaatatcacttgatgtgcaggaactcaacttctagtctacatgggttgttgtattaatattttgtacttttgctaccagatgctgatgcaatcaagcattgctcaattgttatgtggctctgttctaataaatgagcttctgttgaagaattactctctccgtatataattggtggccacagctgcactgcagcatgagggaccatttgaataagcccagtacagcattctacatttctcagatatctcaagatctcgattcattctagaaccaggtgaagttagttactattagctatccaacataattcaaatctaaccagcaacccagacatccaaggaaaatgcaggcccctaactctgagcaagaatattttgcgctgatctagccctgatcttcagatgtttcttcccaggatgtttatagctatgcaaacgcaccaaaatccattattattactgcacttaacccccacaagcagtgcttaacctcccccattatgaagaggatcggtttctgcagtgtccgcccataaacatggatgcttacaaccgaaaaaaaaaactaagcaccggtttgatagtttgatctccttagcgaatcaactcctcccacataatcaatctaaagggttattcaaattatataacgatcagaactgcattaacctaataactcatgctcgagctacatttttgtacaaattttacagcccccggtaccgaaactgcacaatagaatctgttcatccaacatccaatatcttccgtgcgcttactagaacaaatttctcgcagaactggtcaagtgaacaagacatcatgatgcgcatagatgagagagagagatacagagagactgacatggttggtccgtcggaggggccggcggcgagtgcggcctccttttcgccggccgtccgagaagattgggacaaatgagacgcgagaactgcgaggcggccgccgcttccgctcgccggcggcggcagctgcggcggcggtcgactggcactggcccggctcatcccttccccgacttcctcgcccaatcgctgacttactgctgcctccatcaccgtcacgctcgcacctcagcttttcaacagatttcccgcttactaaaggtcaaaacgtattttccagctttacgctatgttgccagtgtaaacgtacacgtgaaagacgcctgcacagactgctctgtaccgcattacaaccgctcttcttaaaacgatgctcccaacatactccctaatgtttgacgccgttaacttttttaaaaaattttgaccattcgtcttatttaaaaaatttaagtaattattaattctttttctatcatttgatttatttttaaatatatttttatgtatacatatagttttacacatttcacaaaagttttaagacgaacggtcaaacatgtttaaaaaagtcaactgtatcaaacatttaagaaatgagggagtattttactagtgctctttactagttcacttattttggaacggaggaaatatacaataagcatttaattactactagcttattgcatttaattactactagcttatttcagatcgaagaagtatatataacaagcatttgattgctggtgttaatccgaactcttatgattctcaagcccacaacatatgagaagacccgagctgccaagggagcaagtcctatcaaagcatcaatctatcatcatctggataatgtgagaatgacatatacggatgtttttttttgttttcttctatagattctgatttgaatgggatgagattcgtgctgtgaaaattacaaaaagagagaaacaaatcgcatcctagattccaagagtaaaagatgtttcaccaacagatgctgctgcgggaactgttgctcgaaatggcatctgacgaacaccgggttcaggatgtgatgcagtgagtacagcaggggcattcaggataagtatgtttcagcaactgatagcagatgatgttggagacagacagcgacatatgaagttaaccaccatttttcgcactaacataaattagccaaaataattatttctgacaaggatagatatctcaacaatcagatcatagtccagctagttctatccagaaattgaattttacagtaatgttacaacccttcatcttagtgaagtatttgggcttaaagattgcatcctccttgcagttctatggaagagcagccgatgtcaccaccaagtataagaaagctctgagaacctagatgtgtccagcaaatttacatactcctagctaggaaagtagcaaggcctcagaaagatagcagtgctaccagaacacatactaggctcctgctaatctacacaatacaaatcactaagctagacataagccaagaagaagctaggaaatgattctaaaccccaggaggcaaaacttacaagcaagagcacttcaaaaactataaaataaaatactgcgggcatgatcagaaatctgcggagcttgttctcctgagttgatacttgggttctggtacaggcacagcgcaaattaattcatccaactcctgaagatagcatgagaggggaaaacaagtcaatgctgtgtatggataagtaacccaatatggcatcatcagaatacaaaaatatatggtgtaaaatatatggaacaggacagtgtttggctgatagtaggattaagcacaaaattagcataatatatagtactagctaaattgatatccagtggcaagtgctaaaactttgaattatcattaaaggagtactactgccaattttcttgccacatcagatgcactgaaacaatgtggtaccagaaaaatatgaaatataaatagacatgagattaatacttctagctttccagggacatgattcagtccgttggatccttgctaatcttcctatagtacgaaggatgcttaaaagacgcatggccatccagggttaatgggatcaaaataacttagaaaatatcttttattgctaacactgctttgtttgaggagctaaccaattagtcagagggatgcaatatgttagaaccagagatgcaatatgttagaaccagagtccacaacagtattctgcaagcagaattcttcaaatgccataggtaagaagttactttattggacagtcatccaaaagttgacatgcagaagacaattcctacacacaaacaatgaccatgacgaagacctcttgattgtaacttgatacactacctatgaagtagtacagctcatcataccagatgataatattgctgttgattagactgcgatgtatttctatgttttccatcacaagattactcctagtataatgctgccccattttattatcgacttagagtgaataatagtataaggtagtcttttcgaagatatttaaggaaaaatacaagatacccccaatatccaccagaaaattagtttcctcccttcaggcacaaataagatactggctcaaataaatgcttgacgggacatgcctaataattagatcaactaatagaatgaacagtatatggctcactcctacagtcctacctaaaaacagtcacctcaagtggtggaagcaaatacttaagattatattattattatagagctgtgaaaacattgaaaaatcataaggtgtagtaaggccataaaagggtcttagtgatgtatgacaagtacatatcaacaaggtagcttgacaatatgaaatagtaaaaactagacataagagacagtacaagtgatagtatttatttcctgtcacttaccaaatagtctgactcctattcagaggcagaaagtgaagacaaattagggaagaattaattggttaatttataggacaagcatgcaccggggaaaaatacttgataggggaaatttgcaacattctgatataattgcagtggaaaagacagtaccttttgcctctttagcctcacattctcctcttctaaacgagaaaccttgttttcaagttcattagtgtaggcctgtcacaaatgaaatgtaattatgcaatcatgtgggtaatacacaaactcacaggtcacatgaagaaactaaatttaaagtaacagtggccttcttaatcatcatatgcagcaagaacaatgctaattaaaaatttgccacaaatagaaaggtgtaaaacacatattgcacctgcttcctggctcttgaacgggcagctgactccctgttcttgatcatcctcttctgccttctctccatcaacttatctgccacatcccctgacatgcctcgcttccttccaggcgtctgcgaatcggacattccgccgatcattcctgaagaagtctggccatcagagtaggatggctccagaatagcaccggggccaacattaagtggctgagggaccaatcgattcggaaaataagcaccctgcacaccttgctgcccatggtgatgagcatcagtagatgcaatctgctgcttatactgctctatccagtgtgatccaggtgccagatccacagtcccggttgctgtaacacctcttccaaccggatccacattgcctacatcactaagctccttgagagatccttgggtgacaaccccagctttgaccaggaaatcctcgagcgtcacctccccaagcgtcggctgcctctctcgccgccgtcgacctccgccgccgccgccgcccgtttcggcattcctcttcggagcagcctggatccccttccacacctcgtccaccgtcttcttgctgagctcaggcggcatcgtgatgctcccctgccgcaggaggcccgagcccggctgatgctgctggctactggtggtggcaccggcaccgtcggcgatggccaggccgtcagggaacacgctccggagcagctcgtcgaggttcatgctgtgcagcggctcgcccagctggctctgcacctcgtcgagggtgaggctgtacatggatccctgcctccccagactccgcatccgccctcctccgcgccgcgcgacgcccccgcctccggccttcgacgccattgtctggctccccatgatcgagacgagatttctgctgctacgaggtaaagaatggataccttcacaattgaattcgatccagccgcgttcagccccggcaggcagaccgacctgcttgtccccggtcgccgcggtgcaggcgaggaggtcggtcaggccaggccgcgcgcacaagggaggagcgcggcgtcggtaagggagaggaggccgtgcacaccgtgcgtccgttggccgcgggctgcggcccttctcgccggcggccggcgcggggcgaggagccgaggagacgatgtgcctgcggctcgcgctgccgtttctgtgtgtgtgtgtctctcagtcgctcttgcagattggaagttgggaccagggaggagtgtagtagtaggtgcgggaagagagaaatagatatggagatggaagcgggggatgcgaagtgggggcacgttggctattcatcattttctcgtgtcctttactgaaaataaaatttggttcaaacctttttctttttttatttgcctttttctatctaggaagactgatattagaaaactaaaaagagccactagaactatcattcgaataatatccttgtaaaattaagaaaacacggtgttaaatgcttgtctataaacttctgattacttaatatactgcagtgggaggctcctgctgttttccataaaaaaaatccaaaatgcccttttttatggttatattaattaatgtgaaaattctataaatttcacttttcaaaaataggcatatttttatgattattcgatgtaattattataaagttgaaaatggatttaaaacaatatccaaaaaa

SEQ ID NO: 67700 - DNA, 680 bp, Oryza sativa
gaattcctgcagccccggctttatagtggaatgaccgtggtaaacccagcatgcatgctttgacctgaaagatgtaaagtctggttcatccatattggaagcgctatcctcggaacaactatgaaactttgtcttttctgagaaacaacaactatgaccctagaaagtgatgtaccttatgctaaccttaataaattcgatcggggcacttcttcaccaccaatgcggtgaaaaaaatattgctacctccgactctcctttttttaatatatagaaccattaacatctctaacatgcttttttatgaatgaatctagcaaatataaaaaaaataatgtcatacttaaagaacatttaataataaatgatatcacaataaagcatatgataatacacatcataatttttaaacaggataaaggatcaagctatctcaacagatgaaaagcaaatgatgtcggatattataaaggatagacttacaaccggtttggatgacttgtccattgatcacactgcaacctccagcaacaaaatatatctataatgcaacgaacaatcgatacactggcgagagagaacttaaatgcacaacttgaatctgcccatggagacagccctggccctggctctgacctgcttctcgatgtggcgccacagctagccaatcatgtccgtgc

SEQ ID NO: 67701 - DNA, 4834 bp, Oryza sativa
aacatgaatatagtaaaaccaggttttgccgaactctgtcttttaaactagggatttgtcattcgtctctttaaccgtctgttagacaagtagctaagtttgtgcgttaatcgagaaaaaagactaataaatttattactgatctatgtctctttagcatgtgttacacacttgcgtgctataatggaaaaaaaaaactagcatgtcggagtaggattagaaacatataagtatcagtttacttcgttgttcagatacaattgagacttgggacatggggcagatttaggatgtgttcgggagagaaggttgacaactactcttctgtgcaagtaaaacagggtgtctcattagcacacgattaattaagtcttagctgtagaagccttaaatgaattaatgtcatttttaaaagcaacttattatcatagaatttttttttaaaaaaatacaatatttagcagtttgagaagcatgtgaattaatgtcatttttaaaagcaacttattatcttagatttttttttaaaaatacaatatttaccagtttgagaaaaatgtgcatagaaaactagattgtaaaagttggtaacatgtagggtctcttttgtttagacttagacttttaagttgtttttttttttttgcctgtatgatttataattcgatgaatttatagtctcaagtttaatgatggaattatacctctacctcatatatgaggaaaaaaacgtttttaacttaacttttggattatcagtgtaatagtacttatctctaatacttaaaaaataagaggtgcttccatcatccgtcaaaaaaaccggacgaaaaaaaccaagtttgtccgataaaaaaaccgggcgaaaaaagtgcgaaaaaaaaagaaaaaccaaatatgtctgatctagaaaaaaggggaaaaaaccgggcggaaaaaaaccaaaattgtccgatacaaaaaaaaccgggcgaaaaaaaacgtgtgaaaaaaagaaaataaaaaacaaaatagcgataaaaaaaagtccgactcggtcccctaaaaaatagagataaaaattaaaaaaaatgtccgactccttattgcgattccctcttagaaaaaaaaagtctgactctagatccgagtcccactcatctcggtttgagtccggcatactaggcatcacttctctcggtttcaatctataccgtgatattccatacatcttggtgaaaaaaaaattgatgtgccatattaaagatctgtttgcaaaaacggaacctacatgtcgagagcattccatttttatatgattttaaattttgggtttgtacatttgcatttgagtccctgtaatttttatatttacatttgagtccctataatcttgcaataaggtgcttttggtcttttttttaaaaaaaacaataaataaaagggatagaacaaatgcagaaaggtgcatgaaaagaaaaagaaaagccacacaaaaaagaaaataaataaaaaacaacaacaacaaaaatctatttcccctaagtagcccaaaaaaaactgtagatgcaaacgaaaaaaatccaattcctataaaaggcaaaaaaaaaaaaaagtggtgaaaaaaaaacgctagatccaattcctttaaaaacgggaaaaaagtctgattcctgtaaaggcaaaaaaaaatccgaaaaaacatctaaaaaagttcatccgattctttaagaaagtggcaaaaaaatggttcgtataaaataaaaaatgcacgtgagaaaaaaaattggaaagggcgaaacaaagtccaatttctaatcagtaaatctcttctctatctctaatctaatataactatttaaaaataaaaaatgcacgagaaaataaaaatggtaaagaaaacgtgtgaggaaaaaatcagaaaaaagcgcaaaaaacacgctgaaaaggtttttccatcttcttaaaaaaataaaaaacgcgtgagaaaaattatttccattgtcggcaaaattttttttaaaaaaaatgcgaggaaaagactatcagaaaaaatgcgccatttctaaaaaaaatggttcgaaaaaaccacgcaagaaaaaaacactatctatataaaaaaaatcgctctgaaaaaactgtcagaaaaaagctaaattgatggacgcttaagtcggataggatccatcgattttttaccatctactacacggcttttattttgccgtatattctcatgtattggaaaaaagcaaaaaataacattcagaaaaaacaggcaaaaaaaaccacatgagaacgtaattgtcagaaaaaataggcaaaaaacacgcgagaaaagaaaaacaaaaaaggggagaaaaatatgattttcgtcatcagtaaaaaaaaaggaaaaaacatgctaggaaaaaactgttagaaagaaatgcgctatttctgaaaaatggtttgagaaaatcgcgcaagaaaaaaaacaccgtttataaaaaaacaagccgctcattaaaatcaaacattgtcattgacatgattatgtatgaaaaacgtatattatcattagaattttttcacccgttgcaacgcacgagcatttttgctagtgatttgaaaaagacaaatgaaaaaaactgattgttgtttagacttagactttttaatttactagaaaaaaatgcccatgcgttgtaacaggtgaagtctattttaatcttattattgttatatgatttagctaagataaaattcactgtgtgagtttgcttggatatatatatttttagaaaattatgagctgcagttaggaatacgatcgtctcaagttagcatgcgagttttttaaaacatattgcttatgtgattccttgtatattaccaaaagtgaacaatcttaaaaaccgactcaaatacggatatatatttccaaaagcaaacgaacttaaaaaccgactcatacacggatgacgtaccaaaatactggcaaaaacatttttgatttttataataatagagataagctgacttagagcatcaccaaaagatatccaaaaatatatcccttaaatctccttttgtgattctctaacaaaaaattaaggcatcaaaatacccttctttccaagagactttctaaatatgaatctctaaatagaaagtgggccaccttgaaaaactaccaacaaaatcaatctatcctgtccttgtcgtgtgcatgttgcaaccagggtttacattaccggttgagcactaaatttcgagccccatcggtatcacggttttcgataaatttcgatcggttttcgataaaaattgactgaattttgaccaaatataatgtttaaccttcgaaattccaattgaaacttaatttcgagccgtgtcgaaatttcacagaattcgaccggttttcgtcagaactgtgaaccctggttacgacccctcccaagtggccgcgcaatagattcttatgatgcacccttctcctgcgtgcaaaggaattgcagctacgattgggagccaaatctcgctcgtatatccggattccggagaaccaaaaaaaaaagggtttgggatttcctagtattgggcgtgtaagtagggactctgtttttgaacgaaaatgagtttcatttatacatacctactatataaaataaatttttgtagtttacttgtttgatgtggcagatgttttttaaggggatttgtggtagatgttaatactcttatctataaacttaattagtcaaaggagtaatttgaattaagataaaactggaaatgtttatatttggggaccaagggagtatatgaatctatttgaaaaagcaaaacaaacaaactttggttatctgtttttatcaaaccatatagatgtggcctgatattatatgaaaatatcatatatacaatagtcgtcaaagcattattcatgctctataaagcgcgatgggggttatttagcataaaatgatttgggctgattaaaacaagatttactttgttcatgctaaaaaaaatgcgacgagaaatattcagcaaaaaaaatgatttgggctgttatttaaacaagatacacattttctttctgattgtattgaaaatgcacatatacatgcatgagagaccaaagataactatgaaaaacatctgaatttggatcaggatgaatcaaatcatcgtcattcagtcaaaacaacacatcagagactactagtaatacaaatcagacgggagtggattctaatccctcgaggagatatcccctcgtatacctttttcttacaaattcgatacaaatagttgtgaaaaattctgaaaaaaattaacaatgtagaatgtagagtataatgatatctattagttcaccaaaaatcatgttcatattcaatctacacatcgagaaaaaaaaaagacaaatttagatataaacagtatgctactattcatacgctgaatttgtcttttttatatctcgatgtgtgagttgagttggagttgaatatatgtgttgtatgaatgttgtcaaattttttcagaatttttcataaccgtttagatgatttttaagcaaacgaggaaacatcccatcgagggattagaatagtttccccaaatcaaacaaagggaaactattagattcaacaacttcataccaagtactgtaaagcacggtaacaactcaattatttccaagcaattagaggaaattaaccacaaatctaatgagaggtaatgccaggtcataattcaagcagaaccccaaattaaggacaaactcaaaccctcaaaccgtcaactcaattaaccactagacctcaaaccaaagtttaaaatttaatataaaaaaaaggga

SEQ ID NO: 67702 - DNA, 1063 bp, Oryza sativa
caattagaatgactgctgaacatcgtagagtaaactcatacattgtgaaagttttacacaaaaaatgcagatttggcaatatttttcccttttgctgaaatataaacattttgataaaacgaagaagtaagaatattacaaacaaactacagaagaaatgtttctcacattttctgataattcatcctcaacaacagcacctgggtgttcccacgcaagcatcatatcaaacattaaacggcgaagattcttatcagccaaatgatctggacgtgtagttacttcatggagagctttgtggcagcagtactctaaaaattcctttgcatatgtattagactccttacaactatcgggatagtcaacttcaaagttttgctgcaaggtttcggttgcaagagcaagaaccctgaaaatgttaatttgagaagaaacttgttagaagtttgtcaggcataacaagaaattacaacttaaatcatataagagtggtcaaacaaagcagaaacatgatcatgtcagtgtatttaaaaattaaagataactacaatagacaatagtaagctatggaagttgatccaattgtggctagcatatgattctcagtactccccttaacaagttagcatgagtgcttgatcagtgattattgcattaattaaccatcctgcaacgctacaggttgttgcctttatttgtttgtgttctgttgacctccttcagacctgtttgctttagataagtagagtgttggctgaacaagattaattcagagtttaatagtaaataatctatggttgattcaaagttgaagaataaataatccatggttaatttagtgtttaagaataaataatgtagataatcatagtttctagatctcttaggcacgggtcagcaatcaaataagtttctgtcaggcataatcatcaaaactcatgtgaaactcaggcatgcaattttctcaggcacaatactcaggtcaccaaccaaacaggccctatatatatatagggatcacatgctcacaatggccaagtgtccagaaataaagagtaaattt

SEQ ID NO: 67703 - DNA, 1468 bp, Oryza sativa
tgataaaggaaccaaaaaattcatttttgtaggagcatccgctatatgttgggctctatggttcagtagaaatgatatggtttttgataaatctccgtatgtatcttatatgcaggtccttttcaggataacatactggctccggttttaggctcaattacaaaggtgttatgaggacatcaagctaataaaatctgcatgtcgactacttgagacaacggtcatgcagctttttgccaactttggttggaggttcaccaataggattcaataatcaatgggtctttgttttacgtggttatttgttagcttgtgtttcctttaccttactagtgtgtgttttttaagacttttttgtgtgctggtttgtgtgaatttgtgtagtaattgactgtaacttcttgagcaaaggctgagattttattccattattgaagaaagaattaaaattggagcgcgtggaattaacacaaaacgcatggagaggaacatgaaaaacgctattacagaagtgatattttgcttttttttttaaaaaaaaagggacggaggagaaagcgaacaaggagaatcacttgcacgttgggggtctgagagaggggtccctgacttggcagatcctccagcgatcccgttgcagccttgcccactattctatccactatcgccctcctctcctctgctctctgccctctgctgctgcaagaagctaccaatccaatcctatcattgcaacatcctcaacatcctcacacacaagcacacagctcatccctctctctctctctctctctctctctcacgggcataaatcacatccgattggcacatcaatgcatgccaatttgatgagcatgagcatttgctgctaaaaaaatgtactcctattttttaaaggaaaacaaacacagtaggggaaatgtaaccccacagtaaagataattgcaaaaaaaaagtattaatcccgtatttataaatatattggtttgatgattcatgaatcgccgaaggatgtcacacatttataaaatttaattggagccttggtaggcttcagagagaaagcaggtatagacccctcgctacgaaaccatttttcacctcatcttttattaagtacatgaaggaaggatttagagtactagtctaatgaagggtcttgctcatgaaagcagcaccacattcatcattcctttagatgactggtgaaaaatcaggccatgtttagttactacgaaaaacttttcactctgtcacattaaatatttggatacatgcatagaatattaaatatagacaaaaaaactaattacacatattgcttataaattacaagatgaatttttaagtctaattactccatgatttgataatgtagtgctacagtaaacatttgctaatgacagattaattatacttaataaatttatctcgcagtttacatgcgaaatctgtagtttgttttgtt

SEQ ID NO: 67704 - DNA, 783 bp, Oryza sativa
acggggcctctcactccctcctgcagcgggcgtacctgtggttggtgcctcatctctctctctctctctctctctctctccctctctccctctctctctctctctctctctccatctgcacctgcacgcgtgtacaaaattgtacctcgatcgctctgggagtctggggacatggtggcacatgcaatcacgagtgaaggagccgaaacttaacgcatagtagtatgtgtagcttagctagcaggacgggagctgatcgatctggggaggagtacatggacgtcggtgagaagagaacctgactatgcgtcacagcctcagaggggatctgtatgtattatgtatctatcgttgtcgcatttacacgccaatcaattggagatcgaggtgtttgtcgatgactcctatatcctggtcgaactccagctgcaatgcatatatgcattgctcatgtacctgcagattttagaaaaaactgtttgcttcctcgatcttgctagtggccggtgcgactgcgcgacagtgtgatcatcaactgtgttagttgtcatttgttttgtccaactgcagtcggggaaaaaatcgcaattattggatcgatgcgccgatgaaacgtggcatgcttgcagcctaattttaacgtagtaggaagttttgcacgaatttaacacgaactttccaagtctttctcatgtccagcgcacagctagctatcaaccaatgcaaacaggagcgggcgggcgcatttgctgctgcacttctctcgcggtgttttgttcgatc

SEQ ID NO: 67705 - DNA, 12224 bp, Oryza sativa
  unsure (1)..(12224): unsure at all n locations
ctgtaacttgcatataattacactgtaacaatagtgtaacttgtatgtaactttcaaaaatctctctgtaatatgttatttcggtaaaatggaggttatgggaacaaatccttacacatatgtgtgtgctgtgatttttttcttcctcaccaaaacaaatcttgtaatagatttaacgattcaaaattacgtgaaacttatatacaagttacactgtagttacatgcaaggtacagtgtaattacatataagttacagtgtaattacactacgattgtactataattacatctgtcaattttttaggagaaaatttatcgataaatatatagctggtcccatatttttatatatttttttcttttaggagtagctaattgaattgcatctcctagctagatgtcacacgtgttcttcgtatcattcattcatgtgtgtagagtgtcgaccctgtagtcctgtagcaggcattggatagcagctggcgcctggcacccaaaacaactatgagccgcgtcagttccaaatccatcagaaccgttggtgtccaaaaacactaaccctagttttacttttcctctcccctcccctcactatgagccgctctacctcccctcccctcaccggatcttagccttaaaggaagtggcgggcggcggcgacacagctcgaccaaccagccccagcgccagcggccactccgcacccctcatagtcggatctgaccttagggaggcggtgtggagctcgaaggccgcggcggcggctgaagctcgacgatagcaaactcatgccgctcgtatctcttgcgagatatggtagctagatttttgttcgatttgggttttctttttctttgtctgcctttatcaactcttgtatttaggatctaattcaagaaaattttgtaaccaatttttgtatgttgtatatgcaacttctcctggtgtaatactaactgatttaaattttttgtgttatttgatatggactctgaatgacttttgtgtgttggacttgggatgccgcggatgaaaacatttaggtgaggacgttcaatttttattaggggcaatgtatcatgtgcacacatgcactcatgcaacggcatccttccgatctcaatccaaaggctagcatcatggttaaggaattttgcaaaaaaaaaaaaacaaaaatccctgacgaggcttttctcttatctcatcttcttatgtatcccaaatcttcatctctatcaagcaattgaactgggaagccccagatctggaacgagaaagaaagaatcaagcagcaggtggcgtacgtacatgttctattgaaaatcaaatctctaatttctctcatctcccgaactcgccggcctttttgtaggtggcgccgatggtagccacatcggcagtggcggcggtgcagctgctgctgcatggctacggaagcatcggcagcggtggaggcgccggcaaccagaaatcaagcacccacatacataatatgatatagggcctgttcactttgatatcattttcactttgataccactttaacaccttgccaaaattttagcaggtaccaaaatttggctgcaaactaaatgtagccactttttagcaactttactaaaatttagtaaggttaaaaatggtagcaaagtgaacaagcccatattttacatctaatattaaatatattttagtactatattacttttttataaaatatattgaaaagaaggaagtttcaatttaaaaaattaaaacatcttgtaattaatatactcccccatctcctaaaaaatcaatctagtaccagatgtgacacatcttaatatatattcggtactatgttagttttttttatcagggcagagagagtaaactactcgatcgagtactctttttcaaaaaaaaaaaggtacaaattgggccaaggtatatgtagcccatgcatgaagctactccgaatcactttgagcatacatggatggattcctccaagcatggagggggagagagagagggaggtaggtagctaatgatcgatggatggatggatcgaaaagatcaacgcagagagagtgagagagatcaggctaagctagctggagtagctctctagacgcagatcgagatgccacgctatctatcttagctagggaaggaaagaatatgcgttagtgtactagtactacgtgcatatgcacgcacgctggctggctggctctctctctaggttgcttgtgcatctcgcacaaatatggcccatccatgtggacgatgtcatgtaacgtacgtacgctgtccctccctcccttccccccactccgttcaatcaacctctatagctacgttgtagagtaccctgcctagctgcacactatgcccaaatcatttacgtcccaaaatataagtattttttaagttagcacgggtattaagaaagtaggtgagaataattgaaaaatgtgtgtgattggttgaaaaaagaaagtaggtgaaaaagaatggttgtgattggttcagaggagaaggttggtagaaaaatagcttcattttagaataaagtactgtgctagaaataactacattttagggcggaggagaagcttgaaccccgatcgagcgtaggtatatcaggtatgtttgcaagtgtgtttgctactagaatattcttgtagcgctttgccaatttcaaaatatacccatatagtctttcgaatatgtgcgtgtgcaggtttataagagcatggtcagccgttttccctaaacatctctctcccaatattaaaatgagggggttttggttgaaaaagtcgctctccaacgatctcgtaataatctatttaagaattggagttccttctgtgatggagctaacgtagttgtcctccaacctggatgcatggctaatagcatttcatggcaatcgctcaatttttgtacatattgatggtagtcggtaatggaggcacagtgacagagcccagatagtcggccaacctgctcaagagctacctccgttactaagttcatttccccatgaaagtctcactctccacaagtcaaagcgccgtgctcgttcccaatcaactctctaccaaatcaatcgcgcgaatgcaggatgaggggaagaacagtttattggtagtttgggggtagctcatatttttatcttagagtcaagctgatttcaggctatctgttggagagttattttaacatttgtgattggaattttgagaaaccgttaatcacgctttaaagatgtgagcgtctacgcttgtaccacgcatgcatgttccgttcgtatagcatattcttgtagcatagtatgcatgcgtgcatgcatatgtctaccactgcacgctacggcatcggccaccgaccacatgcaaagcatggatggatgcagaaaggtgttgcagctaacgctacatagctggagtagttgccacgacgacgacgacgacgaaccgatcgatcgaaacgtacataccggccggccggcagctagcacgcaatgaagcctcaagtctgtcgatcgtccagtacttgataggcttcagctaagctagctagacgacgacgacgcctagctatatatagagccaggcctagtagagctatagacccgtctcgctcgcctctgccaccatgccgtgtcgtcgtcgtccctgacatgatcgatgcatgcctgccccagccgcaggcgcgcacggcggctggccggccgaccggccgtacgtgccgccgagatgtttcgatctgggcatcgatcagggacgacgacgagacggcgcctcgccgtcgtccccggcccaataatccggccgacgtcgagtcggcaataattgggaagcacgcacggaagcgtccgtccggccggccgccggcgatggcagggcaggcggcgacaacggcggcatatactaccttcataatagtgcaactatgagtttctgtatccaactttgaacgttcgtcttatttaaaatctttttataattagtatttttattgttatgagatgataaaacataaatataactttgtgtgtgacttatgtttttaatttttttaaaaaaaataaataagataaatgtttaaagttggacatggaaaatcatggctatacttaaaatgagaccgatggaggatttgtttgcactaggaaataataaagcgaaaggaggggttacgcgctatgtacctgtgaattgtgatgacgagcagctagctttcgccatgacaaagcttgaagccatccgtagcttttttatcagatcgatcaccacgtgcagcagctagcaatgcaccatcgatcaaacaagaaaccgttacctacaatgtacatgcctgcacaggttagagagagtccaggtgaaatactacctccgtctcaaaaagacggagcactatctagcatgagatttgatatatatcatatacaaagattcattatattaagatagatcattcaaatgctatcctagataaaaacattttgagaaggaggaaataataattacatgcatatatacaaccacacaggctcattctgcttctaccttgtctttagtctttacaggattattttcttattacaaaacggagttacggaggcatgtccatcaggaacacctgccgcgcgagtgtgtatgtgggctccggggacgacacagaaagaaaacacgagccaagccaagccaggccaggccagcgccggccagccaacaagcgttgtggcgtctcacacgacatgtcacaacgcgcctgccttcctgccggctcggccggcggcggacgacgcgtcccgtcggcagctagcgccgacgctgacgttacagacagccctgacgtacgaatccatgatgcgacggacgcatatgcagcagagatcgatcatcgccgcccccgacacaatgaatataatttcgtcaatcatcacctacggtggcggctgtcgtcgccgtcgtcgtcggcggcggcgacggagacgatctcgaccaggtcgggggaaggtggtggcggcggcgccagggcgctgcgcggcgaggccccgaagtggtcgctcctgtaattgctcccctccgtcgcgccggtggtggcgccgccgtgggacgactgctgctcctccttcttcctccgggcgtccagggcccaccccgcgacggactcgtgcaggcccgacccaatcccttgcagcttgatgcctccgtccatctgggaacgccatcgtcagagagcagtaaaagtgaaacatttcatgaagtagtaaaaaaccttcagaaggagattgggagtttacacgagcgaattgatgataagattaagatgagaatttgatttttaatcccaatatcttgtttggtagaggtgatggatattgatagggagtttagttgaaaattaaatcattaataaaaacggatggctgagatttgcttagataaagtaaaagaggaattccctcccaattacctacccctaccaggtattgaaaaggagggagttccttcctcaattccccatccccatcccaccaaaattctcatgtctcccaaccaaacaaaacacttaataacctcatccctctaaactcccgatccctcctaaaaactccctccaaccaaacggaccgtcaaaagagagagttatttctggagcctacatgtgtaacgatggcgtatagtggtagagtgacgtagctgcagatcatttggatgagcacactgcattaaacagcaaataattagtcattatcaagacgactctaagtaatttagtagaactaagggcataaaaggtcaacggataagtaatgttccaactcttattgtgctagcaggactatgcatgtgagaaagaacgaatcttgcaggtaattcagaatttttactgacccaataacaagcctagaaatggcgtacaccttcttctccataatgcacgagtcgaacccgaatgttacctgtcgagtgattcctttattagctgcgattctgcgaagtcataatcattaaatgcttgcaattgaagtgggagagcgcaatggacaataccaagacccagatgaaaaaaccaatctcgaaagagttctggaacaggatgaaatggatcaggttgaggacaatttcaggtctgccaaaccagaaatgttccttcgatggctttacataaggagttctctctgttccgtgtgataatgatgccactgctgctgcctcttgagctaatcgggtaataatatgctctagctttgcaccaacaacaagcaggagctgcaattttactccattatcaggaagtgcctcattcagatataaattcattctatgtttacttttcaaaaataacagctaatgtagatttgagtcagaatttaaaagtagatgtctcaccaaaaaaggaagaattctaaagtagatagcaggaagtagagtatatgaattcaacggaacccatgtcaaaaggagaaagtttgacttacaaacagaggcaagaaagctaaccagaagtatgtatgccatcctgcattggacaataatcaaaggatgaagagcattacaccccacagaaaactattacaaaccttgctccataagagaactgataccactttctgaatcctaaagttgatatgcaaatggcatgctaattcatacaaggatagtagcatacaatgcagaaacaccatgttattcacaagccaccaatggtagtgttcaaataaagcatgtactggtaataataagaagataccatgccattttaatcatttactgtataccactatactggatccaatgaatcaaggggacatgtagactaaccgtttatattcagcaataggaaaaggatgacaaaaagccacatgtaccagctgcacacaactagctaatattaacgtcatgtacaaatttaagtcaaaggttagaactgttctatgaaaacaccaacctgataccaactactctcttaaagtcatgttcaagagcacgaatcaagtacttgtagaaattgaaggatggatgacttgggaaatgtttctgtgaaaacaaaagcaccctgttcgcttcaatagcgatgtaaatcaatgagcaaggcttgaaataaatgatgtgtcttaccaagccgaatgctgatctaagtgctttataatctgatttactcacagaatcatgaaactgcttaaagaaagcaatctgcaatatatgtagataaaagcttttagaaaaaaacaccttcgtaaagttatagatacatgaggcactactgaagacagtaagcaaacatcataagcattgcaataaacacatacatagaacatagtaggagaatggtaggaaacaatgtcttgcggaaagcatttaactatataataaagaatgtttactgaatgtattgatccaatatgaacatcagacatgtgaccactttgaaagatagcatttttttgcatactttccatactttaatggcactgtggcatgcaattcgtgcaatgatataatcattgcttatttacatcaatcatgatttggatcaacttacggccatggcagcatgcggatatccacattccaaaatatatgaaatgagaaagcacaaaagatttggcagatgacttactatccagcttacaacagccagcttcatccataacccctttgttcgctcactgacaaattcaccctgttgattatgtgcaatacgcccaggtgtagcatctcttttttgtactacaaccaatttctccaataaaaatgagatcattacacaacgaatgaaaatgttaaagtgttagcagcctagtgcttctaacaggaaaatggagacacgatcttttatacagaacttcctaatggtagtaactagtaagtctggaaagggaataatcagagcgtggtgcattaacatcattaagaaacactgcaaaaattggacattccaatatgtggtttatgcatgtcgtggtgactgccttgttcatgaatgattaatcctgggtatcaaccaaaaagaaactaatatttgaccaaaggaattgctcatcagtaagtatatctaaagacaaaaagggtcttcaggagaagtgggcataccagtgaccaaactgtacaaccaccccactattggaatttaaacccatttccacttgtttggcataatgcaaagtgcttatttggttaagccaatggaaaactcaattagcaaacataggttataggtacaggcattggaataagcacaaatccatttttcagtgtagtatagaagcattacatccaagcatattgagctatcatgctaaagtgctctgaagccagctcggtagaaanaaaggggtatgtgaccaaaacgcataagtcataacttaacccacatataggttatggacagacaatgatgcaatcatgcagtcacaattaagaaatttatgaaactgaattcttcctcctatggtaactgaatttcagtgacaatgacaatggttaaaaagaaactgaaaggtgttcagtcgcatgcaaatggcttatcaatatatgcttatgccttaaaacaccttgaaaccaaaggatggcaggaacaagccagtgtgaacaactaggacaaaatacaaaaaacatgggaaaacataagctgaggggatgtgcaaggttacagagtatgttctaacttaaatcagtgaaggtaatactatcttgtgaaagctgaccctttctacgcttcaatatgcattcaagaaaattgtgtatctttatcttttataattatattttattttggaacataagttatttaaaaacagaagcaaagaatagggaaataacacacacatttctgttgcatttcctgttggatttctgtctcccaaagcttccattttcttatctacaaagtttaaccaggcaaagattaatcaatggaagcatggtcacatatcacagagacttatctatgcagatataccttcgctccaccaagtaatattgttgtagcacagaacacaacatggaccaaaccaagtataaatatgaagatgtgcagctgatgcaatgcctccactgataacaaggggaacttcaccctaaaacagagcaaacctgttttgttacaatgtttattgaaacagttctgcaaaacaaaattggcacaaggttttgctaaacaacaatgtgtaatttgtatgccagaatggaatttcaaacatcatagaaccaggcatccactttcaagaaacaatttcccacaaaaaagttgcaagaaaaacaatcagatactattttcatttccaagaaaaggaatccttaatattcgataatggtgtatatccctaacctttttcttgcaaagcttaacaccttctgaaagctggtaagtctctttcttgcatggaagcatcaaatgcatagcattttccgaaacacaaataccaacaatgaaaccttcagagaggctcaggacgaaggaaatgaatcccagaagcattaactctgcatatgtagacactcaattagataagacgttaaagaaataaaattttaaatgaaatagcataaattttgtgaaatacaaatataccgtaagcagctattttgaatatttttgtttaaccaaaataagtgaaattctacaacagatgtaccatgtttatatattgaagtccggttaacaatatcgaaaataagcaactgaagatattcctgaatgataccttcttttagtctctcgagagctgaatacaatgccttctgatctttatgtttcaagaactgtatgagcaagaagaaaagaagaacttagcagtttcttaatagcattgtcgaccattattactaagtcaattcaacaaatgtgttgagtattaaaactcatattgaatattgaacaatgcactgtattttttttaatgggaaaaaatgaaagttaagctctgactgttattgtttcaacagaacataaaaagtttgctttcttagaagtccactaacataaaatacccagtaattaaatcaattaatagaagacacgaacaccatcatttgacgcctaaccagaagagctaactgacacacagcaaggaaacaagggagcgaagttaactgggtcaaaggaggataactatattgagccaacaatggaagtgccttgccaaaaagaaaaatgagattatgcatagcatgtgagctatcaccttacctaacaatgaaattatttgtattggcaaactgtctggtcctagaaaaacggacgagtgtgcttgtgtgatgatgctggcaggaaaaatgttgtgtctgtcaactagtttgtcagcttaggatgtgatgagattaatcatacaacacatttggccataaccatgtagtactaaattactgtgcattcgtagcacagcgagaaaaatccatccacagagaagcgaacatctacacggctagctattccaactgagcactcaaattctagctcctcaatccagtaaaacaaggccatatgtagttgcaaacaagttaaatatccatccaaaaccagcccgcccttatgttgctggaaacaagatgaactcgattgcgatggcgtcaccagttcatcagccattattatgacttagttacgagacctcgattcccgcaggggaagagaagagaaatcacggcgagcgctcggatcggatgcctgcaaacccgaatttcctgatcccccaaacgcgagcataacccacagcgcgtagcaaatccaccaccgcgtacgaatccaacacgaatcggcgggtgcatttggagaggcgagagcatataggggtgggataaaggagggaggaagggaggtgcgcgtgccttgccgaggtggtggaggaggcgctcggcggcgagggagacggagacgatggcgaagcagacgacggccaccacccaggtgggcgtgtgcgtgatcgacgactcctccattctcctcctcctcctcccctcagctcgcgcgccgcggcgtcgtcgtcgcccctcctccggaccatccgcacgcagcgtgcagctccgcgggttaaaggggggcggaggcggaggcggcgacacggaaggaatcgtggtggcgcggcgcggccatccccgcggcgtgagcgtgactgccccgggttgcttgccggcggcggcggctggattccatggctccagcctagcgcgatgcggcgagtacggtggcggtggaaggaaagctagcggaagagggaggcaaagctttgcttccaccgccggtctcgtcccctccacgcggcggcggcggcggcggcggccaacggctaccacccagcctctgcagtttgcgtgggccgggggtaggctaggcccatcaagaggctcagaagctataaaactattggaaataagtccactttgtgtcccttaattagtggctgtatctgattcatatatgtgaatcacaatgccgatatttgacccctaagtattaaatccagtgcaattaaatcgggttaaaaattaaagcattagtctgttaatccttttttttaactcccaatgcatgcttattttggtggagctataattaactcgtgtcgtccttccccttcactgacttgacagccacacatgtcgctcccaactcaggtatttgtatcggagggtgccggtatttgttaccggtccgaattttaaacaaaattttatcaaatttgaatatatattgccaaaattcatggaaaattaaaattttcggccgaatgataccgtatcacgggttcgaaattttgaagatagcctcctcgctatctggtgatctggtcaagcgagagcgttctcctgaccgtgtgaaaatagtttttcactatacgatatccaggttttcactacaatactttcccagtaatctatgcacatgtacaatttttataagtacatataaaaaattcaaaacttttggtgatatttattacttcctctgtctaagaatagttaattttaagccccttccatcttttatagaataattttatcttttaaagtaattattatatcatagtttgtgaaagtagataataaatatattgagaatatataagaaaaaataattaatttaggatttgataaagtggaggtattttaatttttttggttttgtattggtatacatagacgtaggatgagtgagaaatgaatttatgtatagtatatactccctccgtttctaaatatttgacgccgttga

SEQ ID NO: 67706 - DNA, 26376 bp, Oryza sativa
actaatgttgtaatgcatgccttgccggcatcatcacacaaatggaatacgtaggcatgcaattgaggacctaattaacattgaccaaatcgcaatacatcaatccaatatatatgcattaattaactactccgtactagtttactatactcgctgcgtcttggctacatattggtgccaaaacacctgccaaattgcaaaactttacacgagaccaacccagcgacgagtggaacagaagctaagagcagattgaatagcacactctataaacatatttcgaggagataagagaggagagagaagagcagtgggctacagatttatagtcagctgcaacacggactccaagatacatgtgtgtatgataggtggatccaggtattaataatgtagtatatatatgtttatatgtaactattatatgaattagctattaaattgactaaagataatttagagctaatagctggctatactattaaacttgttctaagcacgaatgcagcttgtgcacgactgcacgcaggtaatgcccacttattaatttgaatattctgataagcaaatgataaggttttataatttcgttacacacaaatctatcggagaaaagaaatgacatttgaacaatttttgacaaaaatttgaattttcagcgaaacggtttcgtaacgatggtctgttcggttgaattaatagtttcgtgctgatggtctaaatttttgaaaatttcaaatcgaatttttttaaaaaaattatgtagcaattatctcatatatggggagctgaaaattctttttaaaagttgcagctgctaccaagctgcaaaacagagccctaagagcaagtttaatagtatagcccactgctagctctaatttatttgtagccaatctaatagtcaattcattcatataatagttgcttactatacaattaatatatggtcacacctgtcatacacacattgtatcttggagtccgtgctgcagctggctatagatctgtagcccgctgctcttctttctcattttttatctcactaaaatatgtttgcaggtgactaatagtctgctattgtacctgctctaagggagcggcaatatggtacaagcaccccggtgaacgaaaaacctaacatatgcatttgccatgattgatggagtgtcgtgcatgtacttttttttatccaaattaagtgtacgatatatcaatgtatatattgatcgcttttgcctacgttagatgcgccctagattcgtcaccatccataaagccaatggtgccctttttcgtcacttagaaatttgcctattattttttttaaaggaggacaaaagctttgccacatatattaatagagaaggaaaaaattatacaaagtatgtacatggctagtcggagaagaccggcccgcaagagagaagttcgttaggtgatatcttccaaaattccgaacttctgcagcctagccgttccggctttgactcaagctttgccttcctttttgacctttgcaagaattgaggccggtgttgaggctgtacttcgaaagatccttgcattacgctccccccagatctcccaggtgactagcatcagtagcgttcgcagaggggctcttggggtgctgggggattcgacgacaaggttccaccaatgttcaatcgaggggcagtcattccatttgtccatttggaggtcagtatgtgtccatctttggatttctgcccaaatcctcttagtgactctacatttggccagaaggtgaaccgctgattcgtcgattgtgcggcagagggggcaaaccttttgatttcgctagcctcaattccccaatctgtcagccgtccatagcctattctgggtagcaagccaagagaagaatttgcatttcggcggcacccacgctttccaaatcgattggtagaaaacggatcttgctgctcccatgaactgcagagatgaaatatggatacttcagtcattaagacccacacgtcagtgagacataacacgtaccactttaacacctaaacttaaacatcacaagacccttaagaaaaaaaacttattcatcacaagcaattaacccttcaattaatttttcagaagagaaaaaaatgaatccaaaagacctggatgatgaagggtaaaaccgccattgacgtattgaccactacatgatccaaatgaagcctatgttagctagtgcatgttaagggcatgtgggcatgtttatattgtagccaaaataaactttaccaaattttggcaatgtcaaaattttggcaatttggcaatatggccaagttttgttaggatttattatgtatttaccagagtttcataaaaaaactaaatgggtgcacatatttgataaatttaccaaaatttggtaaggtttatttcgactacaatctgaccaagccttaagtgaccacgtagttttagtgtaagtacaacaaagtgatataaacatattgtaagagtttttatatcaaatttatgtcaagttaaaaagaaaaaagtagctacaacagatttacaactagctgcagtataagctccaatcaactttttatgaaaatgagttgtactatagagaaagtattatatacctaaggagacatcccctcgtatattaaaaactatccaaatggtcatagaaagttctttaaaaaaataacaatattcaaacaacatatttatgccacatcacaaaatcttaactctaaaatcaactcacgtatcgagatataaagaacaaatctatgaactgtattttgcactcaaatttatctctttatttttctcaatgtctaggcgattaatttttttaagtaatagatgtcactatacttataacattattaaaataatttaaatttttctaataatcatttttctctaatcaacattggatttaagtgataaaggatctgtttagattggtgccattttaaaccataccgttgtttggtaaaattaacaaatatatggttgcatttagtttgttaccaaatattggtaatgcatagaaaattttggcacaacatatttattccaacatatcaaaatttggcaattctatcaatttgtcaaaaatttggtattgtcaaattttggtaaggttattttcggaactaatctgaacatgccgaaaggtttagggtgaatacccaacgtgatccttgaactttcgcttaaggatcaatttagtccctgacatttcgtgttgtccaaataagtaccttaagttcattgtgtgattcaatatggtccttagaccctctaaacatgccatgtgtacatgccacatcatctatgcatgcaaattcaatatttaaatatcctttacacccttatgttttcatatgaaataaagaaaaactattgagaaaacacacaaaaaaaagcttttgaccattggcaaaaatgtgtagtaggggtgaaaacggttcggaatttttccggattccggacctgttttcggaaacggaatcagccggtcgaaattttttcggaatttctcggaaacggaaatattttttcggaaacggaatcgaatatgataatagcagtttccgtcggaactcggaatcggtcggaaaaaattccggaaagtttgtcggaatttccgaagttaaaaaggcccatccaaatagtccataattcctccagcccaacccaagtccctactaaccgaggagacaggctaaccctaggatagaggcggcgcatccaggaggttgagtcgagcacgccaccgctggccgccgtctcgtcgcccttcctctctcgctcattttcgccgccgccaccaccgacgatgacgccgacgacgccggccactggccacaccgccgacgccggccacaacaccacactgccgacgccggccacagccacacgaccgacgacgccggccactagccacaccgccgacgccgccgacgcctcgccttgcaggcagcagcagccagtagcccagtggcagcaggtgttcctgcttctgcttatattatgttctgttaattttgtagaagagaactgtattattaatatgttctattgccattcaccaagcactccaataaagacagactgctagtatgtccagctaaagacagacggtgttcttgagcctaaaccgttgatttgatttcttttatcgtacagatttgtgatttgaactttgttttgtgatgactgatgaactatgtactaatggagtgatgtgttatgagattgaactaagtactgaaatattgatgaaattatatgaagttatagaagactatattttgctgtgaagctcagtttgagtggtttctgtattccgataaattttcgttactgtatccgcaccggttcattttcgctccattttcggtttcgataatattcgtttccgttttcgtttccggggtttccgatttcgattccgattccgaaaaaaatatgaaaacgaaaacgataaaggttgtttccgtccgtttccgtaccgttttcacccctactgtgtagcattgatagataaaaaaattaatattttttgttttatgattgcttcttcttgtttttcttttctttatttgatagaaaattgaaggttaaaatggacatttaaatgcacgaatgacgtggcatgttcatgtggcgttttaagtggtctaaggactatattaagccgcatgataatctttagggtcatgtttagacattataaaatatgaaggactaatttaacctctgagcaaaaagttaaagtactgaactgactattcacccaaaggtttacgagggaatacttctcgaggatcagtggtggattaactgaagatgagatgctctacgtcaggtcaacatcggtctttgcttgtagcatcgttcattccacgctggtagtggtactatcttaagctagaaggccggccatctcgtggtagagacgtggacgcctctgcccttgtgtgcccctcagttgtaatccaccacgtctggctccgtttcagcctcccgttgccctatctatctagttatgtaagctagagctggactttgcttgtactccctccgtctcctaatacgagggattttgacattttttgcgtataccatttgaccactcatcttatttaaaaagtttgtgtaaatataaaaaacgaaaagttgtgcttaaagtactttgggtaataaagtaagtcacaaataaaataaataaaaattccaaaatattttgaataagataaatgatcaaacagtggaagcaaaatgtcaaaatctcttatattaaaagacggagggagtagcatatactatttcctgtctgtctccactgaaatttcgtgagatttcagttttcaaaatggggcctagccatgcacgttcgttggcttcttgcaagcactggatgatgttgtccttgtccctgagatgctgaattctaaactaatcacgcattgcttatcttattactacctccatcacaaaatgtttgacgccattgactttttaaaaaatgtttgaccgttcgtcttattcaaaaaatttaagtaattgttaattctttttctatcatttgatttattgttaaatatatttttatgtatacatatagttttacatatatcacaaaagtttttaaataaaacgaacggtcaaacatgtttaaaaaaattaacgttgtcaaacatttaggaaagaagggagtaattctcaagcgtcaagcgtgcacgctgagcttcgttatggcgttgaagattgctgcacagtagcagcagacagagaccttggtcaatcacactacagtccctgtctttacagctagcttgtggcctctggcactcatcagtgaggattgatcaatcaatcagagccttccctttctttttggcttttctttcctcatgcgttagacagcggtaaaggttcatctctgtagattctctacctgactatccgttacttcctccattttatattataagactttctagcattgttcatatttatatatatgttaatgaatctagccttatgatttgctgaactgtgaaggaaatcacttaagctcgtctccccagctcgtctcttcagctcccagatctgcacctgccgccgccagagctgaccggcggctaggacagcggcagcggcgggaggggggggcagaggatggtggaggatggcggcggtccgacagcaggaaggcgggtcggcaccggcagccctagaggctacggcggcggtggttcccgtcggtgccggcagccctagaggctgcggcggaggatgacggcggccctaggggatgcggcggtggctcccgtcggcggccctagaggctgcggcggcggctcccgtcggcggcctagaggttgcggcggcggctctcgttggcgctggcagccctaggggctgcgatggaggacaaaggcggcttccgacggtgccggcggcactaggggctatggcggcggctcccgtcggcgctggcggccctaggggctgcggcagctcgagacagtggcagtctgtgcactttgacggtggatgcctaggattcgggtgaagtgtaagtcaatcccgtaggttcgatcgtgtttggttggctagttccgactatacggcgaatgacgacggttgagagtggggccaacaagcggcgcgtgacgtcaactctcctgaaactgatgaagatggcacaaatggaggtttgcatcgacggcgcactaggggcggcggcgaccggtagacttccactcgtcaaatctaggcagagaagcaggatgtgtcgaggtcgtttggttttcttttcctttttggttctgttctcctctttgttgaggtgtgagtctaagtactcatatccttttggctgtgtatatccttcatggatatagagggccggattaataaaaatctattatctaaaaaaatgttaatgaatctagacatactatatacctagattcattaatatctatatgaatgtggacaatgctaaaaagttttatagcctgaaagggatgtagtaaataatttccaatggaatggtaaaaggaagccatccgaatgttataagattattaagagaaaaaagatacaataaacacaatggaaggttgttgaggttggttgtgcaatacagtgtacatccacgaaccgagtcaaccacacaagcacaaacccctaaaagggaaatatagcaccgaatcgaccgccgctatgtgtggtcgatcactgttggatctataacaataccatagatcaaagtctctaaatacgttgtcttgtaaaagttacaacgttaacgctgtcgttgtcgcccatctaaggaactggacgtagttttcatatagagtttctcgccaaaagagggagagaaaggtacatgtgaaaatcactgtagaatctaacctgagaaggtgacaaaaggtagattctgcttgttcaggaactgacgcacaatccggtagtttggtgctcttcttttgcagcctctgttccagtgttccgggcaggcagcagtacagcacaaacacaaacacgtttggataattgcagaaatgattcagggtttcctgcagaatcatgtcagttaggtgacacacaaacggctcgtcgttctctgtcaccgggggaccttgtgcagtgccgcagttgcgtcttgtgtgcatctctgaatattcattcagtcatcggaaggaagattcagacagaaaatgcagggctcacagcagatagcagcggatagcctgcccctgcctgctctgtgccaagaaagccacaggctagctactctcttcgccgctaaatgtaattatttccagcttatttagtagtaaagtttaatataaaagaaaaagatttcctttcagagtcatcaaatagtcaaaatcttaaatttcgaattacttagattccttctctaaacacctgattagtcaaaaatatttttgattcccatgcagtgaaaataacgttgtcccatagaaatactttatatcgtgtacaaaattttaatcctaaacactttttattttacaagggagtagtacgtagcaaagacagagaaacgcctagaaatcttccggctagcttcacaaaggtgatggcttatctggtataggtgaagtctcactcattaaatttatttgatattagatcattccctaatattcgccttccttttatgtatgtctagatttattaacatcaatataaatgtgagaaatgctagaatgatttacattatgaaacggaggaagtagcaatgatcaaccgtcagtgttagagcagccggccatgcaattaccgtgtgttgtgttgcgcccgagcgaacgatacggtggtggagtggaggacgtacgccgatgcaggatggaccagcattttcaagcgcaaacggcgacagccattggcattcgataaattcgatcgtggctaaccacactagagcaatagctgtggatatatctatataacattaacaggataggagatacgcgtgcgttccctccactcgcgcgggctgagcttagcttagctccccactcactcgccacttgctgcaattgcaatggctgctgctgctgctcgatgcgccggccatggcggcggcggcggcggcggcggtttcttactccggcgacggctgctcgccaccgcggcgttcctggcggcgtttgggctctgcactgctgctgctgatgacgctgccacggggagaggacaagggcatgatcatgtgatgctgagcgtggaggacatgttccctgactcgtcgtcgtcgtcgccgtcgtgcgacgcgccgccgcgaggtttgattcgttttgctcgccatggcatggcatggccacttcttgatcgagctctttccaagtctctgtctgtcatgtcagaatctcagtgtgagtgtgaggtgtgtctgctgctgttgcatttgcatatatcatgcattcattcatgcatggatagatgcttcagattgctctctgcatcagtgcttctttttctttttcttttcttggtttggtttggtttggttaatttgtttgcttattcaattgatctatcacccgtttgtttctggacttcaggtttctctggtttcagagctgcttttgtggttgttttgttgtgctttgaatttatatatacttacatacgagactggaaataattttgctgattccagtggattcacttacagctttgatattgcaaatgcttccaagtaagactctctctaaacaaaactaaataactgtagtaaatgtttctaaaataaaataaaaactaaatagatgtatgtaagactttgtgtcgttatctgctcaagtttttgtcttgtttgtccgttatcagaatactgtatcttccctgttttgtatggtacagtacacaacaagcgtaaggaaactgccatgaatttaaattgatggccacagtacacagggccatatacttgacagtgattttattacaaaaaaaaacaaatcacttttaaagattttgagtcggaattttttttggaagaccgaaagtatgacaaaaatggagctttggctctcacaggaaccccaaacatttgatactcgtaaaaaaaagggttaaatttgcattttaaaatatgttaggtgttaaaacaataacccttttttttaagtgcgagaaggacacacactcaaagcttgtgtgtcctaaaaacgctccaaaacataagaccttgcaaaacatggcacacacgtctgattttttccaccaaacaagcacacttgtatataaattttggtagataggcagatttacataaatctaaggatcggatatgtgcgtgaggaataagatgaaggcaatgatgtttctagagcataaatcaattaacaacgatggcacgttagtgaataaatgagtaacggttttgctagctatttgtggattatctaaacgtggtcaaaatacaaaattgtagctttcaaataactttattaacttttagcttgctctcttgggtttagctagctatatgcatgtgtttttatgttgctattgattatagggaaaattgcaaaaaccatctcataagtcaattgaagtttgacattttacccaataaatcactttgttgcaaatacttactcatctatttgttgcaaaaccacatgttttcataaagtgtgagccgtcaatgtattctttaccaaaattaaatattttcatagtatagtcttgacactttttttttgagattccacaaatagaattgctgatgagagcttaaatgttgatgcattgagtttctctatatgaacaaaaaaaagttcaatcaaacatgaaaaataagtgtaatgcaagcacttggagaagattgatttcgctaacttagcatgtggtgactctacatcagcgataatgggccaatttggttaagcacgtgcgcactgggtggtttttgcaataaaactgagtaggtgatgggtattagcaataaaataacttatgggatgaaatgttaaaattcaagtgacttatggggtggtttttgtaattttccctatagtctctttgttttactagcgaaccaaccgttcgttgttacaggaattagaaaaatcgcattggcatattacaaggaagaaatctattttttaattttagaattaaatttgagttttatttatctttttgtgttttagccataaaaatatttctagcggactacgttgacttcctgtcactaaataaatgctcctcccttcaaaacgttgcatcatagataatctatgaattctaccatatatgcgttttgtttgaggaggggcactgatttcacatatgttttggaggttaatggtgggtggtgaaagatgcaccaccgctcccttttataagaatatagatactggtaagtggtaaagaagttgaccattttttttgttagttaatttcaagcattatatgtttcaccctaataaaaagaggtacgtagtaaatatgtgagttgttttgtgttgacacttgatacaatatttcaaccaaaaagaaaggtgattgacaaataagttacccactcagtgaatagatgcatggtccaacaaatgtctagtttatatgagaggaacgtattttcaacgaagaaatccgggtctatcatattcctgatgaaaaatatgtaatactctgtccgtccctaaatataagggattttgaacggatgcgatatttcctagttatatgaatttagacaaggaatatattcaaattcgtattactaagaaatgtctcatctgcctaaaatctcttatattttgcgatggagggagtagttcactactgcacaaataaacaattataacctccctaaaaaaaaccctctcgtgctttggttgggccaagtgtactttttttttcatttatgctgcattattgttcagacacaactgaatgtactagaaaaatataaagagtaaaatccatcaccggtccctaaacttgtaccgttgtgtcatcccggttcctaaactcgcaaatcgaccgttcaggttctcaaacttgtttgactgtgttatcccggtccctaaacttgcatatcactcatttagatcctccaacttattcagttgtgtcaccccggtccctaaacttggatttgaatatcatctgggtcaaataggacggtttaaagactttatatttaaaaataattcataactttttcatgtgaactataatgaagacaaactttatatgaaacttgtagccctcgacgcgatctacaattttgttgttgaatttttttattttaagtcattttttcccaaaatgtaattttaaaattaaaatttcaaaatctataaacatgcaacaatattttgggaccctaaaaagttttaattcaaaaacttttcaactacaaagttctaggtcgcgtcgagggctacaattttgatataaaatttgtcttcattagagttcacatgaaaaagttatgaattattttttaatataaagtttttagaccgtcctatttagggaccgggatgacacaactgaacaagttagaggacctaaacgagtgatctgcaagtttagggaccgggatgacacagtcgaacaagtttgagaacctgaatagtcgatttgcgagtttagggaccgggatgacacagtggtacaagtttagagaccggtgatgaactttactctaagtaaaatatagacataaagtgatagaaaaaattctgaatttcattttctgaaataattccgattgatccaagctgaacatctccctggaaattcagatcacagacatgacgccacgtcatcaaccactaggatgacgatcgtccaccggcacggcccgtgctcgccgctagccgccgcgcacggcgagccgccgtcccacggcgagatcctcgccgccgaccagagccgcgccgagtcgatccaacaccgggtgtccaccaccaccaccggccgggtgaatccaaagcgcagacgccaccggcagcagcagccgccgtcggcgccggcgccggcggcgtcgctgtcgtcgtccaccgcgtcgctcccggcgtcgccggggcgcgcgctgggcacaggcaactacgtggtgaccgtgggcctcggcacgccggcgtcgcggtacacggtggtgttcgacaccggcagcgacacgacgtgggtgcagtgccagccgtgcgtggtggcgtgctacgagcagcgggagaagctgttcgacccggcgagctcgtccacctacgccaacgtctcctgcgccgcgccggcctgctccgacctcgacgtcagcggctgctccggcggccactgcctctacggcgtccagtacggcgacggctcgtactccattggcttcttcgccatggacaccctcaccctctcctcctacgacgccgtcaaggggttccggttcggctgcggcgagaggaacgacggcttgttcggcgaggcggcggggctcctcggcctcggccgcggcaagacgtcgctgccggtgcagacgtacggcaagtacggcggcgtgttcgcgcactgcctcccggcgaggtcgaccggcacggggtacctcgacttcggcgcgggctcgccgccggcgacgacgacgacgccgatgctgacgggcaacgggccgacgttctactacgtcggcatgacgggcatccgcgtcggcgggcggctgctgcccatcgcgccgtcggtgttcgccgccgccggcacgatcgtcgactccggcacggtgatcacgcgcctcccgccggcggcgtactcgtcgctccgctccgcgttcgccgccgccatggcggcgcgcgggtacaggaaggcggcggcggtgtcgctgctggacacgtgctacgacttcaccgggatgagccaggtggcgatcccgacggtgtcgctgctgttccagggcggcgcggcgctggacgtcgacgcgtcggggatcatgtacacggtgagcgcgtcgcaggtgtgcctcgcgttcgccggcaacgaggacggcggcgacgtcggcatcgtcgggaacacgcagctcaagacgttcggcgtcgcctacgacatcgggaagaaggtggtcggcttctcccccggagcttgctgatgaaatgtgccacgcgtcacccccagcaaacgtacacgtcagcacgcagaatgaattaactgtctgcactctgcagtgtaatgctgcaatccaccaggtggtcagcgactggttttattaccatgatttctgaagatatataatcatatgattacaaatatgctaatattattttctcttcttacatttatgatttgcttgaaagaagggaaaagcgaagattgatagaaaaaaaatatgtaaaacaaaatgagctattggcgcatgattaattgagtattaattattttaaatttaaaaaatagattaatatgatttttaaagtagcttttgtatatatatatttttaataaaaacgcaccgtttaggacgggggagtttttctccgaatccactgctgtagaacacaaacttgtggtccgatgatttctggcaagcccaaaaaaatcattagacgttttatgtaaccatctatactatgaataaatttgatcgggttaattggatcatgccattaaaatatactggttttgaaatatgatattagtattcgcatatctgaaaccataccattataattttccacatatttgagatataccactacttacccattggatgcatttttttttaaaaaaataaggaccaaactatccctttttccccttagtccttctcccttcttccatggcgtgacctgaccaccggcctcctcctgcacgtcatctccctccacctcggcccgccgctggcctcctcttgcatgccagcgtgtcccagatccagctgcctttcctcgctccgagctcccgcggtggacatcgccggcgacaggatttaggaatcaatggcggtggtggtcgctgagatcaatggcagtggtggcgccgccgttgcgtgagcagcacgacgacaacacaacgatctccctaacgttgaccgctgcccggagcctactctgtaggtcgccgtgcttggcaacgttggcgagcagcgccaccgacgcggtcgaggagccgatggcctcctcgtcgagcggcatgacaagcacccgtgccgccaggacgtcgtcgagcaagaccgacgacgctgacgaatcagcctgccacagcgaactacacgatcgccgtggcgagtgcgcgcgccacgccggccgacgcgaggcaccgccgatcctggttggactcccgcgcgaggcgcccgacctcgcacaccaccgcaccgcgcctcgccgcgtcacttgcccatgcagcggaccttggccaacacacgtcggtggcactgctgtagggaagagagaggtagaagatgagggtattttcgtctgatacatgcaaaatacgtatcttagtggcaccattgagattacatacaagtagcagtatcatcgttataaatacgtaaatagtattggtacatttcaaaaccggcaaatttttaatggcacgtatctaattaacccaatttgatatggtacaaaacattgattcttggttactggtacatattcatgttcttttattatttttcaacctatcaatatttgaacaatagagattcaatatgactataaaattatcattttttgtggtttcaacctaatgttcgacctgaattgattttatcagtaagaaactctccatctatcttaaaaaagaatccattcctaaatatgaatctaggtgccagtctatatttatttttttggattggacttttctaaagcaggagtaattcagttcatataaacaccgggtgcggtgatgagcgacgagcgacgagcgtggcggccagtgtgagaagggggcacggcggcggcgggaagaggcgatggcggcaagtccaaaggccggaggcggtgacgacagcgggaagaggcgatagcggcgagcccgcaggccagaggcgaggaggcggcagcgggagagggcgccggatctggatgggacggatccggtgaggcggtagggggttccgtcgtcatcgtcgtcgaccggcgagtgaaacaggagatagggtggtggccggcaaatgaggaggtgaggcggtggcccggagacttggcgatggccggcgaacaaggaggcgaggcggtggcctgaagacgaggcaacggtcggcgagcgaggaggccagcccggaggcggcggccggcgagaagagcgcgaatgacctttttttttatttttttcatttttctcctttcccccttctatttctttgtgatttcttatatttcctttaagattcttttgtttgtagtaattgatattttggtggttttgatgaatttgaagggggtatactcgtcgccttaaatgtaggggtgattgtatccactcatttatcctactcttcctaaccaaaaaaaatggatcactaaatccaccttcatccctacaaccaaataaaaataattggatcgccatattcactccaccaaacaaaaaactggatcgccatattcagtaaaatatggaccgccgtatcccatccaactttgactgtgaaccaaacgcaccctaaaacaaccaatctggatggtcctatgacatttaggttggatcttttttattgagggagtggttgggactagagctgtcaaaaaagcttgaggctcgactcatcctaggctcgattcaaactcggctcgacctccaaacgagccgagcccgagcctagctcgagcttccaacgagcctagtaatatattatttttattgttattcaataatttaggatatcaaatatattatttacatgcattgtattaacatcatatatttattttattctttttcctcttctattaatatgatgaactaggaacaatctcggtagtcaagcttgagcttcatctagctcaaaccaaatctatctgaaagctcgaacattttatgggctcgagtttcgagctcgctcattgacagccctagttagagcaagtttaataatataaccaactattgtttctaaatcatccatagtcaatttagtagccaattcatacacatatgtatcttggagtctgtgctccagctacagcaaatctgtagccaactactcttctgtctcctcttttatcttcttgctggtttatagtccgatattgtagtcatcttaggacgggaggtttttgtaaatcctatcttacaataaatttatcccccactaactccttaaacttaacatgcaaagatgccacatcatcattgacggagcgtggggctcctcaccgggagaccgagcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaaccccactcgccccctctctcctttttttttttggtgggcaaggtcctccttttatatctcaaggggatactacatgcaccacttctacctacttttcttctgggtggggacctactctatcttgaccaaaacttggcttgcaccttcgcctggaagctaaatcacaacttgtccttgagtgaggctcagcgccgtctctcgcctgacaccggggatctccctgttactccctcattaatgggcgaagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccacaacgtgtcagttcagcatgctacacgtctgcccttcttcatacaatgacttccttgcaatggttgcgatgaagcctggaatgtatctggccggggctgacgtgccaactccaggagttcccacgccggctccggctagggacgagtgcctggaggccctcatcattcagacgggacggggcgaggcgtgtgtcaggccgcctgttgccacctaacccgcgatctgaccggtctgtgaccggtcacacactgtgacctgtcacggaccgaacgagtgtgctgcactgcattaaatgcggcgtggggcgctcgtccaacccgcaataaacgcggttaggtgagcgccgctgtgctcacctaacccacacacgtggcgccaaacccacagggggccggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagataccctcggtcccatgtcaccgacaatcatccactaacaagatgccacatcatcatccactaattaataagatgccacatcatcatccactaattaacaagatgccacatcatcatccactaacaataatcacatttaaacatcatgcaaacatgctatatctttatagtttttataatttaagagcttttcaaatacaatcatgttaaattattatccaacataattcacataatgttttaatgtatatctttattatattttatgatatcctatctacttatatagcttatcctcacttagttagtgcttaaatgattaatctatggtccaaattatatttctcattttttcctctaattaagtcatatcacatcaattgtttttagcctttagatgattaatctacggtccaaactatctccctacttttcttcttccgtaaattcataccaccttacattttacgtttgaatcaccattctacatactatttaaatttaaattatcataaatcatattaatttacttaatctgatattatctagctattttacatgttattttttcattgttatcgtactaaatttccgaaacagggtttaacttagttccaagaaaaatggaagcctagcaagcggccactgtttcctcagttgtcaccagacgtctgactcttatgagttctgacacagcgagaccgggacgcatagccctctctcactgaaagtgggcccggataggggacagctctccagaacccaagtgcactgcaacccctgcaaagaccctagtactagtactactctactaccgagtaccgacaaacatacgctccgtaggaatgccaccggaagtactcctacgccctaactttacgtataccgtatcttgtcagagaaaaaaacggacggcccagatgcactgcacgcgccacaccggtcccaaaccttcccaacgcgcgcggcgcatcggacggccaggattcgccgcggatggaccaccgtccgatcttactccccaccctgtcgctgtgtgcctctctctctctctctcccgtgtctctcgccgcggcgtcctccggccaccaccccgcgccgcgccgccgtctacggatccccgctcctcgctcgagcgagcacgaaagccctagcgcgccgccccctgcaccgggtgggttccccaggtgagcactccattcgcgccgcggcgccctctctctctctcgttttgttcccacggatttctgcgggggatctcgttcttgggtggaaatgggaggagggggttggggttctagttcgtttcaaggtggttgttgacttgtggtggcgaattgggtgggttttgggagggttttgtgtaggattggggggggggtgaggtgaggttaggttggtggcgattcttgatttgttcttgcgcggcggcgatcgggctgggttgcgtctgtcctctcctaggttttttttttctctttttcgctcgtgtagttggattctttggtgggttcttagcggaagtttactgttttttgacggagcggtccgcaggaatgggggccaatgttttgattttggggtatctctgcacgccctaaaaacaaaagagatttgaagggagagacttccctccaaacatttttttaagaagaaattgtgagcgttgttggggattgaacacatctttgtagcgagatgtcggcttttatgttgaaagtctgaatggtacatttttttgtatgagcatacatggtttattgtggggaagtataagtgtgtttctagtatatgtttcttttttatttcaccattctgatttaggtggtatggtggatggatttttttgctacccttatagggtcttaaatgactattccgtagaagaaagttaagttttttttttccatatacttttgtttgtctctttatttaggttttttttttggggggtgggggggggctctactagggagtttagttcatataactgttggtgcactagttcctcatttatgaaggaactgctgaatttcatcctttcaggtgtgggcacctatatgtgcgttatattttactttatcgcaatttatttatcaaccagcattgactttgattcagagatcatgtcggctttgcaggtttacttgtttttatttttaaaaataatccaagggttttcagaatataaataattgaatacggtcaaatgtgcagctaactaattatcatgaaatgccatcaatatgtttaaagacttacatagttacgtttagcaggttgttgagctagaatgggagtggcagggcacaatgatcctttgataggtgaaacgacatgtggatctttgctgcagcaacttcaggtgcctttgtctcttccaatgttcttttgtatgtgtgctttataatgactggaactaaggatagcagcaagccattttagttccctatctacaccatagcatctgtgcaacgaaaagttatatgagtagtgcataggattggacaagtgactgactagtgtcatttcagttgatatgggatgaggttggtgaaagcgatgaagaccgtgacaagatgttacttcagctagaacaagaatgcttggatgtttacaggagaaaggttgatcaggcatctaattccagggcacgcctccttcaacagcttgctaacgccaagtctgagctttctagactcctttgtgcactaggcgagctgtctatttctggcattgtaagtatcttgataaatattttcatgaatataattccttattttccccaaaagtacacacacacctacaatatgctgcatctggctcattactgctgacttttgcagcctgacaagacaaccggtactatcaaggagcaactagaagcaatatcacctttcttggagaaactctgcagggaaaaagataagagggttagagagtttgctggtgtacaacttcaaattcaaactatacgtggtgaaatcgctgggagtctgcaagttggtgaccacatggaaacaccccgtgttaatgaggatgatctttcaacgaagaaattaaatgaatttctttctgaattgcaagctctacaaaaggaaaaggttggcactttgtttttcattttcacaatctgccaactgcctttttctggacctgcttatggaataatcttccaaatttcatagcccaaccatgctaaagagattctttgttttgcataataaataataatttcacataatatctgctggtcaaattctcttgataagcattgtataacatcaaacatccctatgatggatgatctctaaattttgacgtaccatattagtaccacagaagcaggcatacggccactgatatagctgatgataatctttgcattatacacacattttcgactatttaaaatttattgacttgaaatcgtatttctttccattttcttgcattgcagagcaatagactgcacaagattcttgacttcgtgagttcagtgcatgatctctgttctgtccttgggatggatttcctgagcactgttactgaagttcatcctagtctcaatgactcggttggtgccgagttcaagagcattagtgacgcaacattatccaagctgtctaagatggtaattcaacttaaagaagagaaatcaaagagacttgaaagggtaattctacaacgagcctcttgttcttactcatccaaccctttttgtatctctgtaacatagtacatcctggatattatttatgattaaatgctatgtttctcagattcaagctctagcttcccagctaactgatctttggaacctaatggacacctctgctgatgagcgacaactttttgaccatgtcacatgcaacatttcctcaacattggatgaagtaacagcaccaggagctcttgatattgatttgatcgaacaggttaggagattttcttctcaaagtgctcctaggaaaatagcataatattttgtctgacatgttttgcgctccaaaggctgaacttgaagttgaaaggctggatcagctcaaagctagtaggatgaaggatattgcgttcaaaaggcagactgaacttgaagatatatatgcccaggctcacattacgatagataccagtgctgcaagagatagaatactgactgttattgattctagtatcttcgagccttcggaactactggctgatatggagaaccagatacttaaagcaaaagaagaggcactaagcagaaaggacattctggagaaggttgaaaggtggatgtcagcatgcgaagaagagagctggcttgaagactatagccaggtaataaaaagtatacagtatgtaacttcttcattgtttgatctcattaacagtcatacatctttacattgatattctgataaatggcaggacgacaacagatacagtgcaaccagaggtgcacatctgaacctcaagcgggcagaaaaggctcgtcttttggtcagtaaaattccaggtatatcctgaatgtttacttggttttgtttcccttgtgattatactacattacatattctaaaagtagcttccactgcctgccttagacctatgctacatctggcataatatgacatggaaaattaattctattcctaatctgacttttgggttcatctgtgactgttacgagtgtagtcattgttgatacactgatggcaaagacccgggcatgggaacaagagcatggtatgccgttcagctatgacggtgttcatcttctcgcaatgctggatgagtacaaagtactaaggcagcagaaggaagaagagaagcgacgaatgagggtacccttctgtccaatccccattaatctttcgcatgtctggctctaaaaccatatctcattccatttgctttcttccaaaactcatttcaggaccagaagaagataaacgaccagctagctgcagagcaggagaagctcttcggctcgaaaccgagcccagcccggccccaatcctcaaggaaggcgcctggcccgcgggccaacggtggcgcagtcaatggcacaccgaaccggaggctctcggcccaccagaacggcggcggcaggtcggtgagccgggacgggcggagggacagtggccggccggctgctccggtgaactacgtcgccatctgcaaggaagagtccagcaacaacaacccggcggcgtcctccccctgacgatcatcctcgccatgattgaccgtacatttcttggtgccagtggtagagagatactccatatctgtgcagtagcaggaaaaaaagaaaaactatagcaagatactagtaggacaagtgattcgaatgatagtagcagtattttggctgtatttgaatcgatttgttgctgtccatttgctggtagtggatcgaatggatcgagtgggtgcagccgtgcaggtgcatccgccatggaagctgagctcatgtcgtcgtgtcccgttggagtttctttcgcctgtcactgtcggttgttgggcttgagcttggcgggacggcgaaaaacgcaatccgtcagttacagtggttatcgcttgaatttcgtcgaatcctatcaaagtttaccgagctgttatcggcagttttgcggttactgggctatcagctgttaggctatgaatttaaatttgaaaatttcatgccagtaatccaaaatttcaagttttggatgatgtatatcaattccgtacattatttaagcactaataacaacttggagtagattacaacgcgacatacatgcaacagcagcgaaacattcgtcagtctttcagacttccgcactcaatcaccaatcacttcatcggtttaggaggtggtttctcgttttggatggataatcaactaaaacaaagcaatcaaaagaagaaaaaaaaggggccaaatttcatagcaatttgattacacaacacagcacagcaattcggtggaggctccacgcaaattgaagaagcatatgtacatcatcgatctgctccttccccggtcagcttttgtctcagtaatccgtcggtggttggttgccgtcgtaggcctccgccgcggcttcttccctctcctgctcctgatctcgccggtgcaccttcttgctcaccttgatccagattgcaaaatgttatagcatcggtgagtggaggagagatttttgcaaagattttgattcttggttgtaaaatgtttcatcagtggagggatttgcaaggattgattgattgatttaccttgtgtgatcttgcgtggaggcggtggtcggaggaagccaccttccggcgaggcaggctccggccgccgcccctgaggcggctcttgctgccgggcttgtagcagctgaggctgccgctggagccgtcgaagctgacgacggacacgtcgttggacccgcagctctccttctcctcgccggcgccggcgccgaggtcgtgccgccgccgcaccacgatcacccgccgccctccggccgccgccgccgtcgagccagcgtccgccgcgttcttgctcatgcagtcgtcggccgacgcctccgacgacgcctgccgcgtcgccatccaccgctccagccagctccaccccacgttgtactccgcctggtccgaccgcgccgcccgcttcttcgtcgtcccgccgccgccgccgccgcagctccgcagctgctgcgagaacgcgtaggccagcgcgcgctcccgccgcgtcgtcgcctcgatcctgctctgcatccgcatcctcgacacgttcgagctcaccgtgctgtcgtcccactcctcctgccacgcacgcatcatcatcagttcatcacatccaaaatctcgcgacacaactcgccgatcacatcactgttccatcatcggttgcagagatttgatcgagatcgaagtctacattgcattgcggacatgttcttgcatggtctgtatataccttcactctgaacgcctgtggccgcgaccgctggctgctccggtgctgcgccgacgtcgccgcggcggcggcgctgtcgtcgctgaggcggaggttgctcagcgactcgccgacctggacctccaccgacgccgcgatggacgccgtagtagggctcctcggctcgtcggtggtgcagcagccgttttctgagcatttgagcttctgcaactgcctcctcgcctgcaacaccagtggatctgcatgatcgatcttttttttctaacctccaatttttgaatttggatcaagaacgcaccatgaatcccctgaacacggattggatcatcgtcgccgcttcgacttggctgtcggtggccggctcggccgccgtcggaggcgcgatgtctttgatggggatgctcatgctcccatgttcttcagggtggccgccggcgtcggcgacgccatccacgccattcgccggtcgagcaaccgtcagcgccgccgcctgcggttcctgcggcattgcgcaggtctcgaagctcttgacggagaccgtcccatcatcgtcgtcgtcgttctcgtcctcggcggccgcgctgatctcgtcgccgcagaggtagagccggagagagctccatctcctcttgtgatcagcagagcccctctcctgcaaaccaaaaatcagaacaatcttcttcactcgattaatcaaactccattttctgttcagattgtttatgtcgcaggcaggcaaaagcatctgcaattgtgaagatccatgaaccgaggtgccacgacaaagtacagaatcgaaagtacattggcctcatcgccggttactgattggtgtaccgagagatcttcactttttctcgtactgaacctgaacccgaacccaacaccgactgcacagttgcactgcaccaccacaaacgtatgccctacacaaaaacagtggacgcaacaccaaaagagcacctacattgtggcaaccacggccgccaccgccggccgacgagcaggggctcttggagaagactcgccggacaatgccgccggcgaggcccatccccaccgtcgccggaacagaagaaaagcctctctcaactatctaggactaggaggcttcacatgtcagtgtagtagaacgacggcgatcttggttggcatcgccatgagccggcggtgctgagctagctgagctctcactccacagtgatggctggcgcgcgcaggcgaggctgcaatggctggcttccccttatagtagcaagggagaggccaacgaccgtgcagtggtggtggtggctaaaatccacaagaccaccagaaccagtttggcttgggttaaaataaaaagaaaggcggtgtgcgagatgcgctttggtgcaagtagt

SEQ ID NO: 67707 - DNA, 3403 bp, Oryza sativa
gacgcaccagcgccagcgccgcggcctcctgctcctcctcctcctcttcggctccgcctacaccggacgagagccacacgcagcaagctcagccgcagccgcagcagcctacagaagagtcatccaacactgaaccgaagcctctgctcttcgtagcagagcaggacggcattccagaacccgagctgaatcctcagctccagacagctgaacaacatggcagcgacggcaacacggccatgttccagccgtcggtgacgtccggcggcatttggggtccggccgacgaggcgtggttcagcgcttgggggccaggaagctccgtctgggactacgacatggacagcgcccacggcctcctcctccagtctcgcttggccggtgagcagaccggcatggactacgcctacaccgcgccggaagtcctcgtggcaccggtgccggcggcagggacagccatggccactgccgcttcctcctctcttcctcctcgtcctccccctccttgccacagtccaaccttcgcatggaaggactaaacagcatcacacgccactcttacacgcaggaacacctaggttgtgagatgcacacaggttgcaaatttttgagacagcttgtggcatcgcacagtatgatcagcgatcacatcgcaggaatatctcaactcctcgagggcattcccattcccgaccttcctctctgaccaatctcctcctgaaaaccacaaggaaaaacccggctgcattttttaggctgggataaggatggccaaatattacaagcgtcatccttatcgatctttccatgatttttcaaagatggattcttttagacatttgactagctagtgatcgtatcagtgtctgtcacctgcaggatttgtagttgaatgtagcatgtaagggtttaaggattcctgaaagaggcttggaaagaggagacgggttttatgctctcctctgttcttacttgatgcttgtgttttcttcatttcttgcacgtactatcatgtatttattcatgtgtgtcttcttgatttggaagagatgtgccatcggcaaggtacttatttgtactgtagtctctatggtcaataataatgaattgatagttgcatgtcttcctaaagtcttgtttttcgtcttcaagtcatcgttatgagttcatgaccacaaatatggacagacatgttaacattaatggcgcgagtgtctgatcggtggaattattatgtggattcgaaatttcgaactgtttgagaagaaattgggccagaaactcgtaatagcccaatggcccagatgggccgatctactaatagctgggccaggaaagcatttacaattgcagtagcaacctttgcaggcatccccttcgccttcgccggtcgccgccgtcaaagccaagaggcgtgcaatgtcgcggccgccgtcgccgatgctctccgtcccggagaagaagacggccgccaccgagctcttccgggaccgccacttcttcaactcggccttcttcaccgacctccgggaggcacgcgcttccctctccgctccgagctcccaggcgacgacccaggacgccgcctcccgccgcgcgctcctactccggtaccaccgcctcctcgcctccgcgcgcgacgacccctgcgacttcgacgacgacctcgccttcacctggcacgacgccttcaggccccacctcaggcgcaccgcggcgtccctccgcttcgagaaggccgccgtcgtgttcaacgtcggcgccgcctcgtcgaggatcgcggcggccgtcgaccgggcggcggtgggcggggtcaaggctgcgtgcggggagttccagcgcgccgcgggggcgttcagagcggcgggggagatgatggagggggaggaggaggacacggaggacacggtggatatgggccccgaggcctccgcgatgctggagcggctcatgctcgcgcaggcgcaggagtgctgcttcgagcgcgctctcgccgcggggacgtcgtcagcggcttgctccaaggtcgccaagcaggtgagattggatttgctcgctcatcttccctagtggcactgcattgatcagaaaaaaattcccctcccttgcctgttggctgttagggttctgactgggtgaagcaaattatgcaaagaaaatattgtaacaaaaaatccttttagatagacatactatgatctatgaggggtgctgtgaggatgcattttctagatttgctttttagaatacatccaaaccggatgtacgcagccaatttatatttgctatgtggcacgcaattgagactgtgagacattagctcataacctataaatttgtgccaactgccaattgcagtatcgaaaatagccccctttgcattccccttagaactatggcatgatttgcagttagttcgtgaaatattagctttagctataagtttataaagcctcctttgtgggaggctgggttggcgctatattagcttattgtaatactgtttgtgctgaattacagtgacagaaacttgcagtaaactatgcactatgtagcacccctaacttgcacaatgttcattttttactatcacatccattccaagaattctgttttgtgctaggaattcagtaaactgagctggctgagcattctttgtaatctaccttactgaatactgatacagtacaattctagctttagatcattatgtgaactatgagttaagtttgaagaacagatcagttaatgaatagacaacaggaggaaatatctgaagtaagttcacgagcagcttcccacaggcactagcatcaggacaactgttagtaacatgtcatcaccttgcatgtctcggtccatcatttgtcttaccatcctccatcatacatatgaaatctaataaattaactttttaactgggtcaaaagaactaattgaatcagaagatctaatactagctgcagattggtggatgtattcatttccttctatggaccatgaagtagtttctgaatgagaatgaagatcatgttagacttaagcctcaaacatcattctgtctgtgcttcccggttggcgtagataacctatgatgctcaaatcctgattgttaaaatacagatttacttccagaaccagtgaacacttgttgcaaggtggatgttttgttgtatattatgcctaaactgatatcacaccagcattttgtgaccaaaaaattactgtggcataattcttacactaagaaaataatgaattttgaactcgttccaactgctttaaaagtttgaccaatcatttcaaaaagaaatacaggacttaggctgcatttgtttggagaacatggggagattggttgtttcgttttccacgcgcacgcttcccaaactactaaacggtg

SEQ ID NO: 67708 - DNA, 6549 bp, Oryza sativa
  unsure (1)..(6549): unsure at all n locations
cctgcagccctgaccaaatttagtcataaccataaattcaatgctatgcatacttatgttaattgaaggttttgggaagatgtcagcttatctaaaacaaaaattcttttatttgcttaaccttttgggaactacccaaaatgtgatctttgaattagaagagaacactacttatgaaaatttcatgacgccatgtttgaaacttgctcatgggattttcatcgatttctaggaaatcaccaatgtgttcaaaagattgaatttatttggactgaatcaacaaggagaaaatgaatgcaaaatgaagttgatgcattggatacaaggtagcctaataaataaggaattaatcagaaaaatcttattctttttatgaatatataattctgtttcttatgcgattatgtttgaaggcataatgcagactgcaccaagtagcaactaaacatcaaataagacttacattaaggctttaaagaacgatgttgtaaggatcatattgcaatttgattgtgtgtgcgagtttctccagtaaatttgtttactgcagttaatttcaattttttgctcaatcttctgcaaaagtggaaatggcttcatgaaagtgcatctttgcatggcacaatgtcgagttgacaacttaaagtgatgcttctgccctatggctagatagactatagaaagggttcaaggattcaatgtggacggcatttccttttactctctgcagcattttgttgtaaaatttcttctgtttatgcatgatgactaatgctctgttcggttaaagctcaaattagacagaatcagcaagttgtgacttgtaagtttaacatctgcaagcattatactacacttcctttttagaaccctgaggtgccacactgtctcagttatgtgtttaacatctgaaaacattgtacttcacttttctcttttagagccctgaggtgtcacagtctcaattgtgaatttacatccgcaaacattgtttatagtagtagtgatcctgaggtgttattgtctggtgaactctgaggacttgtgtttgttgacgtactttagatgtttagcactgctattaccgaatgcaccgaaataaaatcaattggtattcgctattgatttgtgctgtgagtgatgcattttctgtattctacatttctggtatccatttcaggtttccttcagctataaatcaaagtctctgttttaccgtactccactatcgttcttgtgcctttcatgaggtttgctcccataatgcaagtggtatgcctgatgtaaatttggcatgaatttcgatgaaaccactcaaagctatggacagtgactccagtgagccatgattctgctttctttggtttgtctgatgagaaaagcacgcatccatttttctttttcgcattcatttacgtgttcccccttttactcctctttacatgttcagcctttgtggagctatacgtctgttcgctgacattctacctgccatttaaatgcgtccttcgattttgcatagtactccgtagcccggatcagaacggtcaacttggaagctccctgatgcctgagctagctttggattctcttactccatttgaatcccccaaaggcaccattggtcaatccatgtgtttcagtccatgtgagcgtggtccgagcgtacataaaaaacctatcctttcgtatgcgccggcagcgattcaagtcgtacgcatacgtgaaatcgtgaaccattgatgccacctggggtcatcaggccccagtaattgaatggctaaactgcaacagctgatgaaatccatcagccaatcaatttaccaatcaatggctgcgcctgatccgctttgctgcccactgctcctccattttcctctcacgccgtccacgtgaaaaaaaaagaaaaaaaccaatctggaaccttgtggtttggttcacttccctctctcggccgcgcgaatctggcggcgctgccgaagtgccgatccgatcaaaaaggaggggtttttgccacggatgccgcggtggcgttttttgggctttctggcgtggcgcaacggtcggcttctctccgggcgttcaaaagaagaggtattttaacgcaacggtcgaattctggtgcgacaggagggcaaagggaatcgcccgcgagcgtgcaaatcttgtgcgtctgcgtgtcgtaggcaggaagccgttgggtgaatctggatcgggctcgctcgcgtcggatgcccaacgcccatttgaatcgccgtgcagatacagtaagcctgtttgtgacaagtgacaacggggccccgcatggttgaaggcttgaagccgagcaaaaatgaacaacttttaccaccggacgcttcgaggctgcaagaaagggtgagaactgaatctcacagctcagcagcattttgcccacaaagaattactactagtacttcgtttcttttcttttccttaaaaaaaaacccgtccgcagctgatgtaccgggtgcacttattgatttatgcgtgcaatgcattagggcattcccaacccaataattaggatggtgtccatagcattaaataagctgccacatataataaaaaatgatgtgtcaagtaaataaatgaggaaagagaagaatagtagtggaatagtagtgagataagtagcattaaatttaaatatggaatagtagtgtttgtattggaagagtaatgtctagtactagtttcttgatgatgtggagtttatggaaactatgtctatgtctagtgtcttgggttgggaatgcccttactggtagtaagcaaatactgcgctgatctgctgtgctggcagccaggcagtactggtaaacgataatcaaagccagatactcctacattagtaccactatgccctatgccagttaaatcactgtccgttttgatgaattgagatggataatcagggccccagcctcagcttcctctccgtgagccgtggagccgttactcgtggaccatcactgccacggtctaaacacagcagatcagtcctcaaacgccaggtctacggtctcctcaacgttcgccccacccgtgcgcccgaatgcaatcagcgagagaagatttgaaatccccccctctcatcatctcatacatcagcagccatcagccacgcccatgcacgcagctcgcagccgctaacacaaaacacaacgcattccaacacataattaattccccctaatccgcttccccccaagcactgcataaataccacctcctcgcactccaactcaaccttcctcttcttcttcttcatcatcttcttccggtttcctctaccatgggtctctgctgcagcaagacgcagaaggagacgacgccaccgcacggtggtgcagaggccaccacctccccgcaggtgaagaggaagtccggcaagatcgccgcggacgacaagggcaagaagacgagggcgggcagggcggtggaggcggcgggagacaagaaggcggtgttcgtcgtgaagacgaagtccggggccgtgaatgtggaggagaggaggccggtggtggtggtgcccaccatgccggtgcggacgtcgagctgcaccaaggaggaggtggacgcgatcctcatccagtgcggccgcctcagccggagctcgtccgggagggcggcgtcgagcgagacgggggccggtcaccggaggtcgaagaggagctacgactttgatcaggagaggagacccgggtgtggtggtggtggggatgaggagcgcgattgggagaggcatggcggcgcggtgtccaggccgtcgcctcaccggggctcgccgcagcggaagcgctctggtagtcgggagaggagcagcggcggcggcagccgtagagcgagccgatcgcctgggcggcgtgccgaaggtgtgtcccctgcaccggctccggcaggttccggcggaggcggcggcggcggagagcgggtggtgagacagcagccggggaagatggtgtccgtcccggcgagggagaaggcgcgcgcgccgtcgcccgcggccgcgtccggcaagaggtgcgcgtctccgagatcaagctcgcctgcgaggatggtggctgcagggaatgagaatgctggaggcgggcagatgacggcggcgcagacgccttcgctgagccggagctcgtcgccgtacaggcgcagccccatggcggagatcgacgagaactccctccgcaacaacaatggtgccaatcaccacaaggtaaacaacctatacaaatttcgagttttttttatgccagctattgccgcaattccctcctcttatctcaaatccctcgcgtgaatccagaaaatttcggaaaacgcgctcgccatcgccgccgctccccagaaggccacggagcgttcaaaggagaagccgaaggtcgtggaggagacggtcctcgttgcggcggcgccgcccgcgtctaagacgacggcgacgcgcacggccagtgccacggccgagagcctcaacacgaaggcccggtctcgccgggcgtcgcgggacttcgaccagaacaccaactcgtacgccacccagctcctcgaggacatccagagctaccaccagcagcagaacaccacctccgtggccgccaccgccgcgacgctgcccagcttctcgctcccggcgtgcgtctccaaggcgtgctccatcctcgacgccgtggccgacctcaactcctcgtcgtcggacagccactcctgcgagcccgaccgctccgccaacgacaggggatcggtcaacgcgccgctcggcggcggcatggacgacctcgcggagccgggcgtgcacaagaggcacgccaccgccccacggggggacatccgcggcggcggcggcgagaccgagccgcaggagtccgccgggagcaacagcgtctccggcaacccgtggacgccgtcgtgggagcccaactcggtggagtccacggaccggacgtggagcgcgtcgcgctcgacgaacaacggcgacgaggtggtcgagcagggcagcagcagccacgccggcgcgcgcagcccgctgaaccgctcccggcagagcagcaagcagagggcggcgcagccggagcacagcgtccggtcgcgcgccggcagctctggtggtaacagcaacaacgtcgttcatcgtggacgcggtgctcatcgcagcggcggcggcggcggcggcagcgtggccagcggccggtcgggtgttcgggccgtctcggccatgtcatagaaggaaaaaattatccatgttactcatgtatgctgctgttaggttgtagaatttgtgatcactgctcagtgtcattcgtagtagattgggtttctagtggcaagatggattgctgcttcagtcacagatgtgtttgtggattgtggtccactgttttggtttagtgatacattgttcagatgtaggtcattgtgtgacattggcaatgtatactcttgtcgtcagtgtttaggctgcacacttgaatcttctggtgtattgatttcatattcatttccagtttatcggcaggttcttctgttctagctcagcatataatggattcattttccatttatgcaagattttatttttgttacaaagcacgttggtttataatctctatatactatcatttcaaaaacccaattccagattgatcattgtagtccgggttcagtaccacaattccagattactctctcaagtttctcctatcaaaactgcaattcttaggatcggagtaattttctcaatgaaatgaacatggaaacttagtacaagtcactgaacatatcatggttattcagtgttcatgaatttcttttggcagggaaaacaacataaaattgacgaaacactgaaaataacacaactagagctttcgtagctcagttggttacgnnnnnnnnnnnnnncacccgtttagtaagcgggaggtcctgagttcgactctcaacgaaagcattttgttttagtagtattgtttgaattcatttttttctcttcatcttccaaatgttctaattcaagggtttttgttcatatatactggtcagatgcgaggggaccttcatgtttcaaatgttctaattcaacctgttctcttcatttgggagacacttttgttgtgttggggcgacgctaatgggcgggtgatcgcggccagcgattacccccccatcccactatacgtcctctccccttcttctcttcctaatacaccataaattttaaaataataaaaaaacaaagttagaaaattttatgtataaaaatactatgtataaaaaatattcaaattcaaatttaaatttgaatcggatatataaactttttacttatgaactttgggtctataaactttatgtgtataaactttaggtgtatagaaatactatatataaaaaaattgaattcaaattcaaattcaaacttgaatcgggtatataaacttttgacttataaactttgggtctataaactttaggtgtataaactttagatgtatagaaataatatatataaaaaatatttgaattcaaatttaa

SEQ ID NO: 67709 - DNA, 1152 bp, Oryza sativa
ctgcagcccaaagcaacaaaggaaaacagttgcttaagtacgagggctgttataacctgaagcttagcatcttccatgttattcccactccgttgcctagaatttgcccacaaacttctacctgaaagccaaagttagcgacacaattatgatgctgcaggtcccacaacaatactgctaatacatcgttgtgcaccatacacatatactgagaaaaaggcatgatcctagacattctccccagcattataacaacttgtttaagtaaaataatgaggaaatagttgctaactgacctcagcataagcttctttgcctactgaactatcaggagatgtccgagcttgaaaaactaagttatatccctcagctgtgcactgcaacacattttcaactatgttattaattgaaaaagagctgtgtcaaacaaccaacaatctaagatacttacaagttccttgagagcagcaatagaacctcctgcttttctggaattgttctcccccatcttcacaaagcgagtttcttctgaagtacttgcaattggtaacacatcgtccctactatttccagggtatccaaaaatgtttgtattgctaccaaaaccattttctttcatatcagtcatcttatttggatcagatgacagatatttatctgcaagtattgttggcatggcaaatcaatacaaaatattgtataaaacaagaagttccaaaaagacgcaaaacaataaaagagttacaatgttttgcttttttcaacctatcaattacagaaatatagcttcatccagatgttttcatcccagaaaccaaaaggaaaactgacaacatgcaagcaggcaaatttgaatgccatgaaaattccagcattctacacagtaagcttcatgaatctactcgaacctccgtatattgtcaacaggctctgatttatgataacctgattaagtattcttcaatgaaacatatgtaaacagaataatccagcactattaagtggcaatagctgaaatgcgctatgtgcccaaattttgaaaaaacacaccctatgcccccagtaaacatgtcaatcttttatttaaaacgaatgtcttggttgcgacaagattgatggcacaaaacattatgttatatgtgcagtaaggaa

SEQ ID NO: 67710 - DNA, 2588 bp, Oryza sativa
gtgtatgataaggttgaaggaaaggggcttccggttttcttcatggcgcacagggattcgatggatttccttataccttatctttgtttacatgtactctccttgttgatctttgtttccatgtactctccttgttgttttctgcactgttcttgcactgttcatgatggtgaaccctctctgtctgtagttgattgttacgagtatatggtagcgatcagaccgtctcttcttctagtgtaaagaaaagagtaaaattcgtattattctgaatttaatcagactaggtgagttggtactttagtttggttctggcccttcatgctgattgcttgattgtgtcggctgctgctacaacttgcacaatttatattatcatgctgttctgaaccagtttgccaacttgtcccatgcatgagagatgagatgagccacaactatttgttaattttgtttcaggtacaactgttgtttggtgcttgtccagctaggacagccgagtgaagtgccagcatgggtggcatccttggacgccatgacaccatgaagaggagctctcacggctcgaagctcgagacgaagatggtggagtccatgcagcagagagcgtcgcacgggacttcactcaagtcgttcgatagcatcatcatgaagtttccgaaaatcgatgagagcttgaggaaatgcaagatcatcttcgagcaattcggtgagattcgtcatgctgtctgcatgccaatcattgtctaattacctgattatctcctacttttggatctcactgctagtgagattcagtagagatcttctatacaatggtgaaatagtttgaaaggaaaacatagggactgtcggaccgatatattctattttcctgtacacaatgaaatccttaccagaaataaatatgtagtgttgttgttgttgtttcataaggttcttgtcatggactgttgaatttcaataatgatacattatcagcatgagttgtattatataaatggttatgtcgtctttcaaatatttactgatttgtgcaaacaaacagcttctcactcatatatcaaaaacaaccttttttgctcctcagatgaagattccaatggcgaaatagataaacaagaattgaagcattgtttccaaaagttggaaatttcattcacagaggagagataaatgacctctttgaagcttgtgatataaatgaagacatgggcatgaagttcaatgagttcatcgtctttctgtgcctcatttatctgctcaacgaaccagctgtgtcagaagcagtatccttttcttaataagcattgctgcagagcaatgttgggttagcatataggttaggtattgcaaaaatgatacattactatttactgttctattttcttcaatctttcattacgatgtaaatctgattggagtaatgtttattagatggataggatacttagtaactttctgtacctgtatcctattttagatctgtcttaactcatttctgccaggagcttctctgtttccttgacataatgcacagaagattaagatgggattaggaaatcttgaggcaacttttgagaccttggttgatgcatttgtttttttggataagaacaaagatggatatgtcagtaaggaagagatggttcaatcaatgaatgagactgcaacaggggaacgctcttctgggcgtatagccatgaaaagatttggtaagtcgcttgttctccagctctctggtctctgagtttagggcgaaaacaattagttgtatgcccttagatgtacatgttatgaataaattatatttttgtcccacgttttttatttctctatagtaatctaaaaatttctagattgacaattcccatcagtttcagaattaagtcctaacatgtaacactttctttttttgcatggcaccagaggaaatggactgggacaagaatggaatggtgaccttcaaagaatttctgtttgcattcactcgctgggttgggattgacgaaaatgaggacgacaatgaatgaatttcgtgaagataagttgttcaattattaggacctggccagcctaaggaggttataaagtttggtggtaatgacaactggagcatatgatgttgattagttgatcgttgatattgtgtattatcttataggatgattcaacatgatcctagtagaatatcttaacatgcctgaagactccatgtatgcttacaaatttaaagagttccatgacagatagatctgaacttgtacagtaattctaatggttgtacttaccaatatcctggacttgatgtggagaaatgctataattcagttgcatgctcaacgaaaataagatcatatctttatgttcttctcaccttactacatttccagacctacatgaactgtaaagtgatgtgcacactgcacatctctgattgaataagtataagctacaaacatgcactgaacagtagataacaactaacagtcatggctgggtttacagcattacagcctcactaagatcaacagctctactgaagagataactagcaagtcctctaaacatcactgccctgcccctac

SEQ ID NO: 67711 - DNA, 10818 bp, Oryza sativa
attcctgcagccactttaggtgtatagatttactaaaagaggaaaagaaaaaaaaacccgatcgctggccgcgattgatcgcgcgttagccttctcgaagatcatgcgtgttatggtatagaatccgaagatacaaaacattagtactccattcgttttaggttataatgcgttttgaatttggtcaaaatcaaactgttttaagtttaaccaaatttgtagaaaaatgtactaacattttcaacccaagacaaatttattatgaaaatatattcaaatattgatttgttaaaactaatttagtattataagtatgattatatttgtctataaacttagttaaatttgaaatagtttgactttgaccaaagtcaaaatatcttataacctgaaatggaggaagtagtattactcattatctaaatattgtattgggtgagtctaatttgagctagttctcagttaaagaatgatgtttttttctactagttcatagcaaataaacccttcactcaatcttaagttgagaaatagcttaagaacgagttgaacttggctgatatggctggttgcaaatccatatcggatgaaatgggctgaatgagctactaacacacgcggagggcgcaatttttgacaagcgatgttgaggtgggtgggtttttttaaaaacaaaataggttatgggcataatcttaaaataaggataataattatggtggtttatacaatttttcgttgtttttattctatccatgctcatccatctaatcaaataagaaactggattatactgtccattcaaccaaacaaaaaattaaccaccataccttatccctaaaaatataaatagctatagcccatccattcttgactacaaatcaaatacatcttaagtctatttaataaaaaaataaataataattatataattttttatcaaattgtatggcaaagatgtcatatattgcatacttttttttaataaggaaagggtcaaattcattacttgtgtgcttcagttcacataatagatacaatgactttcaatatcacttagaagcccaactaaaataagagaaaatttcgtatatatccctgaaactttgtctaattccttctatgtcactgaattttgctaattcccttgtatacatttgaattttaatttagatccttccataccatttccaatagttgaccaattcttatgaaaaaaaatccattgtaccttatggtatgaaaaatatataaatttttggagtatagaaatttgttgtatgagacttttatatccatgagtttctaatgtgaaatattatttataaaaaaattattttcagatatgacataaaagatttatatttatttttaatatttaaaattgtatatgtagcttattttctatagtagtacaacatatttgaatctatttatacgctacagtaaaataatttgataacaaataaattaatattattttttatgtcatatctgtaaataaattttatgataaataatatctcgcacaacaaactcacatatataagagtcttatataacaaatttttaccctccaacaatatattctataattttatatgtttgagttacaccaaaggacaaaatggtttttttatagaaatttaacggtcaactaacgaaaaaaatatgataaaaaatctaaactaaaactagagaatgagtaaaattcatggatacaagggtacaaggagaattttctcaaaataaaacatggtgctgaaatgctgaatgacaagcgttaattagtacgatgattcttcaattaattacacagctctagtgtgtaaaaggaactacgaaacgaaaaactattgtgtcagaactcagaagttaagttgtaatcgctatcatccaatcaataggtaatagagacagaatccctactccagttgtcatcactgtatcagaaacgaacgtgcagccgtatcatcatccaaccaacagctgaagcctaaacacacaaccgaaccaaaatttcactcacaccagagacaaagatttaacaaatttgctcaactaccgatcgaatgagtctgcagtacagtaatattcttcaacttggatcattgacatatagatctgttggttataagctcatatatcaacagcttaaaactagaggattagtattgtaaaggacgtgtttccctaccgaacactgccatccagcagaccaatttgcaacgatccaggaacgaaatgagccaccaatcaaagcttagtaattcggctgtaaaccggcctgtccctcctgtgcacagcaagtgcttggagcacgaccagcttgcgcaatgctcgtttacctgagaaacgctcaggagtttttcggctaactccaaaaggtagtgggctagatgatttggattcgaaatctcaccccttctaattatttgatattagattcttccctaatatttacgttcttttttcaatgctcgtttacctcggtgagacgcccgtgccatcgccgcaaatcggtgagacgtccgtgccaccgcctcgccatcgctgcaatcgcgctggaccaaccatcgtctagcaccaactaggcaactaccaactgatagtattatggacgtcttaatattgtcttcccgggctggatcacaaacatctctgatctctctgcagaaacacaatcgtcgctcgaatctgcttctcattctttttttcttgctgatcatcatgggcgctgctgctgctgctggcttcttcttcgtcctgctgttcctctctgttcaaggtggtgctgttggctacacgagaagcgattttcctcgggatttcgtctttggagccgccacctcggcatatcaggtgacgaactgaagatttgtctgaaccgaatttcccttacccggttttctgaacagtgcgtgcctttgttgtgcgtgtgcagtatgacggcgctgctgcagaggatggcaggagccctactatctgggacacgttcgcacatgaaggtcagtttttttttttgggttgctgttgtgcaacttgtgctattcatcatctgttcatgctcatagtcatatactccatccattccataaaaaataatcctagtatgaaatgtgatacattataatattatttatctgaatttagatttttaaagagtgtaaatttgatcttcgtttagataaaaattgagaatttaccttcttgacccatacgtggttgaccttcgatggccacatgtcattggtgacagatagagccagtggtactaataagtgaatagtgacaatatttttattggcaaaatttgctacaggacaccgaaagattgcggcctttgctgtgagacacccgaagatcgtgtatttgctcatggacactacaaaaaagtggtaactagctgcaggacacttctcccattattttattatttctggtcaaaacggagagagagagctgtgtaagtaccaaaatgccctggacacgtactgttcttcctctctctctcttcttttcttttcccattcttcctcgcgacggcagcggaggggaaccgatcgacggcgagcggcggcgggcgcggatgggagggcgctccaggcggcggcgggagcggcacggagggggcgcggcggacaggaagcttcagatggtggcgacagcgggccggcggtcggcgtgcacgacggcgcgcggggaggtggaggggatgggggagaggcgggcgccggcgaccatggcggagaggtcggccgtcgtggcgccggccgctgcctccgtcgccgcccgctcggtccgtatcctcctcagccaccacgagctctgcctcagccgaccgccgccaggcgagctccgcttccatgcgaccaggccgttcccaacgctacccaccatcgtcgtcactgcgggaatctctcggaggatcagagctcgcccgggcggctgactcctcgcgcattcccctttctcgctgtcgcgaccgccatcccccgccccagcggcagagagcttgctccgcctggaccaccgccgccgcggcctcacgctgtcgtcctcaaggtgctgccggccggcgccacgacggcccgcctctccgcgatgcacgccggcgcccacctctcccccatcccttccacctccctgcgcgtcgaccgccggcccgcccccgtgcgccgctgcccatcacatcccctcacgatgaagaagaacagacaaagagaggaagaagaaggacaaagaaagagattgacaagtgggcccatgggcaaacttgtctttaaccaaagtttctctctccattttgatcggaaataataaaataatggaagaagtgtccagcagttaattaccactttttttagtgtccatgagcaaatacacgatcttcgggtatctcatagcaaagaccgcaatctttcggtgtcctgtagcaaattttgccatttttgtttgtgcaatcagggaaaacgaaagacaaaggtacaggcgatgttgctgcagatgggtaccacaagtacaaggtacacggttaaatttctcagagagaaactagcagcacgtcatatttgcaaataaaaaataatttgttaataaaaattttatatacgtgttcttaacgatttaaaagcaaagattaaaaaataaactacgataaaaaaaacccaaatcaacttatttttcgccaacgcaaaaacaactccaaatttagggcccatttgaatcataagaatgcaaaaatagatgaataggaaaaatgcatgattctaataggaatgtaagtgcaaaacagataattacaaaatacagaaaaaacacaggaaggaccatttgattggaccgcaagaaaaacgtaggaattggatgagagagatagactcaaagataaattttcaaaaggttggagctcttactaaattttctctaaaatctctataggattatccgttccataggaatttcaaacgataacataaaattcaatcatttgtttcaaaggtctttatagaaaattttactatagaatcgaaatcctccaaaattttccccgcaaaaaaaaaagaaatcctccaaaattcccatgtctttcctctaaatcaaaggagcctttaaggttgaaaattttaaaatttagctgataagcataagtataaacaaaaagatgaggccatcaggccgctattggcttgtccacatattgtctctctatgtgtttcatgtcttacagacatgtgaacgcgcctcactattgtagcaaattcatgtatcttcaaagttctattcctgacaaccgactaaagatagaaacatggttccttaagttccatccctaatgcttcaccaaatcgaaatgagaattatcatcttagttttttctcctttccttcatcaaaacataaggcctaatttagttcccaaaaatttttctcaaaaacatcacatcaaatccttgaacaccctaatggagctttaaatatagataaaaaactaattgcacagttcacacgaaaattgtgagatgaatcttttgagcctaatctatgattagtcataagtattacggtaacccacatatgctaatgacggattaattaggtttaataaattcgtctcgcggtttccaggcgagctatgaaattagttttttcattcgtgtccaaaaaccccttctgacttctagtcaaacatccgatgtgacacccaaaaattttcttttcgtgaactaaacaatgcctaagttgaaaacttcggcttgtaagaactttacatgccttcctttttcagggtgatgtcaagctcatggctgaaactggcctagaggcttacaagttttccatctcctggtcaaggcttatcccaagtatagctatttctactcaaaactaaattcttgttaataaagttactactagtgtaatatgtatacttaatatgcagatgggaggggagctgtcaaccaagaagggctaaagtactacaataatgttattgatgagctagcaaaacgaggtaaatcttgcgaatcccttttacaaactataaatattgcaaagcgaaaaagaactgaaagaactttcatggatgttgattgctctgctttcttcaggaattcaaccccatatcatgctttgccatctagatctcccacaagctctggaagacgagtacgatggatggctaagccctagaattgtgtaagattcaataaccatctatatgaagtacaaaaatagtaggagtatggtgatagcttccataggatgagctctagactgctgatcagtagcaatggcacaatgcagggatgatttcactgcttatgcagatgtgtgcttcagggagtttggggacagggttttgcattggactactttggctgaacctaatatcgctgcacttggaggttacgacacaggagtattatctccaggacattgctctgatccttttggattgaccgaatgtacagtggggaactccaccgtggaaccatatataacagctcataatatgatactaacacatgcggctgttgttagactgtacagagaaaaatatcaagtgagtaatcatgtgcttaagaataccagtagtgtattttttgaatgtatttatattctctagggacagtactaagcattgcataggtctgatagaagttaaacagattatgttcaaagatgtagtgtatgattttttttttacaaaaataactacatgcatgtccagattcccttcttattttcttgctgttactcctcttatgtgaattcctcgaagtgctctgaaactgtctttcatgtaggctctacaaaaggggattgttggtataaacatgttttccttatggagttatccattaacaaactccattgcggatttgcaagcagctcaaagatacaaggatttctcgtacggatggtatgatcaatgttgcaactcttttatcttcacactgaaactagcggactgcacaattttgcacaaagctagattttatagaagtttacgactcttgcttccattttcatatataaatgcctgtatttttatacaattgtattgataaagcaacactattataatataaacccaccaaaatcaatcggtgcacatctttctctttttttcccagttaacgtagcaatttttagaaatgaacctagtggttccttttagctccctctttgtaatggataatagatatttgacatagacaggaatatatataagctcaccgttgaacttacgctgtgttcttatcccaggtttcacaacttatctccctcgttttccgtgcgcatgattttcaaactgttaaacggtgcgttttttaaaaaaaaaattttctatacgaaagttgcttaaaaaatcatattgatctatttttgaaaaaagaatagctaatacttaattaatcacgcgctaatgaattgttccgttttccgtgcgcactgttctggttgggaacaggctccagcgaacacagcattagaggataaacaactcttcttgtttgcaggatactgcacccattggtatttggagattacccacaagtaatgaagaaaactatcgattctcgtcttccatccttcagccaagtccaaactgaactaatcaagggtgctatagatttcattggaataaaccactactattcagcctacgtgaactatcgccctttggtagaaggtgttcgagactacgttgctgatcgatcagtaagcgctagaggttagccaattttctgattttctgttaatatgaacataattttttagctcttttttagataatagaagcttgttcctcgaaaaaaaagataatagaagctttattcataaatttgtagctctaggagtgagtagtttgattcattcatataaggacggtgtatgaagacgtatgtagacaaaaagaaaatcacagaaaatgataatgcatgacatatttctatgacaagaataaaaatacattttcatatcccgagttacttcctccgtttcacaatgcaagtcattctagcatttcccacattcatattaatggtaatgaatctagctagatatatatgtttagattcattaacatcaatatgaatgtagaaaatgttagaatgacttacattgtgaaacggagggagtactttactaagtcatccaatgatgatcctgaaaatgattctacaaattttcagatgggtagttttaccatcattgagaagatacgtgaggtaccatattttttaagtataaaatttggtatcttcatgtactaagtatatctcgaggtaacaaaaattttagtacaaatttaggtatcttaagttactttcttaatgatgataaaattttctttttcataatcacttttactagagtaaaagtattctgtagcttatcagttctatatgtttatgttatgcagtttataaaacggatccaccaacggagaaggtaagttaattttgtcatctctgatttttcttttgagataataagcattgttgattttcgacctttgtaaaaacttcctaaaaatgtgataggatcttagcctagcttagttggtcgatggtgtggatgtatgcctggatcacccaagttatcccgtccttatcgaagcgaatttggatgcctattttcttcttaatacaaagccacctaattctcatagggttatcccatttcttatattaaaaactgaattgtgatagacacgtaatgttttgcattaagtgatgcaatcaataaagcgtataaaagaaataaagtaaactcgaagatcattgtcataatttttttttggtgcggcgataatttcataattgaaatactcttggatatacgtacctcatcctgttggcagtgacacatatatctcatctctttattgagtgcagtatgaacctacggagtatccaaatgatccaaaaggattgcaactagcgttggagtacctgagagagtcctatggggatttcccattttacatcgaggagaatggtaagtacagtttccaagtagagtattcagaacaggaagtacaatatgttggaaatttggtcataattcggcatattttaatccaaaataataagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaaatgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggttt

SEQ ID NO: 67712 - DNA, 21466 bp, Oryza sativa
gaattcctgcagccccatttagtacttgaaaatattgtctgaagttgttataatttgaaattcaaattcaaattatagaaacaaagtcatatagcaaaatgatcaaaacaaaagttgtagatattgatgagttatacaactttgttgttgatgactttttcatttgaaatcatttagtatttaaaaatgttgtttgaacttggggaggaattatggactatttggatgggcctttttaacttcggaaattccgacaaactttctggaatttttccgaccgattccgagttccgacggaaactgatattatcatattcgattccgtttccgaaaaaatatttccgttttcgattccgtttccgcgaaattccgaaaaaattccgaccggctgattccgttttcgaaaacaggtccggaatccggaaaaattccgaaccgttttcacccctacttttgtagggatgataagtcggtgcacaggctagctcatacatggattggcatctgcacggccagccagttgcttccatcgataagccaaatttccatttagcaaatatcatgattatgataattccattttattgtgatatgatgattcaagcttccattctatggtgatacggagagtagtatttccatgtacttgttgctatatctgtttcttttccattcgaatcatctaggaaatattattatgtgattaccttgccatttcatgatgacactgtggcaacacgcttccattcagatgagatacaattcacaattatttccattaacgggctagctgtaggattgatcgatcatctagagctaatcttccattttataaaagataatcaatgatcccttccatatatttatacaagcttttatatttggaatatggcatttgtgaggggtatgcgtacatgatgtacatcacgtacaccggctgggctggagcataggcaaccagtactatacaagtgtcatataatattcagacgtgcatacaggtgcatgtgcccatgtagtcaaggttgcaccattagtgataattaatcatcaattttattactaccatcgtttctgggatcaatattttaacacacctcatttctttttttattaaaaaaaatgtacaaaatatcatcacacagccacgtaggataaaaccactctggattaggtcgaggggggtaattcatatggtttgcatagttgggggtgaagaatgtccggttctatggtttagggggtaattcggtcgaccgcgatagttcgagggggtaattcgtactttttcctatatttttgcgcgtgtcgaagttggtcaacaccacatggcattccaagtgtggatcatctttgttgtgtgttgacaaaatttgtcttattataagaagatggtaataatcgtctaagaatagaccttatttgaaaaaacaaactacacagtacaagtaattatatattccctaggtttccatccattgaaattcgatgtttcatattcaagaagcgaatgttttcaatagaatatgactctattgcacattttaagttttgattttatgattttctctatttcaattattagggctcaatgtttcatcaaccaatattaactatggcactcgttgaatcatcggatgtataggtccttcgagatttttcttgttcatgttgcatatcattctcccgttctcccctccatgtcttgtataagtgaagtagaattggagatgagctgcttgcaaaagtttggctataaccatatgaatatctcaggtagttggattagccatgatcgaacgacacctgatcgagagaggtcggcagataattcactattattgcccgctcattaattccctcctgcgcccagctagtccccttaagttatctgtgctaccgaggctggctagaaaaacagtattttgaaagaagataattcactccggccggcttaataacaatattttagccttttagggtttgtctttcagcatgtctatggagttaacattttctagctaggctcttttctgtttttttcatctctttgtcgatgtctctcgctttcatggttatcattgaagactacgaaagacatgtctatcgggttgtcaatgattcaatcggtggcgttttgggtaactaatttgtacccatgtattcatgagagattgatatataggcaacactagccaacaattacctatctcaggggtctgaaccttattaaaaatgggagtacctatacatctttcgaaagatttttataatcgtatcacacagatttttaatctttgtattaaaatccgatagatataataaaaagcaaaaagcaattaagaaacaccataatgaacattaaattatcatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgattaaaaatccatctcacttcatgtggctacacacacctttatttacatcctcgtatcctgatccttacgtcctcaaaataaatcgtatatgtacggttcctgtggtagggatgtaacccatccatacatatagttttgcacgtactgaagttggtcaacaccacatggcattccaagtgtggatcatctttgtttacgccacgttcttttctaattaagatttagtttttagctcggttttaattagcacacttatcaaactattaaataatacatttcgtatgaaaacttaatttctatataaaacttattttaaaatatcaaacatattcatttattcagtttgtaatattaaaacttaattaatgatgtattaatattttttattacatacgccaacttaatctttattttcatcagtttcaaacacgttgacaaaaattatcttagtataaaaacatagtgacaatcatttaagaatcaaccttatttgaaaaaaagtaacaaacatagtgcaagtaattaatatatccctattttcccgtctgttgaaattcgatgtagaacatgactctatttctcattttaagttttgattttatgatttttttttatgtttcaatcagtagggctcaatgttttatgtaataattgttggtgttgcaaccaatattagctaggtaattgtcagggttatggataccatatacctagtagtagttgactaaatctcggcaggacccaccacataccatgtcttatacgaaaacaaccttcggatatagaaggagttccgcataaggaaggatgactagagttctacatggaaacgacaaggactactcggattgtatccatattggtttccctagttctagttggacaaggggatacctatgggtataaatacaaggcccctaggaggagaggggacacggaacaatagaagatcaatgtacaagccaacatacgccaagacaagataccagatatcgacttcagagataggcatggctagtcccctacggtgcctacggataccgtcaggagagatataacgctatctctgatctcgccggatgcggattcgaggaagaaggctactctgttgtcgagtaggagtcagaccttcagaccgccatgtcgacaacagttagataggctaccccaaatattaattgtacttgtgtgatccagatgaataaaaagcaacaccggtttcggccaacaggatgtagagttattacctaacaattcaggggcccgaacctgtataaaaatcctcgtctctgtctcttttactacaatcttgcatatattatagtaccaacgatcctcatactatgcaaataccggaatcgcgacatcaaacgtcaacagtaataccccgcgctttgctgcggattaatggatgagtatatgttaaatattattgaaatgatgaaagtttaaataatgaaaaaataatgtgaggaagataatttaacacatacttgtcgatctctataatataatattatagataacatgcctcttgtagaaactgatagtcgttatgatactcgttataatcctgcaataacgagtatcataaatttttttaaaaaacataccgtttagcagtttgaaaagcgtgcgcgcagaaaatgagatagttgagttggaaaaacttgaggaagaacacatatctttgctgtcgaggttgccttaaaaaaatattttgaaaagaagataattcactatggccagcttaacactgttctttaagattcagattttactttggttctgttagcacgtttttcaaataagtaaacggtgtgttctgttcgaaaactttgtacatataaatttctttaaatatcaaatataacaatttcctttaagtttgtaataataaaaacataattaattatgtgctaatagctttctaattttacgtgttcaacttaatatccacctttatcagtttcaaaaaccagtaaatgtgagaaaaaaaagaagagttacgggcacatcggattaaattactttagttgaagaaaaagggaaggactaaactgcaaaaataaccccatcttctcgaatctactccgtagcaaactgccaactgcgtacactaatgttacctttataaatagcatcctgcaattcctggaattaacaacgaaaccctccaaacatttcgcctccgccccctcgaatcatcggaattagcaatttagcccttgccgctctacccgcttcgatgtcgcccgcgtccggccccgcacaagccaatgtacatgggcagcacgagccccatctcgcccaggaggactccatctccagcgccgcccccacctcgatcgccgcgccgcccgaggccgccgccgatgtctccccgcctccctcgtccgtcgggagccgcctcccccagcagcccggagacggaggaggccgcggggccgacggatggagccccgccgctgcggcggtcggccagaaggggaagaagaaggagaaggtatcgggagcctctgatgatcgggagcaagtgatggttggctggctccgatctttccgtttttcgccgtcatggcgttcttgtttgtcaccttggaggttttcttgggggggttttggtggggtttgttcttgagcatttcttggtttccctgaaggcggagagggacgaggagaggaaatctgatttcctcaggaggaggagcgttcgtgttgcgtatcatggccacgccaaggaggaggtgaggagaaagttttgcttgtcattcttgactggtctggccggggctgggcattcttgtgtcatcttctgtgttggggaattttggatttggatcatctccttcttgtgaaaattcttgggatcatattgcatcatcgatttcataggttcaatcctgtcacttagatgctgttcttgtgtaggaatgtggaacttaggatctttttgctttcttgatttctatttacccacctgtttcattcagttgtgcttcagcgaagaaatattggttggttggaatgatgtggcaactaggcaattgttaggggggcaattcggctatgttctgtggaactttgattcagggaactgctttcttgttttctgtcaaaattattttagacttatttgctcctgcttttgttattctgattttgctgtttaatgtggttcattttaatcaaactgtaaaaatgtggggaatttattgggtgatgttcgattggttcatctagacgtactttgatacaggaacggctttctagttttctgtcaaaattgcttgacactttcgttaatctgatttttgctgtttaatgtggttcattttaatcaaactgtaaaaatgtggggaatttaatgtggtgattttgctttcattgtaactgaatcatccagatgtacttggggattgggattgcatcactggcgccatcgcatgttttggaatcttggagttttgggagcttgttcttgagcgtttcttggtttctctgagtaggtcatgtccaagaagctaccttgggatgatcccagacttcggaaggagcaggtgacgcccgtttccacaataaacaagtcacaccggaccagcgctcttggctgtatcaacaaagaggtaagcagaagtttatttgccattcttggctggctgagcattcttgcgccaaaatttgttctcaggatgctgttcttgtgagaaaccatggaaaatcttgcatccctgcttaggtgccaatttgcgtgttggaaatgttgaactgcgatattagctttcgtgttcctatttgttcctgtgaaatcttcgatgatttagtgtaattgagcacagatatcttagttcaaattatgctgcactctaatgttgagtcgaaatcattagtcatgttagggataattcgactttctgtttctacagtaaatgcttccacaatacccataagtgtgcctttttttgtgtttacttcttgccaatctaactacaaggctgtcaccaatacttgtaggaaatagatggacttcttgttgtagaaagacccaggtttggaccaccgtatgtggcatgtaatgaattcacacttatgtggtcactgaaaaatgatgtaagtaactattatataaatatttcatttaggtttaatttgggtgtcttaccgacaatttatcttgaataaaatgtacaggaaatttggtaccccttatttgctgaaatccttggagacgctgaccaatcaattgaatcggtaaagaaatatggcttcaactaattgctcttggttttataatgtccttatctttggttatgtgcatttgattttagaggaaggtgtgggatgatattaggcttgtgcgcaagttgaggcccctgcagaattcagagaaaatatcatcccgaacccattacaagatgatcctagttgcagctcataagcatggtcgaaagccaaatcttatctgctctagtttgttcactgaggatcgaaaggccaagggcaagctggaaggtttcgagatcccgcaaaaccttgtttgccccttgtgcggcaatgttatggttgaccctgttatgattgcaacaggaaaggtaattaatgggcttttccccctctttgttccttttctatttgcaatttttgtggatagagtgaatgaatggcatgtgtatgtaatatttgtagactatggaccgtcactgcgtacgggcttggtttgataagcatggacacatctgcccagtaacgtgccagccagtctcttctaccgtgctccgaaatgagcggattagaggatacgtggaagaatggcatgaagctgaactagaggttgaggaagatgctagggtatcatttacaagaccttaggctgatcacccaagtagtttgagaagtaactgtatcatactgtgaagtgcttaggctgatcacccaagtagtttgagaagtaactgtatcatactgtgaagtgatggtatttcgcttagtgaagcaaactgtaacatggagtagtgtattttgtgcttgctgattttctgtataaaatctgatctacttgcttattctggcagttgatgagttgctttatctttctttgagaaatgtacatgaatataataataataaaatgatggattgagccatcccttttcgatcaagctaagtaattcctcaagtatactataatccagaaacaatatgctaaataagtagcacgaatgagattcatatacataacatcctacgaaaaggtgcggacttgtttgcctgtctcaagaaggttcaacacatctcttagcgtattaaggactctttgaaacgcataatagaaaaaagatacaggaattaagtggcacgtttttctaatccttaaaaaaaatataggaaagataaaaggagcccttcgatagcatcacaggaaacaaacaaagtcaaggggttagacttcttgcttattttcttactctctattcatgtaaacattcattttgttccggtcacaaattcccacatatcctcactacatcaggtcatcacatatgtttttttagataatggattttcaataatctggcctctatatccacgaaggatatacacagccaaaaaatacacgagtacttcgactcatatctcaacaaggaggagaacacataaccaaaaaaagaaaagaaaaccaaacaacctcggcacatccatgcttctctacgtcaccccatattctcccgaaacggctagatttggcgagtggaagtcgtctagtcgtcgccgcccctagtgcgccgtcgatgcaaacctccattggtgccatctttatccattttaggtaagctgacgtcacgcgccaccagttagcccattttcaaccatcgtcattcgttgtttagccggaactagccaaccatacacgaaccgacaagatcggcccccagcgccaacgggagccgccgccgtcctccgtcgcagcccctagggccgctggcgccgacgggagtcgccgccggccgctggcgtcgacgggagccgccgccgtcttgaaccaccgcagcctctagggccgttggcaccggcaggagccgccaccatcctaggcctctagcgctgcctggagcccctgccgtcctgggtggccggcgccgccgggagcccccgccgtcttgggcagccgccgcccctagggccaccgccaccactggggcaccgccgagcaccgccgcccccgagggcctccctcgccgacgtcttgccgctcccctccgcccttccgaccacctccagccgtccccaactcacacggctaggcacgggcccggctgcctcaggccgccaccgccgcacctccgcctcccacctccccaccaccgccgtcctagccgccgcacaaacgccggtcagctctggcagcggcagggctagatctggggcgctggggagaggaagagacgcgttactgcacagccctccaggtttaggtgggtcatcacatatgtgacagcccatcgataacgagtcgaagtttttcatcatggataacctcatctctaacgggctaagtttcagatgagacttaagggacatggcccatcacaggtaacgacttatctatcaaaatctgagtacatcggcaatgagatttctgagtattttaaagagtatattatggttacactttttggttcaaaatcttactatgggtgtgtttagttctttgggtgtaaagtttttaaagtatacggacacacatttgaagtattaaatgcagactaataacaaaacaaattacagattccacatgtaaactgcgagacgaatttattaagcctaattaatccatctttagccaatgtttactgtagcaacacattgtcaaatcatggtataattagactcaaaagattcgtctcgcaatttaaatgcaaactgtgcaattgattttgtccacatttaatgctccatgcatgtgtccaacatttgatatgatatttttggctaaaattttttgaatctaagcaaagcctatattatctaattaagttcaatttgttcctatgaactaataatagattgtactactttctgaccaggccattcgagggaaaagaaagaaggtgaaaaaggtagcatcagaatcaacgtcactttattagcctttttctgtcgtaacgcatggtttggttcctaatttggtggaagggggattactcaccttcaatacgctgatgacaccatcttatttgtgaaggctggggatcacaatgtgttagtgcttaaattccttctattctgctttgaataaatgtcggggatgaaaattaattatcagaagagtgaaatgtatggttttggtatgaataaaggggaagagctgaaatttgctgatatgttgaattgtaaagtgcacaagcttcctgtcacttacctaggtctgcctatgcatgcaggaaaacttggtttgagggattttgcttgtcactcagaaagtggaaaaaaaggttacaatcttggaaaagtggttatctcacctatgggggaagggggattaagatcaactcttacttgtctagtataccaatgtataccatgtgtttctactggttacctaagggttttcatcacaaaatgggaactgctaggagcaatttttactggcaaggcctgagtgaaaaaaacaagtatcatatgatcaatgatgtggactagggttcccgatcatccaaaaggttctaataaccaacgatttgggcggagtcgcgatacaaatcgatccggcttcttgaacgaacacgctcttgagccccgcaatcgcagcaccacgtctcctctggttatcacccgtgtcgaaacacggatgacctcgccgagaaggctaatccctgtttgcgaatcaaagaaaacaaacaagaacaaggtagaatacaaccaaaattgcagatgaatgattaagctcacaagttggggtcttacaaaccgatctagcgccgaaactgttctcgacagaataatctaagcaaaacccaaaccataaagatgatgacgagtaatgatatatagagtttagggtcgtgcaaccaacccttgacgagcactaatggcctctaacacgatacatggcccaaagacccaaatacgatgatgcagcaccatgacagattctagacgtcaacttgttcggtcgattaccgttgactcggaaagaatttggacgtgtgaccaaaaccattagaaaggttatcttcttagctttccatccatataaagaatgccccaatccaagcacgtatgcgacctgggtgtccgtttcagtgcaaactagtcctggactccgaattgcactcgaagtcgacttggtttcttttctttcgcccaagcaagtacctctgcaaacgaaaacacacaaaactcattgtgtagcaacgtttgctcaattatataacaagtaaatctaatatagaacatatgcacctttagtggaataatacataaggtaatcatggttatatccgagctagttgtgtcctcatcaatcaagtgggaagctctctgcagacctaaagattatggtggaatggggttcttagacaccagggttatgaatatctgccttttgagtaaatggatcatcaagttggaaaatgggtctccagataagtatttgaacaatgcttgggggctctcagtagttcttccatagggggctctcagttttagaaagagttacaccattgtaagacttgggttgaaagacttgtggagaaacaggttcataagggagatcatgtttttttctggaaagatgtgtggtgtggagatattccactaaaaattaggttccctgatctttttgagattagctatcaacaaggggctctggtgagtgaagtgttcaatggaggagattgggatctagagtttagaagaaatctaaattcccagagagaagctgagcgcaacttattcaggggatttgtctagatgaaggagaagaccaaattgtttggccccatagtaagataaaagttttttctaccaggtctatgtacaggattttgacttttgggggtataagagatgtggatttatgggaaatctagaaatgcaagctccctctcaaaatcaaacattttcttttcctggttgggaaggggaggttaccctatgcagagcaactagtaaagaggacttggaaagggggtgataaattctgtaaattatggggcaaaattgaaactaacagtcatgttctttttttttccctctggcagtttttgattggtgtgtaatcaaagaggctttgaatcttcagactcatccttctaatttttgggattgggttaggttatgggagaaaaaaaaaggaacacaggctttggatttttctgctagggtgtctgttgggctttgtggataattaggaatgattgggtgtctgagaatactttggtttcctctcctttgcagactgtttacgaagctttgtcttttgcgccgaaatggggcgtcctgctaggaaatgaggagcaagcagtgctgggagggtggtatgaggcgattctggagaagtttaatcaacttagagttagaactttgcctgcaactctgtgaatgctcccaatcgaccatcgtgtgtggtgtgtgttgttgtgggtttctgttttcctgctatgccgaatgtttgtaagctgaaaatcccagccagtttagcttgcttccagtttactcccttcgtcctataatgtagcaacctattatggttactacattatgggataggttgctatattatgggacggagggagtatctttttgtaaagactctgtgtgtgttgtgtgtttaggctatctccagaagccgggtcaatatatttgatctgattttaaaaaaaaaatcatacagtctagggtgctatctatttataggattctgatcgcgtgagccgttgctttgtaaaaacgcattagtattttgctaatttatggttagggataattttaacatttatctttttgttaataatcgtacaatcactactaaaaaagtgtttttgcatgcgagctagaaggatcttttcatgcggttggttggtgcaaccgcatgggcgagctcttctgcaaaaatcgctctttggcgtaaccgcatgcgaaaatccatgcaatcgcatataccggccgcatgcaaaaataaattcggcaacaaaaaaataaaatccaaaaaacccccaaaccctagcccgtcgccggatccgtcgcccccgccgcccgctgtcgtcggcagcaccaaatcggcgcggggcagcgccgcccgaggaggccgccacggcggcgttgaggggggggggggaggcgccactgccgtccagatccgccgccgcgccgccgtcgcgcatgggaggtcggtgaagggaggtcgccgccgttgctgagcccgccgctgccgcgccggatgggaggtcggggaagagaggccgccgctgcctgtgctgagcccgctgcatgcccgtcgtccagacccgccgctcaccgctgtcgttgtcgcattgcccaccgccgtcgtggaagggaggtcgctgccgcgcatgggaggtcggtgaagggaggccaccgctgttgccgagcccgccactgccggaccggatgggaggtcggggaagggaggccgctgccgccggtgccgagcccaccgctgacgcgccgctcccgctcaccgtaccgcgcagcagccgcccctccccatccgtgcctcgccgtcggtaagagagagagaggagagaaggaaagagtgagaggctgagaggagaggagaggagaggaataggataaggatggggaaagttaaaatatcaggagaggaggggagagagaagaggagatgaaataatttgaagggaggagggaaaaattaattttaaaatattgaaacttcgaatagaattttatcatactaaatgaactcgtgtgaaaaaagttgtaaaaaaaagttgtagaactcattgagatataccaattttattttggtcatttctccatccgagtttgattgaactatataaaatttaaattttaaaatataagaaattaaaataatttttcaggtagtgaatgattttacatggaaaaattatcaacaataaagttgtataacttatcaagatgtataacttttgttttggttatttttctatatgactttgtttaaacagtttgaatttggattttaaattataacaatatcaaacaacatttattacaagtactaaataaattcaactgaaaaagtcatcaataacaaagtggtataactcatcaagattatttcttcatccgacaaagtgatagtaacattttcacaaaatttacatatctctcttatagtttataaaactatttgtcggatgaagaaatgactaaaatagaagttatatatcttgatgagttatacaactttgttattgatgattttttcagctgaaatcatttactgctttaaaatactatttgaagttttaaaattcaaatttttaattgataaaacaaagtttaaaaaatggcaaaaataatagcagtaagaacacagcaacatgatagagcatgattttagaaacatttaggaaaaagaattatccaatttaaagttcatatgagtgagataaactagtttcaaattttttaaattttattttttgatacgactccttaatatgcccgtataaaaaaaatcgatttttccatgcgggcggttaagtgagccacatgcaaagaggcctgtataagaaaatcgatttttctatacgggcgttttaagaagccgtccgcaaaaataccgttcgatttttactgacgcccctagttatagttatgatccatttaaaaaatcataatgtctcgtacagaaaaatcatcattgtagcagtgaatcagacgcccgtgtcaccgctcatttcgttccttcgtgctgtagctccgcgcatgcccgactcccggattctagtttatcttcaaattatttcatcatccttttataaacatctctcccgtatgaaaaataatttatctgtagtatttgcatcgatgcatgagagatgatgtacggatatgtagtcgctgatgtggcttggaccaagtcacggcaggtacaatgaagagcgatcgagatacacttctcgaatcatgcatggcaaacaaaaagtatttgcatctctttgatgacaaattattactattctcttgatgttgttgactctataaagaaaatgcgtaaccatgtcgcaacttgatcaagagatgtggtgtcattcctaatcaaagagatgaagacagttacggaatggttggcattgacaatttgacgtaatataaatcttaaaacaaatttgtgcaatactaggtactccctccggtttcattttaattgacgttttaaataataacacggtctataaatatttctttgaccttatttttctattataatatatacaataaataaatgcatgtttacttttattatattgctttgaaagataaatttatatatgttgttctagtctttttaaactaaatatttttaaagttattgatggtcaaagttataaaagtttagccttaaccttgttcaaaacgtcaattattatagaaccggagggagtacgccctaaactatttaccttttcgcccttccaagttcttatgcctatctgatttcagaccttttgccctgaccgcttgttagtaagaaatttataatatacattttcatgtaatggaaaatttacatgtatacattacatcgaacagataaatatttgatactgtatccaaaaccttactgcaataagcaaataaaaacgttgatataagccataagtaccttattatttacattgtcatatttgggctagttagcaaagactataatcctgccgcattctaaaccgaaagttaatatcaaattcgaaacaaattttcggtaaaaaaaaactgaaacaaactatacaggcctaacaaaaaaatgttcaaattaatgccatttcaaaccatacaattttttaattttttaagtaaagttctcaaaattatatatgcatttaatttcttgctaaactttgataaatatataagaaatcctgccaaaattttgataagttggtaatattactaaaattatggcattgctaaaatttgttaaagtttattttagctacaatcttaacggtcccaaaatatatacccaacaaagggcaaagtgggcaacaaagccttagacacccataggattaggctgagttcgttagaaggagatgggtacacaggcttcacacagctagagttggccagaagcttcatctcgaacgtagaaaatttgcgaaaaagaaagaaactacacgacttagtttatttatattcccatagaaataatactttcaaaaggacacctagatgaataaatgagggatgtgtttgtcgaaggttgagacgaatcaaaatagaattaggatagtaatctatgattcttaatgattttgtttgttttaagctgcactgtttaacttcaacaaatgattacgtgtgctattggggaaaaaagagaaaatgtatgttttccaaaattgcagcgatcttcatcaatcctaaaatttttgcacataattccttagaacttgtagtgttgcctgataatacatattctaaaaaataagttctcaatatcacaaaagtttgatccaatcttttactttatttctgttatttaatgtttttattttctataaagagtaaagtgcacgggcgatcttaaattaacttatgcggatatatatatcatctagctaggttcctcctgggttgttatatagggcacttatcttttgagagttcagtgtccacccgtacactgcagtcttctacaaatataggacaccaatgtggtcaggccaatttaacccacagtatgtcatattcatcttaagatttctacaaaattatttctaattctttactttcattttaaaatttttccttattctccagcgaggtgtgattactgattagtcagtaggcaatgcacaatggtgcaaaagccgcaggcgcaagggcctagatgcaagcagtccaattggctctcaaatcctatctttctgtatagatataacccactaattttaaaagttcaacatgcaaatatgccacctcatcatccactaacaataattgcatacaaaacttatgcaagcatgcaacattatctataatttattgaattctacaaatcaacatccaatcatcttccttcacattatttttcataatatttttaacatatatatatatccatcatatttataataattaatatatattcatccatataatcaaagtgcgggatatcatatttcatctacaatctcatatttatttctcttttaatatagtatgacaaaccagttttatttattgttaataactaatataatttttacttttagctcaattattaaaaaataataaaatttacttattaattttcacagcaaagcacggggaatcatctagtagtaatacccgtgcgacgtggatggatcgatccatccttgcagagcaacttgttttttaagtattcactccgtcccgaagtataagaaattttgattggatgtaacacattatagtactatgaatctaaactagtactatatgaatcatagtactaagatgtgtatcattcaactaaaatcttttatattttgagacgaagggagtatagttgaagaatagtttagtacatattttagtttttaagaatgggtatatctattttggatctaattattgtcaaattattccattatccttttatagacacttgcatcgtacatgagagagaggatgtacggaaacgtaagtcgctgaagtgccttggaccaagtcatcacggcaggtacaatgaagagcgaggtatacttcttgaaccatgcatggcaaacaaaaaataacaattattctcttgatgctgttgactctgtaaacaaaatgcgtaatcatgtcgcaacttgatcaagagatgtgctgtcagtcataatcacatagcttaagataattatggaaaggttggcattggcaatttgacaaaatataaatcttaaaaaaaatcgcaataatatgtacgccctaaactatttaccttttcgctcttccaagttctattatgtctacctgatttcagacgttttgccctgaccgcttattagtaagaaatttataattatacattttcatctaaaggaaaatttacatgtatacattacatatttacatcgaacagataaatatttgatactgcatccaaaatcttactgcaatatcgtcatatttatttacataaggggcggaactgggtaggcagggtgggttatatttgagctggttagcaaaaactataatcctgcctcattctaaacagaaaattggtctccaattcgtaacaaattttcggtaaaaaaaattctgaaacaaactatacaggcctcacaaaaagtgaattaggctaagttgcggagcgaggagggttggaaaccctcactcccaaacacgcaaaacaaagcggcgtttagtgtatgatctattaaatattagctaaaataaacttgaaaaatagattaatatgattttttaaaatcaacttccctatagaactgtttgcaaaatacgtaccgtcgtttagtagttgggaaaggtgagggaataacacagccttatatacccaacaagggcaaagtgggcaacaaaacctttgtggactgtggtgccggacatagcagtacgaaccagtagcatatatacggcacaacggcagccataggggagcttgattgccaaaacacaaactcactcgcggctgcaaattcacctttgcagagaagaggcctagctagagctcgatggcggagatcgccgtgagtttggttgggagtttgatcgccggcatctcgacgctggtggagaaggaggccaccttgctgcagagcgtgccggagaataccaggtaatcaattaggatgagccggcgccgcacatagagtttttctgtctcctccactcgcttttcttcatgaacatgagcatcggttcttgcaatgtgccaacagaactgacaaatggagaagacaaaaacacatcagaccattatctaagaaaaaacacacattagatcatgagagcaattagctcttttatgacaatttcactgttagagcatgtgacagtcattttcttttttgctttgttctaatatccctaaattagtcacttttaaaaaataattattgagtaatcattatggacaaaaggttaaaattggacaatatttaaggcagtatgatgcagaaataggtaaaagtttattagcttatggctttatgaaaatagcgcatttggagtacagaacaaaatgcatttgtaaaatatagagtcaatatatgtaaggtggtgttggtcacaaactcctactttggataatcttcaaaagttccctgaatgtccacagttattacagagaaaaccaaataacagtagacagttcccagaaagcaaacaacaaacaaatctaaatatttatgtgtattatggtatatcacgaactaataggagtttggtgaagcgatctaagttttaaaaagatattagatcctaaaaagaaaaaaaaagggaaaacactgtgcatgatcttaaatcaattttgcactacctccggtcaggaatatttaacacctgcgctgctgcgattagtgacactggcatcaaatattcttgactggatggagtacttatctttctgaagaaatcctaatgtttctatgttcagaggcagacaggtaggtccctaaactatacaaataaatatttagacctataatgttttagtgtgaacaataactacatatataagtatacaagataatatatagggctaaaagatgttatattatacacaactaaataataataggcattagatttgattgtgtgactaattagtatcggtatcataataacaagttggctcgagtttttaacgagctgaactgagctctactttcagttcagttatctaaacggccaagcctagcaagcttattctcctatcaagttttaacaagctgagccgagtaaagccaacttgttaattgttatccacccctagtagttgtgtccccatgccaatgactcaagatataaacaatgactgaatagaaactagggatggtttagcagttattttccaccattaggagtaaatggcatgagctgacaattagggcctgctggtcagcgatacagagaaaattaatatagaatcgcgaatcaacttgattcagcttgctggtggggaggatttgttggggctcaggatgactagagggaagggaagctgttcagtgttcacctgtcacgcggaccaatgctcactgaaacaattgaatcaataaaattaggaaagttatgtggaaacgaacttggaataagaacaattgtttcgataaaactagcagggtggcccgcgcaattgcgcggctagcacccaaacaaaatcatttttttttaagtatgattttacttaaaaatttattaaatagctatctcattgtcttaagagtttgaaagaccaaaccttataatccccgtgtttctaattatattgttttttaaaagtcacatcagttgctaccccttatgtcatctccttctttatttgcttgctcgatctaccactatttctattcattctccttggaacctttaaaaattggatcttatagtttttagagtttattgtcacgttgggtttcgtttttataatttctagacctcccgtcaaatgttgccattttactcctctatggcacatcctctgtctcttctctttattgtcattgagattttaaaaatcgaacataattatcgtttggattcatttttactttctagaagtcccgccaaaccgtaagcggctttgccattgtagttctctacggctcgcccgctgcctcccttctttattgtcattgagattttaaaatcgaacattattatcattgttttttttttacttttagaagttccgaacctttaaaaattgaaccatgtagtttttagagtttattgtcttgttgggttttattttttataatttttagaagtctcgtcaaacgatgccactgtgctcctctacggcccgtccaccgcctactctttattgtcattgtgattctaaaaattgaacataactatcgttggaattcattttttattttctagaagtcccgtcaactgtcggcagctctgcaactatactcctatacaccccgcccgctgcttctcttttttattttcattgagattttaaaattcaaatatgattatcaatagttttttttttactttctataagtcccgacaatcgccttgctcgtttgcttcacagcatgcttgtcgtccctccttttaatcgtcattaggattctatttggtgttttgttaacagtttttatatgtcgtatcaaccgccagcactctactcctttatagccatgatacttaatttatgtcgtcgtgtgttctagatggtcttttctttcaatagtctttatttttatcacaaattttagttatttataaattgtattcctaattgaaatcttttttctttttctaatttccgaatttatttttttcgtattgtgttcttttgatatttttattttttattttcatttttagttgtttcaaaattgtattcctactttaactctcttttttatttgcctaattttggattttattttatttttattccgaatttaattaatctaccaattttaattaatctcgtattgggtt

SEQ ID NO: 67713 - DNA, 6729 bp, Oryza sativa
acatgattaatattttatgcgtgacttgtctttttatttttttttatatttttttcaaataagacggacggtcaaacgttgggcacggaaatcagggtttgtctttttttggacggagggagtacagttctttctcaaatggtgacatttgataccctgtgtacgcactagtacgcggtgcaggagtgtagattctaatccttcgaggggatatttcctcgtataccttttttttctaaattcgatgcaaatagttgtgaaaaattatgaaaaaaattaacaatgtagagtataatgatacctactagtccaccaaaattcatgttcaaattcgatctacacatcaagaaacaaaaaagacaaatttagatataaatagtacgctactattcatacgctgaatttgtcttttttatatctcgacgtgtgagttaagtttggacttaagattttgtggagttgtatatatatgttgtatgaatgttgtcaaattttttcagaatttttcataaccgtttagatggtttttgagcaaacgagagaacatcccctcgagggattgaatagtttccccgcggtgcagcatccaatgttcagtttgtaaaccagatggcagtcacagggcttctgccaattgcagataacatttgcccataaaaatggagtgatacatgaattgttgggtcacgactaatcatgtattgctatcaactaacaaaagaggtcagacgacgtctccatgacacaagagagcgtaagacagcgtaggccatggggtccattattctggtactccgccattaggagagcttagaactggaactgcatctccttggtgtacccgagctcatcaaggtgcgcagccattgccttgttcatcggaggaggaccacacctcaagatctggaacaattaaacacatattatatgtaagtgtccaggttgagacaccatacagaaagcaaaaacttctttctaaacaagaggttccgaaaatgaagatttgagttttacttgaatgtcctcggcaggtgctggcaaatgagctttaatcatgtcctgtgacacaaacccaacgccaccgttccagacttcaggaggctgcacaagcaaaaaatcaacattggaatctgctgcaaatgtctttatcaagtaccatgcatgtcgtaattcctaatatacatttgggactacgattttatagcataattttatttcaagcagaaaaaacacaaatactaaagcaaatgcaactaagagcatgctcttatccaaagaaaaaaaaacgctccttaattattttaatatcatccaggaatctttaaatatttttatgtgaaatctttttcaattatctcaccattgtagggtactatggctaatggataaacaacccatcccttgttccaatcagacaattcataacataaattcagcaacgactcccaaaaatattcaagagaaatggcgaacgtggaatcctggagaccactgtgtccagcaaagctattgatatgtatctagagtactgatgttgatacacaaatcttgtaaaataatagaagcatagggttcacctgattcaagacatagtagatcttaaagcgatcagggtaggttttggccatgttgtccagttcttcctgcacagattcaacacacataaatttgggactgcagtaaatagcagaacatatgcagtcaccaatcatcctaattggttacagataacatgcatagtggcataaactattattgcaacctcaaaaatatttcgacatgtataatgaatagagaactttcttgcaatattaatagaataaattctttgctcaagcacatgcagctgtgctggattattccgactctcccattcatatatcatttatagaagctttgacattacataaagaaattgtaaaatatctcagctacaaagtactatgtataaattattccactttcatgcagtacaagttgcatgagttttgcatttgaagaaacaaaccagttaacagttatcataaacaatacttgaaatttcaccagctgtcattggcaactaaatgaaatgtgtatgtgcatggtgtccactagtgaatatatggcacaaaagtcaattaaatcacatgatggcacagtaaatctgaaatctgatggggcgatgctaacagtcagaaagaccacaaaattgtatcatagatatattgtagaggcagcaaaaagagagtcttaacaaataacaaagaagtgattccaccttcagaagaatgtcgtcatgcgtgacatttgcatagactaaatgaacttttgtgatatcattagggttctcaagaattgcccttgcaacctgtgagaacataaaaaaaatgtttgtcagtactaactactaagtgacccgcttgcagcaacattaactgcaacatagaactttggaggcatatatgttacttggaacatgggagtgatgcctgatccaccagctagcattccaaaagctctcacttgcccaacttggtatctgaaacgaccctagaacagagaagaaaccatgttaaactcataaaccaaagacaaatgagcacccaattcaattgtgaatgtcacctaatcaataaatgtaagcacataaatgctggctaaagcataatagataacacaaaactctttcagagtcaataaacacccattatagacttaacacaagttgcttggaacagaaagaaaacaaccttaggtcccttcacagacatataatcaccaactttcatttcacggaaatggtgtgacattcttccttgagggtacatctgcattatgagaaaagttaaatggcaaatcctgcttgtgtggcacataacgatatgttccaggattgacaaacaagcattcatacagtataaagaactgaatacaatttaccttaataacaagctcaaaatgccctagatcagaatccaatgtagtaggggtataaggtttgattacttcttcgcctgtagcatcttgtcctctaaaagaatagcacatacatttttccaatttatgtaaaaaaaaaagggtagcaaacttcataaagaaaggcataaggcggaatccaaacctgcaactgatatgctgaccaattggaaggcccaatacagaggttggagttggaagagcaaatttgaatctggccacgttatgacttatttgcttcttttccacaagtttaaacttcttgaagttctcaggatccaaacagcctgaggagggaaaaataaatggcaccaaccatcaataaaggaaagtagcatgaataccaaaactgcacaaacaactactgaaagataactatagacaatgaaacagcaacgatacagcacagtgtggcagcctacagttcgctgctccgttgaatctttgtcagtctggttgcgaggaaggccagaagatgggcattcgtaaagcgattcagaactcaaaccacacacacagagagtgatgatgagaaccaaccaggactaatctggaaccccggagaagcagatcagatcacgcgcgagagccgccacatcacaaactcacaacatcggactatcagaggggacagatgcacggagccaatacatacccttgggcttcctggaccggaggaggaggaaggcgccgcccgcggcgaccgcgacgacggcgacggcgatggccaccgtggtctggacgctctccccgtgcaggagatccatggccggggaggaagctgcgcttgcgacccccctctctcccgctcgctcgccgcggcgcgctcggaatcggtggcgggtttgggtgtgggtcgcgggggtttggtttggtgcaggatggggaggtggattttaggcagcggggtcggggatgaagtaggtgcgacagtgtgtgcgcgcgtgcgtgtttgttggggagtctggtggtggtagcggagatcgcgaggtcagcaaacgcacacgccggtcacaccggactcggaattcgtctattaggggctgtttgtttttcagggaattaggcctgtttaattcagcttaagattattataatctggattattaagagtaagctgaaataaataagtagattattacgatagattattataatctataagccagattactataatctaataatctcctctgaaggagcttttttcagattattgggtggctaaagacccactacccttagatgccttcaataatccagagaaacaaacagctcgcagcttattctatgtcagcttattataatccagtttagagtaatctgatttaataatttagattacaataatcttaagctgaaacaaacagggccttattccaactccatgtcacatcggatgtttggacactaatttagagtattaaacatacactaattacaaaacccattccataaacttggactaattcgcgagacgaatcttttgagtctaattacgccatgattttaacaatgtgatgctacagtaaacttttgataattatagattaattaggcttaaaaaaatcgtctcgcggattagctctcatttatgaaattagtttttttattagtctatgtttaatactttaaattagcgcctaaacatccgatgtgacatgcgctaaaaagttttagccccatctaaacaccccctaaaaattgtgtcgcggccaccactattgagcactctactatctactagtactacctgaaagcaactacagaatgctgtactctattgaagcagccgtttaactgaagttctggtctaaccatttgaaacttgaaaccttttaaaaataaaaatcgagtttctaccacgattttagcttgttggatggggatggatcacgtgctactactatacggctatactactgtactgtacttggacgcggttggtggcgcttccgatgttcagatttccctaaagtaccaccggtaatctagccgtcaggtcagccaccagattcctcctcattactgtggtcggatcagcggcgggttagtggttttgccggtgtgcttaccggcggtctggccactggcatatagtcctactgtactctgtcaaaaaaaaaaaaaaccctaatttttcgtgtccaatatttaaccgtccatcttatttaaaaaaattatgaaaaaattaaaaagacaagtcacgtataaagtattaatcatgttttatcatctaacaataataaaaatgctaattataaaaaaatttcatataagacagacagtcaaacgttagacacgaaaagacagtcaaacattagacacggaaactcagggtttttttttagggacggagagattatgtctgtatacggtcaaattggtcatgcatgccagagatcgttgcaagtttgcaacacggcgacagagagcggcaggatgcaggcgcgcctcaggtcacaggacaaccacgaccagcactccccgtaccgcggatgctgacagattcacaacctcacgcggtagtatatacgagtactccatgcggtatatacaatgatcatttgattcatcgtttcacgtgtgtttcgagtcctaaaacaaaagagagcggagtaaagatgggttgagggagagaagagaagtgagttggcacgttaatttccggatgaaaacgacttgaatgaataggttgcaaatttgaaatacggcatgcatgaaagttactcggtcgagggctaaatgtgtgtttggttgctcacattctagtctgatagtagtatgtctcttacatctagattgagtttggcctgtttaaaaggatatgcgtgcaaatatttggttgtttgcattgggcgcagcctagctaacatgtgattttttttttgattgattgtactggagaacagtttagaagagattttgtttgattatttggatggatcttacgtatggtactcttttaagattgaggtgattaccagctagaacttgtggaagaaatgtccttccatttagataagcttaacattgttatcattttttttcactgtgaaaatccatctaaaattcatggtacgagcagtttacgaagtaattcatctaaattcagcgagttttttttaaaaaaaataattatcaatttgagtttatcctgtacaataactttggtgtattaatgatgggtaaatgtagaaaaataaaacaaaaatgaccaaaagagagagggggagagaaaggctctcgtcatcaaggtcgctctgccgccgctccaccaagaaggttcgctactgctctcgtgaatcccttccggcgctcgctgcctactataccctcgttgctcctcttgttccgctcatgcccccgccaagcttatatcccttgctccgtccaatcactcccaccgctcctcaagctttgctattcccccgctcgctgtgctcttcacctctgcgcgctcgccttgtcctccaccaaagaccaaaacctagctttaaataaggtgaggctgaactgacacgtcggccaccttgcacacgtgggtgtggttgtgcagcccattgcatccaccagatttgcccgagttgtaaagcttgaatcgagcatttccgctcaacctgactacggagacctttttgcatgggcggggttccagaaaggtgcgcgcgcacacacagtgaaatgagtttgttgccacagtaatttacagttttcactgtagcaacagtaaaaacagtgaaatgaactgtgcatggttactattcacga

SEQ ID NO: 67714 - DNA, 8361 bp, Oryza sativa
cagtttgattttgaccaaattcaaaacgcattataacctaaaacgaatggagtactaatgttttgtatcttcggattctataccataacacgcatgatcttcgagaaggctaacgcgcgatcaatcgcggccagcgatcgggtttttttttcttttcctcttttagtaaatctatacacctaaagtttataaagcaaatgtttataagtcaaaagtttatatacccaattcaaatttaaattcaaattcaaatattttatattttcctcttttagtaagtttatgcacctaaagtttacacatctaaagtttatccacctaaagtttgtagagcaaatatttataagtcaaaagtttatatacccgattcaaattcaaattcggattcaaatattttatatataaaatatttttatacataaagtttatgcgtgcaaagtttatggtataaagtctatgcacataaatgagactattagatttttttttctaattttttttactaactttgtgtttttttttaattttgtgatggaaggaaaaaaatagagaggtgtatagggggaggggtgggttgatcgctcccccattagatcccccgtgatcttagtgctcttatcaatgttaggcaaaacatgatttcctgtcaccgagcacgagcaatttcttgatcaaccaatccgtgcatcctcttttttttttgagatttggagggagacgtttctccaaacaacttttaaaaagaaattataaacgtgttgacgattaaacacaagacctcataattaaaaccatatccccttgccaccactagtgcatcctcctcaaagatcgcagcgacagcgagaccgttgcgtgaaacctcactgctgagcaatctgcagcggttgccgcttgctcttgaggaagtcacggtaccagcgagcagaacgcttcgctcgccgcggcagcgccgcgtcgtcgaaatccacgcggtagaggccgtatcgcgtctggtatccggacaagagctcgaacatgtccacgaagaaccaagcgaagtagcctctcgcattaaccccgttcctgcatatgcacgcacagcaaagcaaaatcaatcagaacatgtatcatcagacaataggtcttattcaagaatcaagatggtggattgagcatttgagctgaaccatccggcgtctgaaattttaattttcatgtggttttgggctctgagttttggatcacctggtcgcattcaggacgccctctatgtagccctttatgtaatccaccctgtcagtgtcgtcgagactgtcattgctagatgccttccctgaaaaaacaggaaggagatcgagctttaaccttgaaggcagcaaacttgctcacagcgaattattcattagtcaagagattcttaattagcaggtgatctactaggatgaattgactccataaaactaagtgagaaacagtatgtgctgctcgttctgattactctacgggaaacagaaactgtactttccattctcctggacataaattggcaagtcaccataggactctttcaggtgctgtagcattagttgtaatccgtgtggatcacccatagaccgcgttggggcttgctgcagccaataaagagaggagatatatgagtgatgagtcactgccaacaggacgaaccacataattccaagagtgtcttagtaatgatattcgaatttactttatttttgtccctcgctttatctttaaaagaataatggataagagcataaatagtggttttagaccgttactgtctaatttttttcatgtcagatttagatgacatatatatacaaccgatacaatgatgtttagttttctataatagatctgtataatcaattatttcaccctatagatgacatgtataataattatatagcattaatctctggcctcgttttgatgaagccatgtaaatatcaatctgtatttttttcaccctattctatccatatatacgaggcaaagtttttgccctcttttaaaaatatatatatatagcattaagccgtatattagacttaatcaacagacggcatacttctatatcttttccacgtcacaaaaagaaaaatcctatgtagcatcttctcctagaatgtgacgccaccattgtttgtgcaataaaccttaccccttgcaataaaccttaacctaccacctttcctgtttatcataaaccttaccccttgcaataaaccttaacctaaagtcaaaaggcaacaatgtatctcaataaccttactgatgaccaaattaacttacctgccccgacgatggatccgttttagaagctgcataagaaaacaccgagaaacaaatgataagctatacagtacatctaataacttgtagaatcatcttcagaatcatcattggatgactttacaaagttattcagcatatatgaaaaagataatctatcatcacatcataaaagatatgacgtgcattatcattttgttttgatttattttcttttgtctaccttcatcttcatgggccgtccctataaaggaatcaagctacacactcctaggctacaaatttatgtgcataattaaatagaaaactggccaacctctgcagcttactgatcgatcagcaatgaagtctcgaactccttttgccaaagggagatcgctcacatagagagaaaagtagtgatttactccaatgaaatctagagtacccttgactagttcagtttggactttgctgaaggatggaagacgagaaccgatagctttcttcattacttgtgggtaatctccaaataccaatgggtgcagtatcctacaaacaagagtagttgtttatcctctaagttcaacggtgagcttatattcatgtctatgtcaaatatctagtatccattacaaagagggagctaaaaggaaccactaggttcatttctagaaattgctacgttaacttgggaaaaaaaagagagaaaatctagcttcgtgtaaaattgtgcagtccgctagttcagtgtgaagataaagagttacaacatcgatcataccatccgtacgtgaaatccttgtatctttgagctgcttgcagatccgcagtggagtctgttaatggataactccacaaggaaagaacgtttataccaacaatccccttttgcagagtctacatgaaagaaagttgcaaaacactttgagaaatttagataagaggaataataggaagaaaataagaaaataagaggaataataaaataaatcctttcaacttttttaggattgcacttaatgacttaaaacacacacatactctcacaaatgcggccctttgaaaagctcacactagaggcaaatatctgacctcactaaaaatcgtattgatagcatacttgcttagtgtcttaggccccgttcgatctccagttttgaagatggatttttatggcacgcaaaacgagaaacctcgttagcacatgattaattaagtattgactattataaatttaaaaaatggatttatatggttttttaacaacttctatatagattttttttaaaaaaaaataacgcactaaccctaacaaatcctagattctcccttaacttctaggattggcttaccagaagattggccaataatgcacaatttaacaatttgaaaagcatgctaacgaaaaacgaggaagttgaagtttggagttgaagaatggaactgagccttggtattgattgcggagaatataagtgcggttagaaatacacactaccgataattttaagcacattattacttacttgatatttttctctgtacagtctaacaacagctgcatgtgttagtatcatattgtgagctgctacatatggttccacactggaattccccactgtacatttggtcactccaaaaggatcagagcaacgtcctggagcgaattctcctgtgtcataacctccaagtgcagcgacattaggttcagccaaaatagtccagtgcgaaactctatcaccaaattccctgaagcacacatccgcataagcagtaaaatcctccctgcattgtgccattgttactgatcagcagtccagaattgatctactccaactagttgtaagcttcaagtataatcactaccagtatagtcatatatatatatagatggttcctgaatcttacacaattctagggcttaaccatccagcatactcatcttccaaagcttgcgggagatccagatggtaaagcatgacatggacttgaattcctgaagaaagccgagcaatcaatattcatgagatagtcaatgtcacattggtcgattccggtctttagtaagtcagtgttcaccaagcaagctggagcaccggcccaggtcgtggcagtacttgtgatatttctacttgggacgcattttatttggatgttttatggatgttaaataccattagacgggctactttttattggcattggaaagtggaaacacatcacattatggcagggcaacgcttcacaatttaatgccgaagacgcaaagcgtcacttttcaaaaggaaggagtgcggctgactgaatccatccataaaactgtcaaggaaacgaagttcgtcctagtgcaggttttgctcgagcaacctcttttttcttcttctttcttttttgtgcttgctaatatagttcattgtttaaacacaattatgttttatcaatacaacatgtaatgctctgtaatataagtaacctgaaaaagaatttgcaaaaattacctcgttttgttagctcatctataatgttattgtagtacttgagcccctgttggttgacagctccccttccacctgcatatcacaactaagcaacaaggaactacttctttgttaacaagagttaaattttgagtagaaatggctgtacttgggataagccttgaccaggagatggaaaacctatatgcctctaggccagtttcagtcatgagcttgacatcaccctaaaaaatcaggcaagcaaaattattacaagccaaagttctcaacttaggctgtgtttagttgtaaaatttttcttcaaacttccaacttttccatcacatcaaaactttcctacacacacaaacttctaaattttctgtcacatcgttccaattttaaccaaatttccaaatttggtgtgaactaaacacaaccttaagttctaccagaaagaagaaaaaggtgaaacattcaaagtggaactcgaggaaccttgttcctatgtttagttccttcttcaggaaaaatattgcaaaaacacaacattttgctacaatggcgagactcattcacatgtaagcaagacaaggaaaatatataaaagggcaatcttccgaagtcaaacctagcttctactccacctaagaaattaaatcgtgtaccttgtatttgtggtacccatctgaggcaacatcgcctgtacttttgtccttcattttccctgattgcacatatgaaaatactgtcactattcagttttagtgccactatttatttatgcttatcagccaaaatttgaattttcatccttaaatttgaagttgattttggggttttttcgttgaagtttatttttcagcatttgcttttagaatggtacgtgatcctggttagctcgattgtgtatttgtgtatgagcatgaagcagccatgaaaagatgatgaacaacaacagtgtcccacgcccgcgcgtgtgactgtgttcagcacttcagcttccagggagcaaaaacgactgacctgcatgagtgaacgtgtcccagatgctagcgcccctgccatcctctgcggcagcgccctcatactgccgcatgcacaacaaaaggcacagcgaaaaaaactcaaagctcgcagaaaaccaaccgagcaaagcaaaaattcagttgagatagaatcatagccgttacctggtacgccgaggtggcggctccaaagacgaaatcagcagggaaatcattcctcgtgtagccaccgagaacgccgtgctgcacggagatgaacagcagggcgcagaagaaggcagcagcagcggccatgggcaagagaaagaagagaagcaggggcagggctgctggttggttggttcgaactggattgtgtttttgtgcagagaaatccgtgtgatccagttggggaagacgataagacgtcctcagcaactggcacgcccaagttgggactaccagcgcatgttcacgtcgtcctgacgagtgaacaaccgactcgctgaggcagacgagcattcattctgcccctctgttctctatgtcgggggcagtggcacggacgccgatcgagctgccgttcgggttcggcagcgaaacctggtttcgtttcgagtttcagtgaaaaactcagagatttgcgcaatccgatcgtgcttactactactagtactgatttgctgtgactaaatgctttggtaaatcctcctttgaaaaaaaatgctttttaaaatttagggcacttaccatgtaagccactcctagcaatatcctcatgtgggtcatatgggctaaggcacccaatgaaaagtactccaaccagccctaccaaatctgaggcaacaaggtagagataatctagcccacaacggtcctatcctagcccacgaagccacatgtatgtttttcctcccctacccctagctattttctcagcccatccactgatcatccacttctcccctctttttttcttcgccgcccgtctctctctcacctacctctcgctcgtcgctctccctctgcccgtcgccatcgctgacttccccacctcgtgccgctgccgtccaccactccggcgatcagatctctccgctttgcgccgtctccagttccattccactacgatgctgctaactccgccccaccacggcgccgtcgactctaccccaccgctcctgccgccggacggctccgcccaaccgcgacgcctccatatccgccccatcgcgcccgccgccagctctgaccaccgcgactcccgcgcccacctccggctccgaccaccgcaatgccttcgattctgccccaccgcgcccactgctaactccgaccgccatgacacctctggttctaccttgcatccgtcgcctgctccgcctcaccatgccgaggtgagaggggcaagaagggaaaatatagagaaaggaggtgaggaacggggcaccactcgagccgtgtctcaaaagagtagtcgaggagccagaggggcgcgttcccctgttggggtcacgcgttccttcaggagcatgactcatagacggaacggtgacgctgtgagcgaagctactagctggagttacccattgcatatgctctcacaacgtagaggtgcggtcacagagacagtcacagccgacaatccgacatgcacaacgaggcagattcttgagaaaaaataatgagtacagtaagaagagagaagggcagaggaaaatgcggcatcagaccgttactcaatcgcagcaaatcaatccaccatccatccacgtcgcgacgcgtccaactccatccaactcgactcgacgccgacgccgacgacgaggaaagcaacaaccaaaagcttgccgttaaaaaactccaaagttaatccccaaaaaaagaaggaaaaaaaaaacacccgacccgtcggcttccaggcagccactaatcccaaacgccttttttttttcttttcttttttttttcgcgtcgcctttccttctcccattcctcctctctccagagactcgccgtcgccgcagccattcccatttttgcccactcctcctcctcctctccagtaaaccctagcccacccaacctccaatccccccccaaccagcgcccgaatcgcagccccgcgaggccccaatcgagctagggttcaccgatttcgggggccgagccagcgaaggctctcagttttcgctgcgatttgtggggtgaaattttcggggggattttgatttctttctctcacggtgggggatggggagccggagggaggaggagaggaacgagaagatcatccgtgggctcatgaagctgccgcccaatcgcaagtgcatcaattgcaacagtgtggtaataatctcctccgcctcctgcttgcgtttgttgctgagaagcttgattggtggttcatttcgttcccggatcgttgcatggtagagcgtggaattggtctgctgggttgtagtgttctgcagttagcgcagatttatgaaatccatttgtctctggtgtgaacttttggttcgtccgtatgtttaagcttcaatgttggttggatgatgatagggcggctcgttcgtttctgatacagggat

SEQ ID NO: 67715 - DNA, 13808 bp, Oryza sativa
tattgagaagccacttggtaattacagatccactttcaaaccacaggcccagaaatatgggaagacaccttgggtactgttgacatactagttgcaagcattggcacaggtggcaccattacaggcactgggcgttatctgaaaatgatgaacaaagatattaaggtccgtactcttgtcttcattaagctcttattctatctttgaagaaaactgggatatgttgtgtccaaatgacaagtgctgcaacttccattttcactaggtctgcatgaaataaagaatatgccattctcatccctagtaactttatcagaattttcggagatatttggagtggaaatggaatttgaaacacatgccgtttacacatgatacatgaccacaactgtgtcagaatgattatcttattttgttctaaactaagatatacttttccaccaaattcagtcattcagcgatgttgctttagaatttattctgttatcattgttactcactaactggttgatggtaccaattactccttaatttaactttggaagtgcttgtgtgctcttccaaaaagtgaaaaacacagcttctaaagaaatttatgtcttagttgcagaaactcaccacatgtgttaaatatctgtactattcaatgatttgaggacaacaaagcagggaaatcctttgatcttattataccttttttgtaaattacttgttggacaattggtttcctcaaccacagagatttccattaggttaatatcaatatatctttgttttaaattcacttatgtgtttggcactgccctttaattatcaggttattggggtagaacctgctgaaactagtgtaatctctggtgataatgctggtaagttcaataaccccattccaatttagcaatcaacatatttgggaattgagcatattaagagtatattccttggcattgacatccttttggttgatgtcaattaaaacaggttatattccaagcatattagatgttcagctgcttgatgaagttgtgaaggtccgcaatggcaactttaattgtccttttatttttgaaaaaaaatgttgacagttgacagttcctgcagtgacttaattatgattttgaaaaatgcaggttaccaccacagaggcagtcgatgttgcaagggaacttgcactaaaagagggcctgctggtgagctgctgcacattaaaccctgttattttcagctactttatcagattattgtcgccgattatttgctacaggcctctaaaaatacgttctctaaaaaagctttattctacatttctactgcattgcttatatcgcttgttctaagctatttgttaagtttatcatcaaaacatttaatttatatatctataattgtgtagataatccactacaataatccggtcaataatctatttcaaactgggcctaaatgtattaactttggagttattattgattcgatattatcttgatgtcagcatcttcctcaaattgccatatatgtgatacataacttgttatggggattattttacaggttggcatttcgtcaggtgctgccacagttgctgctattaacgtcgctaaaagacctgaaaatgctggaaaattgattgcggtgagagcttttatctattaaaagatgttgcagcttagtgaagtttgttcatttgtatcacaatgatcttattataatcaactcagatggttaataaataatgaatttgcaggttattttccccagctttggagaaagatatatctctagcattttattccgtccgatatatgactcggtccgaagaatgaggaagagataactaacttctgccactccaggaagaagaaggttgccagttcttaaacctaacatacttccacggcataacagattttgaagggtgaggttccaggtagattacaacgagtagtgcctgaaattttgaaacgccataggcactggtcagcctcacagaaggttgaaattgcgcacggttgctgacgagtagtttgcaagcctgcaatttggttccagggaatcgtgtccaaaactattcataactgtaaatcatctgcaccaaagcgtctggaaccagaccacatccacgatggaatatgtagaattagatattgcagctagcatagtaggatctttcttcaatagtttaggcttggtaatggaacagatctgtaatgtgatataccttttgagctgatcttgttgacttattgaacgaaactctacacagatttactacctgtcttaaaatatactccctccgtcctaaaaaaaggcaaaccctgggtttccgtgtctaactttgactgtccgtgttatatgaaatttttttataactcatatttctattgttgttagatgataaaacatgattaatattctatgcgtgacttgtctttttaatttttttcataattttttcaaataagatgacggttaaacgttgggcatgtaaaccaaggtttatctttttttaggatggagggagtacagagtaacaacttttaagtacaaatctgactattattttatagaggatatcaatagtttcttcaaattgtgagttaatctgggccaatatggcaaatatcaggtttcattgtctgcactatgctctagccaaataatctatgtggactctgggagtctggagtcgaccgtccaaactccaaactcaaagccgtccgtaaagcaacaaaaggctcagggcaagtagtataatgtacatatgttgcctctaagagtgccacattagattgaatgatgaggtggaggagagaagtgaggagagagaagataagccacctctaaatcaagaggtaacctctacacaaatttcaaaaagaatgtgagagtattatagatattggtgtttgtgtacgggtgatacgttgtatgagttgtctcttaattcatgagtgaataaaatagataaatttagatgtggtaatcacatctaccgtagcacttgccctcgtaaagcgagcagcgggcccagttgcagggactgattcggaggagctcctttcctgatttctctagtccgccgaggcgccgacgaagaacgcgggcggcgaggaggcgcaaccgcgcgacggcgtagctcgcgcggccgcacggggcggcgtcctacctgcggccgcgcttatccccaaccctaacccgacatgtcggcgtcggatctccccgacgagctgtgggcgcgcgtgctggagctcggcgcgggcgcgggcgcggcctcctccgcgctggggttccgcgacctctgcgccctcgccatcgcctcccgccgcctccgccgcctctccctccacccctccctctggtccgcgctcctctcccgcgacttccccacccaatcgtcgcagccctcctccgcctcctcctcttcctctcagcagcagctccaccccaaatccgtctacaaaactaagtaagaactccctccctgtcccgattagctttcttctcgtgcgtgtgggggccggggtgaccggagttcttctgcaggttcgagaggcataaggtgcggatggcggaggcgaggcggcgggtggtgttcgaggcagagggccgcgtgttggcgtgccggaggcggctgacgcagctggaagagtcgttgcaggaggaaggggagaagatgaagaccgccgcgcaggagctggacaacctcgagagggtcaggtatgttttttttgtccaaaaccctatcttctcgtgtgccttatttgcttgatgctagagtacaacttagagaaagtagaatatgtaatacactatcctaaaaaaacatatttctgtgcatttgcgtagttcgtagtttggttctatgtgagcacataagaagatctatttctctgttttatttagataatggaattcattctggcctttgcttcaaacaagatgtattgcttttgcagcttgtccattaatctgttgattttcttgtttatgcaagagctggtctgagacctctacggtaaaaaaaaaagcagcccgtgttgtgtttttaaacggtagtaggtgaaccctgtttagttcatatgaattagttgttgcggttggtcatattaatccagttcaaaggcatttctgtctgattataaattcaaatcacttgcactgtcacattccagaacatagtaactcacacacaaaacaacatggctccaatctagagtcatccagggaatatttctttgtgcttcaacatggctgaagcatagctgctatagttaacttgggaatattcttggtgtttcaacatgctgaagcataactgctatagttattaggagtgtttctttgagcttcaacatggccgaagcataactgccaactgaaaggaaccgccccgaagttttataggagtacaggatagccaccaattgtgatgaatgataagaagtgtgttcaaacttgaatggttattatgttagataaattgagttacaggcgccaagtggcttttgagcaactgatcacaatctcacctgtaaaagaaccaccttttcttgtactttgcctccaatggaaagatggagtaaaacaatccagttgggccaatgggacaaatgactacctttgcatggaatccctccatcccagtggatggtacaccagtaacctgtacacaccttgcctgattagagaattttagcatttcttctattccagtctccagaatccagattacccacaggatacttgcataacatgaatgactacatacttttttttcttcattagtctatcaactggtttgttatattacagtatcatctttttccaagctctacagccattccttgattatgtgctatcatgggttctcgctactatattctcaattcattgtcatttgagttgtctacaggagagcttcagtggcattaaatgtatggcaaccacaagttgttcgtggacgtcaaaaacaattggttcaacagtgcacagttccagttgattcccgtcttagtgatgtaaacatggagctgaaagtttgtaagcaacaaatagcaacttataagaacatttatgtatgtgatcttggacttgactgcaattgtaatgattgacaatgctagccttactggaattgtgtttttgttgctattatcagaacaaggagaaggaaaaactgaatgagtatgaggaagcattgaagagagcaatatatcatccattgcagagtagccatacaagttcaattgccaatgagccacaagcaaagagaaagaaacgaaagtaagacatgcaagtttgcctgtgcaacctttcgtccgatcttcctttgtttgcaggtatctactaagaggcccaatcttgttaaaacggagcagtaatgtttttgcctgaattgctctcttgttttgttatttacatgcatatatacttattgttctattattgccatcattggagtggataacagttcataaggaagcatatgccaccttttctgaaagttcagttttgtgcttacatgatgcgattccaccgttccagattcgcacaacaaaggcaaagttctcctgatgtttttgtttctacgtgcaggtatgcatgccactgatataaccatggcaaatgcaaaaagactgaagagagaggaaaaaaggtcctctattggcctcttccttgccaggcaagttgataggaagctccattgatctttcccaaatgctgaaagaatctattctcatggtggtgtgtgtaccgtccagccgccagcggccagctgtttataccatagctgaatagtcagtgctgctggtgcctatctgtcattcacgaagctgtgggcggtcagctgttctagggcagcaggacgacatacatctgatcaaattgcttccgctgacctttgggttgaagagatatgcacatgaagcaaaccatgttccctttttttttaccttcagtttcaaaatgttagtatgcaattaattaagtacgtggaagcttgttttctgtaagctacttcgtatacaagtcaatcaactcttccgaattgtaccctccagcaaggttctgcctgtagaaatggaaggtcgtgattgttttgtacacataaaacataatttgcattgcaaactgaaatcttaaaagcaatgaaatctttaaagctgataagctccgtttatctccccatcatcagataacaacatcaagtctactttgcacacacgccagagacattgaatttcatgctcatcagctcatgcgtctgacgtggtgagcttagtgaggaaaaaaaaaacaggagacgatgggaaacaaaagcacccctgtccgatcctatatttgttgcagttcattcatttcatcaccagttttccctggaccaaaaatccatcctccaaaaaactcaccgcggccgacgtggcgccgagcgccttccgccttccgtgccgcaccctcctgctgcgcctttgacccggccatccgttctctctagccccactgcgaggtggccccacctgtcatcgaggcagcctattaatacacacctcccctcccccgcgtccgagtcccagtcgcatatcccgccgcgtactgggaccaaggggaacgtgggccccacctgtcaggtgggccgtatataacgaccgcctcctcaccccggcctctcgccaccccagaagccaatccgcgcgaggcctcgccgtgatctcaattctcccccaaattcgcaaatcctccgcgtttcgtcgtcgccgttgccgtcgccgccgagcagggcggattcaaggggaagctccggtgagatccatccgcgaagcgcgttccctcgcggaaccctcgctcgccgggccggccgatctggtttgtgcgggggtggttgtggttgtggttgtggttgttgtttggtcgccggaatccgacgagttggagatctccgagggataggaatccgtagcgttgcgagcgccaggcgaggttacgatgcctgcggtgctcgccgcgttcgccagcctccgcgcggccgccgccatcgcctccgcggactcctccccctgctcccatctcctgaagcccccctcctccccgtgttttagtagtagtagtaatatttttagtagtagtaattatctttaacgattgcttccccatcgtcgcgcgctcacgcccctcggtcctcacttcgcgccgttcgcgttctcgtgttcgatttggttgtgctcgatccgatctctccctttcctgcttccgatcagaagcagtcggccttgttggaggtggtgattgctggttcttcgaggaaagaggtattaaaacgatcccaatttattgccattcgctgttattgatgttatggtgtttatttcattgaaatgtgcttctatttcaaattttgatcattagaatatagatttatgttctcactatttattgccttgtaattcacagcatgccaatattatagggcatattcttatatttacccttgtatttgatgggcaaataaatcttgtgcttgattttttgtagagatagaacaggatagacatttaagcagttaaatgccctgtttgtctatacctgtttcctcaaattaaatgaacttgctatttaagtcaaatatacgtttgcagtcatgaaaatggtcttataaagctgtgttaactaaattagatagtgtttcttgtcattataaccgcataaacagactctcatctaacattctaacttcaacccgttttcttttcggcagaaaatcatctcctgaatttggaattaagcttgtggatgggcggatctttggtggactctagcgccgaaggtgttagcagcagcttatgtctctgccacagcacctctgaaaaggcaggctttgagcatagctcatgtgctagctctggagatggaaattgtgaagctggaatagattttgggcaagatgatttggttgtcaatgaaattggaatggctattgctgaagtgatgcatgtctgcagtgatcatgatgatgatgaagggacagattcgggtgaagactttgatgaaaatgagggtctactttctctggaatcagattccactgatgatgtagtggatattgataatgaattggtcatatcgcctaccttttctagttgcaatgcatctgaatcatcaatcaacaaatcagactctggaaattcttccattaatgtaagtatttgactgcagccttgttcaacctaacttgttcaatataccttgccagttgtatttgttttagttgtgatatctacgcacctaatttgcaatagctactcagtttcttttagcatttttttaataagcacattaaaatctcactgccttcttatatcatgttgtcacttctgctttaagaattggatagcatcactggatgaacagtttcagttgttgtgctgaactgctgatgccacttgtatcatgtcccatcaaaatctattccacttgattttgagtttatttgaaatcatcaatgaccataagatctcagtgggctgtatgtgtttttttcttcccataaaagatggggccaaattgtgctttctaacatcacatatatgttcatgtgcagggcactccaccgttggtttctgcaatgaaaggaagccgtgcaaagttgggaatcgtcacaagtttgagtgtttcatgggcccctgatgtatatgatcctcctgttacttctgggtctcacactgtgaaggggcatcaaagaagttcaaggaagagccactacaaatacaagccggccaagagcagtagcagccgcagcagcagtggaagcaaaaaggacaggaagcattctcgccacagtagcagcagcagcagcagcagtaaccacaaaagagacaggaaaccttcctaccgcaacaccgttggtggtgtaagcgtcggcagcagcagcagcagcagaaatactgatgctagtgctgctcaatatcgtgatctgtacagcagcagtggcggcaacagaatcgacattgctgttcctcaatacagcaagctatctccgttggtgccgtctgagagtgcaacatatcgtaatgtgtacaacagcactagcggcagcagaactgaccctaccgttcctcattgtagcaagctatctccgctggtgacatctgagagtgcatcacttgcagggaccgttcctgtgctgaagacattggagccgatcaaacgcagctccagctgctgcaaggagcagcctttgagctttctgtcacgccagtttgtggctgcaaagtacaaggggatgttctcactatggagtcacaaccagctagcttcttaatcatctgttgatacatccaactcgtaagctgttggttatcaacaaaatgcaaaacttttaccgcttatgcctttattattttgatttgtgaccacgtgtcttgttctttgttacactgtttgctccgtttgttgaacatccgaagagatgttatcgaaagttgtcgctcgaagtatgtatgcatactcgagctcattatcttcccttatttatttgttcaatcggcacggttctgtttgaggctttgaacatcatttcatcggttcaattctgtccagtttatttcgtttacatttgttcgggtaaaactggtatcctagatgtttcaacatcaatccttctagccagaaggatgaggttgcgaagcacattaacattactgaaagtgtcatgactgctctaattcagcccgtaataaagagcaactggaaaaaggcatcccctgttatcgtttttcctctcaatttacataaaaaaaatattttcagaattatctgccctgttgttcagaattctaactaactcttgacatcaagacactttctatttattgtaaagttaacatcagaactgtggaaagcctcttttcttggctttctggtgtcttaaaacaggctgtcttgatctccaattaacggaaaatctgtcttgctgtgctgtagacgccaacaattgacattgtagttgcattaccagttagagcgggcagccatgaaccatgcctgaaacaaaaaaagatatggtccaatacgtggataacgtaaatatgcatgacattccacagttccgacctctggctctgaggctctgaacgatctttttaccttttggatgcaccatgtggtccatgtctatgtgattagtggcaatgctatgttaatgttttgaactgctatgttaatgcttttgccgtgacgtctacttggcataaagcaacaaacaaacactaaccaaacaatgaattgcgtacgtatccaactaaattaagtgtttaaaatgaccaacttgcataagttgtgtaatgcataatgcaaccaatgttgctattaatgtatggacaacaaaccatgataggcacgttttaacaaacaatagcaggaaagtagccttctccttttaggttctgttggttgcatagaacatctactccatcactaatatgatttctttcccgttcatagcagcactaagacaacgaacattgcataaaaaacaaagtaaaatcaagtggagttcaataccttgagaggttgtatacttgtatcagggcaagagggtccagtcagttccaggattcctttttatctggataccaaattatgctcagtgatcagtagtcattattgtttggtgatggactccaaagagtttcaacgccacatccctcacccccagctgtgggacaatattcaatcggttgaggaatcaccaaaagtccttgcaagaacaacttccctcaacaaatctatggaaacgaacacggtccctaacaatgatttctctatcatatgacttgcttactatttttgctacttcatggcaatctggacagaatctcaaattctttaccacccgaatgacgtgaggcgcttttgtcttcaacaaaccatatgcaatggctaacctttcactgtgctcacaaagtgcaacttctttttcctcttcaccaacatcatgaagcacggctgcagtccaaggcttgtggccagcacgtaccacacggtcagctatttccctcagtaacagtcttatctcctttatttcagggtgtgaatcatcactcaccacaaacttgtgaaggtaaccattaatttcaatcgaactacagccagcaacaacattaacattgttttccttcatctttttcctcatatagcttactctatcccactgggaattcgatgcgtacaaatttgagagtagaacatagttttctggattgcaaggttctaactcaaggagcttctttgatgctgattgcactatatcaaatctatttgagttcttactggcaacaagaagagtcctccaaattactgaatttggagggatagccatgccagtaacaaatgaatatgcttcatccaaaaggctagaacgacagaaaaggtcaaccatgcaaccatagttctccattgaaggtttgatacccaattcttgcatagtagaccaatatcgtcggccttcattcactaacccactgtgagcacaggctgacaacacacctataaaggtgacattgttaggcctcacctgacatatttgcagtttacaagaatttaattagagctattagaatggttatagacttaccatatatttgtaaagactgcatgaattctaccattttgttggaaactaagttgaacatgtgaactaatacatagaggacaatgtagaaaccctccctatttttcgcgaatgcaaaaccctccctatttcaaaccttcatgtagcaatgtcactatcccagaagatatcatgtatggaaccaacaaattttgcacccatgagctaagttttatggtagcatggtacaaaagacaaaatatatgctaaacaaagaacatgaattttaaggaactacatcattgcgaatataaattagtttcttttgacacccatatttaatgggttttacattttcacgtccaagtaaatgtatatgaaaaaatcatcaccaaaaccaattaacagtcactacagatacatcagtaaaacgatctttttaccttaagctctagcattcttgagaaaagcttcaaggcaacctctacaagaccatgtatcgccaatccaacgatcattgcactccatgcctttgtatctctctccgccattgcatcaaacactccctttgcccgctctatcaacccacactttgcatacatatcaattaatgctgtgctcagctcaagatcgactgtgatacctttcctatcgataaaagcatgcacccatctccccaaatcaagcgcccctgccttggcgcatgccgaaatgacactaaccatggtgacctcatccgggttcacatctgctgcctgcatctctcggaacagccccaaagcctcgttaaccatcccgaccctggagtacccgccgatcatggcactccacgcggccaaattcttgtccccaaccatgccatcgaacactgtcctggcgagcgcaacctcctcgcacttggcatagaggttaagcagcccggtctgcacgtaggggctcggttcaagcccccggcggaaagcctgcgaatgcagctgccggccctccccgagagccggcacgacggagcacgccttgagcgcgaacgcgagcgtgaaggagttggggagcggggacccggcgcgcagcattcggcggtagaccaggacggtgtccgcggccggggcggcgccggcggcggaggagagcgcgcggatgagggagttgtagcagaaggcggtcggctcggggatttggtcgaacaggttgcgggcgtaggatggcgcggcgccgcaggaggaggaggaggaggaggaggaggaggcgaggagcttggagagcgcgaaggcggctgtgaggcgagggaggcggagcctgatgaggcgcgcgtgtgcggcgcggagcgcgaggaggcccgggcagcatcggcggacgagcgcgacgacgtgggcctcgaggaggtggcgcgggagcgaggcggcctcgcccggtttgagctgctggtggtgcatgcgctgcgcgtacgcgtggggatcggcacgcgcggcaaagtagacgacgccgcgacggctcggtagtagcagctacactaccaccgcggcgtgtgctcgtgccgtcgtgccgcgctgagagatgaatcaccgggcaccggcacaccgcgtccgttgggctcggtcggcctcggcggcggcatgcggcgaagaggagtgggccgcatgtttgcatggctgtggttgggggctgggatacgggccgtgggctgctgcgactgtggacgcgcgaggaagagtgacaacatcgtgggaataagtatccactgtacacccctcatcttttcatcgagtttacatagtatccataaaccgcactactgaaaatcttaaccctataacttacaaaatcgggttaaattagatcttattgcggtatgaattgatttcgctgatataacatcctaatcaacatgagatagatctacgtgaaagtggccacatcaaatttctacttcccctcatcgtcctcctcttcccaagtagctcgccgacggggtaaggggcggcggccggtgagcttatatcagtttttaaccccccatggtttttcactgtgattaccactgggtaacggtgatactcctattcatcaaaacggtaaaggaaacccggctaaaccggggctgatccgccactttgcgggaacacgatgctcccccacgtcgaaacagcgcgtccccaacccaacccaaaaaacaattccccccctccctgacatgcgtcctactcct

SEQ ID NO: 67716 - DNA, 529 bp, Oryza sativa
aattattacttgccaactaaaacttgataatggtgggttgtgagcacatggttttgagagtcgtgctcatgacaattaaggaccggttcgcgagctactattgtgaaacattaatcatgccaaccacaagccagcgtgggcaacggctttacctttcgtatagcatggttcattgcagagcaccagactgagaagtggcggagataagcccacgggggttgctggggagtccatgcctctggtttttgagggggtgattatgatccaggaaaggtgcactgtggtgggttgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatactggtaataatttgtttagctc

SEQ ID NO: 67717 - DNA, 507 bp, Oryza sativa
tatataatagtaacaggaagcttagtacgtggcctttttttttccatttgactataggtctgctactatgcttcctttctctagatcctttcccaagacctgaaccctgacctgggtcatcttttactgtccaatcctcactctagatccgacgttatctattgaatgcatgttgcatccaacggctctgattattctgatgacgtggcaaattgtgatgatgagaccacttatggagaaaccatctttactcccggttggaaacccccatttaatcccggttttccaaccggaagtaaggatccaggactaaagatgtctctgttaaaataaccgggactaaagatacatctttagtcccagttggtaccaacaactgggactaaagagaggggatctttagtcccggttgatgttaccaaccgggactaaagagacaatagcggcagtaccagatggtcgccttttctttttcttttttcctttttattttctctcgaatcaagt

SEQ ID NO: 67718 - DNA, 1853 bp, Oryza sativa
gccatagtggaatctttgctgttactctttctttctacagggtcacgtactcacttcagtgttcagtcttcagatgttgtacaagagaagcatttgtttttctcagcaacgttacaaacgctcgggcctcggtattattgtccctcctccgagacggttgctgtattcatacacaccgtgccatttgctgacttgcaaccggagctagagaaatggctttgcttgtgcctacgacgaatgcaaacagttggatcgatcgtttgatcgcgcaggatgagcacgcgcgcgcgagatggatctgcgcatcgtgggatcgatggtgatgagctttggggggtgagggtcttcgtggatgaggtgaacaccttcctccactgtggaccaagcaccggtggtctccctcgctgtactctcgcttgccacggtgaacccctctctccttgtgcttctgatcgcaccgagtgctaggcctcctccgtgctcgctgcctgcaatgggcccgttcctcctcactgtcatgccaccgccgccgctgcgtagaagaggcacgagcagggtacgacttaccgtaccacggttattagccttaccgcgggggtacggtaatataaataccacggtaacctccttaaatttaaataaatttaaaaaataatttgaatttttgataaattttgtacggtttcgtacggtttttcgcggttaccgcgcggtaaccgtgcttaccgccggagcgcaataaccccgcccccgacggtttgggaaaccctgggcacgagaggccgggccagccagtgaaaaaacatgggggagagagagagtagggtagagaaggaagaagagagatggaatttgatgactagcatgccaagggggcctaatggacgatcgatcgccagggcgatcgcccagcgatcggtccaccccccctgcccccgctcctttttcttcttcctcctccctttcttctcttcctattacagtacaccaaattttttttaaaagaataaaaagttagaaaaatttatgtataaaaaatttgaattcaaattcaaatttgaattcaaattcaaatttgaattcaaattcaaatttgaatcgggtaattttaggtgtataaactttagatgtatagaaatactatatatagaaaatatttgaattgttatattctggatggaggtagtaacaatcatataatatgattattgtattattttttaaaaaaaataattgattttgaaattacatgcacaagtggatgctatactaagtttgtcacaattcaccgtactttttatgccacgcttgcgagccacaacttagctagtaaaattaaattgtaccacactttgatgagttgatgacatgtgggacccaaatagatgagaagtaatcttgccacaagtgtggctataaaccaaataataggctaacttggtcaaacttgactaacctaagatgtggtaatctttggtaaactttaggagcaaaccaaacatcttttcactcaaggaacaaaaactcatctccgttcgagatcaagagatcaagtggcacttgattgaggagaagaattccaagaagttgagcagatctgcaagagcggcggcacatgcaagaatgcagaaggccgggtcccctgtggaacacatcaaggctaggcaaggacagacaggcaccggtaaaggtcaaatcgacgcgagcgcgcgttgccgtgcgggctgcgggctacggccggagcccggagcggatggccgtaggtggtgacattggctgtcctgcactcctgctactgctagggtgagggtgggggagcgctctgggaccaaccccgttggttcaaaaaaaat

SEQ ID NO: 67719 - DNA, 1821 bp, Oryza sativa
aaattgtgtaattggtttttttccccacatttaatattttattcatgtgttcaactatttgatgtgacgtttttagtcaatttttttttaatttaaacaaggactctatttagattcattttagatagagttatatctttaaaaatatctagctctaaaaataaatttagacaacaaagatacatgtgtgtttagatttattgtagatttaaaattttttggacagtaataatagactagttattttctttttaaacggaaagggtagagttctagtactagtctacgagacgttttggatgcacttcggctccaccgcccaaatccaccccgagatctagcgcgcccttccatccaacgacccgcgccccaaccccagacatgccgatgactcctccgtccagtcctcctcggccatggcctatggattccaacggtcctactcctaccaagctgtggactgtggagtgcagtagatcagctcatcatcaatcatatccatgggccatggccctcgttgattgagcttctttttccttcgccagaaaaggcatgtaaagaaaatgggacgctatcggttagagcaagttcaatagtatagctaaactaatagctcatttatacaatagttacatattacactattaatatctggtctcatctgtcatacacactgtatcttggaattcgtgctacagctagctacaaatctgtagcccgctgcccttctctcttctcatttatcttcttaaaatatatttgcagctggcttatagactgctattgtacctgctcttaaggtcacacgatccatgcacgccatacttatactcccatggtaaacttgcgtatgtactgtgtctgtactgtactgtactagtgtctactagcatacttactattgtagaacggcatgttatgtatactcgtgcttggagcccatccctcgtactccctccgtttccttccgttttgtcggagggtgaactcctcaaacgagggaccgtggagcccctttccggttcggaccggggacacgggtgaaagatcgaggatcaatgaggaaaagagagggggatcgggcccctcaggaggatcgggcccctcaggagtgatggaaaatgcagatggtttagacatattcgggccgtttctgtatgtggttgatcttggtggaaggaatacaagagttttttgtttttttgggattcgtcccccactccactgggcatggatctccttttatatcttaaggggttaccacaaagacccaaaacctagctttaagagtaaggaaaacattctttatagacaattaatgcgtaacttgtcttcggacgtgcagaaccatgcgcgccttaccgcagtatgggcacgtcccaccacaccgaacgacacgggcggacacccgcatcattccttctttgactaacgacgacttcctcccgtccgttcccaccggtcagccatgaccactttgaatggaccggtacgaggggatttggtctggatccaaacttaagacaaaaagcccatcattaatggcaatttagacggagcatggcgcaggccatgctccctgacagcagtaggcgcacgcgcgaggcgctctgcccgcgatcacatcaatcattccgactttgggcgggcgagtagtgcgcctacatgccgcatttaatgcgacctgtcgcgccaactcctctaataaatgcagtgggttggcgttggacacgcccgcccaaaccatgcacgcgtggccgtgcatggagggggtcggggcggcccgacccctttcgtggggtacaaccaacacggggtgca

SEQ ID NO: 67720 - DNA, 1065 bp, Oryza sativa
atttaacctgctttgcgtgcacgacgtccaggtatcagtgccagatgtttgccattcgcatgatcgctggttttgttcgaccgcgggggctgcatggtgtttcagtggtgatgtggttcgacataacgaaactgacgtgactcggggtggtgtttgaaccaggttctagaaggagtacgatcttagcgtagccacgtaggattgttcccgatcccgtcgatcgaatcgccaccgttggttctactgggccagaagtggcggacagtaggctcagtgattctccgcctccagtaggcccagccaccatcaatccccacgtcgaattaaaatggaataagttcatcgagcatccctcaactttgcatctgagtatgtatgacatgcctaatccccaataccataaatctccacccctaaactatataaaaccatacaaatgagatcctataggaatatagatatctggttttactgacgtggcatactagtcagcaaaataaaaaaaatatgggatccacatgtaagtgagtaatgtggggttcgcatatctttcttctctcttctcttctccgattggatcccgccgccgaccggtccgaaccccaaccgcctgcctagcaccgtctcctccagtgggcctccccctggatcctggggcatccccatccgccattgctaccgtcagggggatgaggcccacgccgcccgacgacctcaaggcccgacgcaccgtccgccaccggtcgcccccacaacgtcagccaccttcagctcctctctgactgtcatcgacgtccgccggtgccatcctttgctctacaccatcgtccatcggcaccatcccgccaccaggggtctcaacttcgccgacacggcgccccaccaccgggctcatccgctgcgctcctccctaggccaccagtgcactcttccccagccccgcctccactagtccactggcgtccgctgtcaaggctgctacctgcgtcgatccagactcagatccgagtcgacgtcgccgtgaacctgggagggagaggcggctggccgtactggtgggagagg

SEQ ID NO: 67721 - DNA, 3829 bp, Oryza sativa
tttcccgttttaatatgccatgaacagttgatggctgtactttcactactttcccgtttcaataagggcatgtacaaaggtagagtcaaatagaagctctatatcatgtagacactagtatcctacaatagttagagataatatggtctctaatcattaatgtatctaaatattttttcttactcttctttcctttctttcaccaccatgcaacaaaatttgttctaataaatgctaagagtcgactctgagctgttgtcatgcataacaaccatactcctttatctttcttttatatcatcaaatttacttatatggtaatagagagaccactaataaagattgttgtacctgtgctaaggcatgaatagtttgagcctgaattagggattgccgcgttccaacaggcagaaatcttcgtcaaacattgtgacccggatcacgtggatcacatcgctcgcccctgaaaaatactgttatcgtcatcgacgccctgcgtgcacggtgcacccgctctaatcgctaatcctcgcggtccatctgtactgtacgcttatcttgtcataacactgacatctctctcacgaatcgcctaaactaatgatcaatcagttatcacacaatgtcaccatgtgaatgtgcagtacaacacgtacgtccctcttcattccttgacttcttctcgtaagttaagatatgccgcttctttgcgttcacaaggacaaggtgactatgcttgcacgactttccatgccacggcaacaaggatcaaacagtagtcagcaaaaatacgggtctataaatacacgacgtctctccgctggcttacacacaacaacatatcgcaagatcgatggcgacgacgaattgcctcctcgcgctcgcaatcgcgggcctcgtgcttgtctccctcccaggactctcgcgcggcgacgtcgacgctcgccgcggccgcgagctggcgggcgggtgcaacccgagcggcacgctccgcccgagcaggagccactcgtgccaggactgctgcaaggccggccggtcctacccgacgtacgcttgctccccggcgaccaccgggagcaccaaggcggtgatgacgctgaacgacttcgaagccggcggcgacggcggcgacccgtcggagtgcgacggcaagttccacaagaacacggagcgcgtggtggcgctgtccacggggtggtacgccaacggcaggcgctgcaacaagaacatccggatcaacgccaacggcaggtccgtgctcgccaaggtcgtcgacgagtgcgactccctgcacggctgcgacaaggagcacgcctaccagccgccgtgccgccccaacgtcgtcgacgcgtcgcaggccgtgtgggacgcgctccgcatcaccggcgaagacgtcggcgagtacgatatcacttggtcggacgcatgagatcgaccggtccgtgatactgttccaaatccaaactttttcatcatatcatcgacgaagagatcgtgtagcgtactcgggtggattaaagtcttaataacgagtacggtcacatccgaaaggaataaatattacaacgtttaataaaggacatgggcattgctacaaaaagagccctaccatggacttccgagaagcaccaccgtgcactagggtgtccacacatttcagccttaagattactggattattttttttttacctttgaggtcttttttaaaaatttatttacaagcaaactcttgaaaaaacatattccatgaatgaaacattttcatgatgccagcgtcattggtgtcatagtccaacctaacagtgctaatgatgttggcgttatccccctcgcacccctgcagaccgcacaagaccagaagctaagtcactaacatgaaggaggtcggcaccaatgtcaatggcgctaagggcctatctgtaaaaaaaattacattggcggtaagaacctataagtaaaaaaattaaaaatgatctaattttaattaaaaatatctacaaatatatcctcaataccaatgacactaacactaagggtgtgtttggttgggcttttcaacaaacttttgcttttgcaaaagccaaaaatcaaccaaagggtccaaaagtcactgctgcttttacccaaagccagcttttggtgtagtacaaatcaaaagcagccctccccttgctttcagctgcttttgagagaaaaaattacccacctttgccattacacaaaaacgattcgcttgtttttttttctttctcccatcggcatagctcctcctcctcctcacttcgccgtcgccgtcactcctcctcgccctgccgccgccgctcctcctcgacgagacgtcgccgccgccgccgccgctactctcgtcctgcgctggcccagatccgccgacgaggaggtgtaggaggaggaggaagaggagtacgaaggggaggaggaaatgaaggacgaggtgccggtgtccccgccgccgcctgaggccgactacaccaccgcccgtgtcaacctcccctctgccgccgccgaggacttctccgccaccgctgatgtgaccatcaagcatatgcatgcatccaagcatgagaaatataaaacatgaccaaagaattcatcgagtgaatggaggatctacaagatatcaaaattcaatgagttttggaatccagttcggccttcggagacagcactgacttcaaacggacctagcgccttcatgccaactccgatttgggtgatcttagacttcgtggaaagcttatctcgttacctttcaaacgcatccggtctcatgtccaaattcatcttgagtcaacgggaatcgccaaaacaagacagtgttattaccgaaaccgaacttgggccttgggccttgtaatagactaggcccatctcggaagtgtctccctccacctccacgaattagcacttaaccctagctttattttcctctataaatagctttgtacatcctcaaaaacatttgggttttgtttagttgaattttaccaagtgccattcaccttgtctctagtcctcgttcgattagtcggcgactattgattcagagcccccaatagttggtgtgttgatttgccgggtcgattagatctaccacttcaatcgcaactatttctttgtgctaattacctattcgcaatatttagattgcatcttatcttgttcttgcaatgttctctcgtttgcattgcagggatcatcacccgcgcgtcatggttggtacgacatcgtttgtggtgtagcgattgcatggcgtcctggacttgttctggttggtagccacgtcgtaaacgtcgcactcaatcaaagcgagagttatcccctcaccagaagatcgggccacaagagagagcgtcatcagttggtatcagatggtatcagagtatcggttgcctggtgaggattttagttttatatatttattttccctacccattatctacaaattgccacaccactttttccttcaccaaacattagttttgagccttgcaattgttattcaattttgctttattgagttttggtccactgttgtgtcaagtgctggttttagttctagtttcgtcttggtttgagttttgcatcttggttgtgcattgcctgtgcgttcgagcagtggcggaaccaggatcttcggacgactagggcccaaattaaaggctaaaacttgccatgacaaatgtgcaacaaccacatttggttctagcacaatacgatcttgcttattgttactagccatggtttctgctgaattaggcattgggatggagtcattggtttcttccgtttcctgagttgccgga

SEQ ID NO: 67722 - DNA, 723 bp, Oryza sativa
aatctaattgagtaatgtgatgtactaaagcagtaaagctataggtttgagatttcagattcgagacctgagaaaggaagaagaaagagaacaaaaaaaaaaccactgaccttccactcccgcacgaccgcaagccaccgccgcacgccgttcgccgccaccacacgcccgcacgccgccgccaccacaagcccgcacgtcgccaccctccgttcgccgccgccaccacaagcccgcacgccgccgccgccgccgcacgacccgtacgcctgcagcctgcaggccgccacctcgcgcagccacgccgcacgccgccgccacacggcccgcacgctgcagcctgcaggccgccgcctcgcgcagccgcgcccccgccgccgcacgtcgcctcgcgcctccccgccatccgccgccctatcgagcgtcgccgcgcctcctgtagggagagatcgaagagagaccaagagacggagagaggcaaagagagagagagcatgattcggattcagtcggcactcggcactgcaggctagggttttcactggttagtgggctaatgggcttcggcgtttgctatttcgtgggctgttcggtggagaaggcgttttttttggaaggccgagtgtagggccggcctgcatacgagtggggctgggccagaatatatgaaaaaatcggaaaaatcacaaggtataggtattaattttttttttcacgagtagc

SEQ ID NO: 67723 - DNA, 525 bp, Oryza sativa
ctgcagcccctcggcaggcggcggcggcccatcgtatcgggaaaccggagccccccagccagccaccaaatcgacaagactcgtagtcccccccctcgtgcgctccccgtcccggcattgccgccgctgtctccgaggagtggaggtagacgcgccgccgtttgtcgatcggatccttgcttttgcttgcggttgcgggcgggggtttggggtggcaatgggcgccgcggcgggggatggacgggaggaggaaggggtgatggcgacggacttcttctggtcgtacacggacgagccgcacgcgacgcggcgcagggagatcctggccaagcatccccagatcaaggagctcttcggcccggacccgctcgcctttctcaaggtggccgtaacgatctctcttctctcttgctaagtgtatctctctgtcactctctttttgtgatctgccttgttctaggtgaaattttgatgcaatgcgcgcgtcgtaaattgcttgcttgctcggacgacgtgctcctcgcg

SEQ ID NO: 67724 - DNA, 1071 bp, Oryza sativa
attatacatggtatctatctattttactcactaattaagccacaactcacgcccgctgattcctatctattttattactagtattatgccaggtccctctgattcctatccattttataagtagttaatttgctccaaatatatatatagtacagtagtatatacttgtgttttttttacctggggcacgtgtaatacaatctagagattatttggaacttgggattttttatagtaattagtttaagactcataaagtttatgtaaatatcaaacattaaaaagtatccactactgaaaaaacgatttttttttacgagagccccctatgggttgcaaacgtaccgtaactggcgacatctgcaaaaatcaaccttcattatcgcatacgactccttaagagacctcatgttcagtcttgcggggggtgcgcacgactctaccgcgcgcgtcgttcgctgcccccctctccacgcgcgccacctgttcagtcttgcggggaggtgctgacgactagttgtgatttagccattccaggttgcatcggcatccatagccgaaggttgaagacggcggtgggctatacgaactgggtctgtagctctactaggctgggctggatcgaagagagacagtttgaacagagggaggcaacagactgggttgagactaaaaagaaggaaagaataggcggcccaaaaccaaggaccaattttcattaaccttttcaaactatctattaacttattaaaagaatagaaaaaggagcctctgtgttcgctctcacgacctagaaattctcatattaatcggagaaaaaaacagaatccatattgaaatacaatttagaaatagttgaaattcagaattaaaaatataaagaatattggaagaggagactagagtccatatagaaatacaatttataaataactggaattcgaaattcaaaataaaggatatataacacagagtatagagtccatatagaaatacaattaagaaataatagaaatttggaattaaaaataaggaatattagaagtagagtatagagtccatataggaatt

SEQ ID NO: 67725 - DNA, 12251 bp, Oryza sativa
ccatcatttcgtggaccacttcaacagcaactggtatgttttatcaatgattcaaggttctttgctctgcaagctttcctgatttgttctacaacagtttgattttgattgagaacaagcatatacattttttctgttacttcccaacttatgacagatagttttatcctttttattcctggtatctagtttaccatgatattgttggctcattgctgaatggacaatttatgaaatttggaacctgttagaaagatgatgctagactggatttttttttatctgtatggattgctgagattattaatgcacacagacagaatggtcttgtaattttgcatgtaagccttttagttattttgcttgttaatcttgttatagtctgtattcacctacagtgagtacttttttctacaatctattggtttgggactttgggcacaaatgatgatgcctgtcgtggggcgctacctggagccttattatgtcagttttctaaatggtttgttttgctttttaactgttcttttgaattttgtttcaggacatcgtgccatctcagcctgcaaaatcaacaaatccatttgacatggcatttgagtctgatgttgaagccagtaacatggtgtgtattaattatactatgatgtggtttgtggtcatgataattataatatggattctagcttttttttaatggatataatcatattttaagacatttggaataaacaactaggaccaattatctaatactctagagacatttatttgcgatctttgtttttagacatgttaacaatagcttagttggttccatgctgcaaacttctatttttcttttgttgtttctttattcactatttctttctgtccttttcagttcatggatctgacctcgctgcaagaaacgttgccaaatccccatgtcaatacagattattccaacttgactgagtcatggatacctcataattctaacatgccttatatttcctctgggccacagggtatctgatcctttatatctccatgatcctcacgcacaagaacacaagcatactctactcttaatgctaatacaatatcggattctgttgttgtttcaggagggttatcatacatggcaacacaagtacaagactccctcatgctgtaagctcctttctaacaagttattgtagttagcattagggcttagtttctaaatgacctcctgtaacaggaactccgcacaagggtcatttccgcccagaaatccattcgaatgaatgctgatagtggtggacagataagcgaagcagtttgcaactgcgtggaacctaaatggaccatggggtagtcgggtgtaccacacgcatcgaagtatatttgtgtcaaatctgcacattgaagtgaatatatatatctcggatttcatactctctggtttcctgtatatgagaaaggagtgttcagaataccaaacaggcgggctggagttcttttttgcctgaagcaagctgccctttttcattgctgttaccctgtctgggaccctggtgaaacctgcgggtttgttctcacctggctgtcatttgaccttattggggtgtccttgttaaacccaattgtcattaaaaaaggtcgtagacgcatacccatcaaatgactagatcatttgcattctttggttcttcagcatgaacttgtgaaaatgtgttggttcaccgaatggacggattgttgcgaggtgttatttattgagaagtagtagtatattgcttttcttggtactacgttgaaactgtttatatataactaaaacttgtcattggccttgtttgtatcctccgggctattaaatagccctccggaatcttgctatttaggagtattaaacgtagattaccgataaaatcgattccataacccctggctattttgcgagacgaatctaatgatgtatattaatctctaattagcagctgattactgtagcatcactgtagcaaatcatggattaatatacctcgttagattcgtctcgcaaaatagtttaggggttatggaatgggttttgtcagtaatctacgtttaatactcctaaatgggttcagtaatatacgtttaatactattaaatagccctccggatcctatcagagccattgttcatcagttggctaatctgttgtgagatgttatgtccaggaagaaaaactgacgtgatttgtacgttggaactgggttccgtttgcgattcacaatcatttcattgcacttgctgcacatgattcctggcttccaggtccgcaggagcaaatctttcctgcgttcatgggatcggggatctgcatttcgggatagtgtcctctcgttggcacttgcaatgaccggaataaattctctataataattggtcatagcttctttgaagcaatgaccggaataaattctatgatctaaaaatatataagagataatctttacacgagtttaagaaaataaaacaaaataaaataaagtagattgatatagccaataaataaaataaaattcagggtatctgtgccagcgtaagaaagcaaatgcacgaaattggaggtatcgatgacatgttagagttgctctatagaggccatagacgacttcatctttgaaaagctatctgcatgttctctatatttgaccatgtaatttcggatccaatccaaaatgttgcagtagagaatgcaaacaaatttcaaaaaaaaaaaaaactagacaagggaagcaaacttcacccaaaaaaaaattgtagtcgcagtgccggtccagttttcgaagatgcttataggggtaggatttacgtgcgtgcgttttttaggggtgagtgtacatgtatagtgagtgtcttcttaaaaaaaagggaaaatattgatgaaaaaaagagaaaaatcggtgatgaaagcgtgcctgaagctgaaccaccagaccgtacgagcagaggaagccaggaaggaacaaaagctcgtctcctacggtcctaccctgccctggttggggttgtcctaaaaccctacctaaaatccccaccccgcttcctcctcccaacccctccccgacgccaccatgcgccccttccaccctccccgccccaacgccggccaaccccaccgcccgcgccccggcgaccccgccccgcctcccctccccatgcacccgggcttcaaccctccgcccgtccccaacctcgccgccgccaaccccatggccgccgcggcggcggccaaccctttcctcgcgatgcagctcttcggccaggcgcagcagctccagagcctcggcttcctcgccgccgccgcgctccagcagcaccatcaccagccgcagccgcaggcccccttcttccccgggggaggtttcccgccgaaccccaaccagttcggggccttccctgtccagcacgccgggttcaacggcggcggggcgtttcgacctggtggcgtgggcgtgggcgtggccggcccccgtactccccgcccgatgatgggcgcccctggtaatggttacaacagcggtggcggcagcggccatggtaccggagctggtgcgccgagacccatgctgaatggtggggggaacgatcggaatagcagtgctgggaagggcggtgaggtgaggaattattttgctgttgtgtattgaaatcgatagattgtctatgaacgaaaagtagtcttttagcctatacgatcattagggactgtgcaattcttatattgaggaaatatccacaattgcatattttaccagtatatatgtcatgcgatcatatcttgctgatattttttttcctggtgggttcatgggtattagtaagaccagttaagatcaacccatattatgtggtcagaagtatgatgtctcggtctctcagacttttagtacgcaaacgactcttgactacatctggatagtgtatgttcagcatgaaagatataactgaatttacttgtcatgctctctgtttctaacaattgcctgacctgatctatgatgagcacatgtcggctcgattccaaatgaccttctgttcttttctgcaatgttcgttgaacctttttgtactatatctgcaagttttgctcgtgcttctttatattttttcatattgatgtgcgtgaaatgttacctactaggttctttcggcatactatgactgagctattaggaaccgattagataatggccatatcatcagtaaaatctcatggatagacatggttttgcacctcattgtttattgcaattgtgtttcgttattgtacctattcaggtttggcttagcattgtattccaatttctgtttctctgcaacaggtaaaccacactaagatcaagccagatggcatccctcgttttacctctgaaaatggtgagaggaaaaatacaacagatcagaaagcccgattcaactctggaagagattgtagggatagcaggcaatttggcccatctggtggaaggggaaggggaaggggaaggtctttcaatcaaggtcgtggaggaggtagtgaatattgtatatatgccatatggttaagcatataggcaatacattgtatcaccttttgcttttggggacgcatactccttactgttgtcaagtgagcatgcagcatttcatgttttacttatcttgtttttatttgctgcaatggtttcataactctgtattattgaattgtgcacatgttttgatcatcttagctgcatgcaggataatgaatgcctttaatacatcatacctacaagattatcagtatttccagctaactgctgaattgatgtatcgcctgtcaggaaacaacaactggagagatgcaaaatccaacttcagaagcagtgacagtccaagtccagcatcaggacaacgccgcaatgacagtccagcatctggaggacaccggaagtatgtatactggacactagtttttttaattaaaaatattattgtaattggtaatctttttatgtgccttagatggtcacaattctggtttatctgtaataatgattatttagttattgcttctcccactcgtagcgctgaccgctaattattgcgtgtcaacaatgcattgctcaactagtacgcttatatttctgttccatctaacgagctgctgttctacatttctaaaccatgtcgatggtttccagaaaaaaaaagagttaattcagtgtgtaaatctagggaggaaacccatttactaaattacagggttgtacagaatgtcgtaaactttatggtcctttattacctgttagttgtggttttctggttcttgtcttgattttttttaaaaaatattcatggagtagtgatgtttttagtgtcaattgagtttgttcctgcaggcggcctcgtataatttatgatgcaaacgaagttaaacagtggcttgaagcacgcaagaagaactatcctacaagtgtcaacataaataaggtcaatgtttgtctttaaatacctctttttattaggcctcagcaactttatgtccacatcagactatcagagaagcatcatcaactgaccacttaatgcagaagttgtctgagagtcgaccagatggtgagaagaaggatgaagaggcccaaatgcgccgtcaggtaaagcaatctattgctatgattcatcatgcatcttctttaggttcaaagggagagggggttgatctagctttgaatggttctataagtacattttttttaacaaactaaatagaagcttttgccacagtattctgattgtgaacttttggggatgaattatttatgttggcaaatgtaagttgctcatgctcttacgtgtgattgttcattctcttgtgtatttcaggaactcaaggaagtattagaaaaacagaaagaattgggttttgaactccctgaactaccacctggctatctatctgaacatgaggatcaaggcaatggtaggagaagtaactggaaaacacaacgcagggattgtcgttttggaaaccgtgctgataacaaaagatcaaggtatgaccgcaatgattttcagtctaagagacccaaggtacggaaccaaactcattgtgatgatggggcagtgctcaagagcagggagccaaccctcttgcagaaacttcttagttcggatgtcaagagggacaggcataggcttctccacacgttcaaattcatggtccttaacaatttcttcagtgattatcctgataagcccttggagtttcctagtgttaaagtaaaccagatcgaacttgaaagcaacattgctgaagaggacctagatgacttgatgaacagcgagacggcaaaggacagcatccttgatttgaaggaaaatggtgatcagaaagactcgagctcaattgatggagaatcagacctcgatgacgacaatgatgatgaagatgaagaagatgatgatgatggcaatggccagtgctgagagcagcgacaaggatgagaacgaggacgtcgatgcagggcagatgtaatacgccgtttttttaaaacatgatggaagtaaacgactccagacgtctacacccaaaggtatactcaaccaaaatgtaatgcacctgaagtcagaggtgcaagtatccagcagggcacaggccaactgtgtttttggtgtatagttggcgttcacaaatgatatttatgtagctgcctttgaaattttgttatcagttgcatttgctattatgtgttttgctgtttggagaaagcacatgtgctccttagaggtggccacgtgttgtgtcaggagccgtgttatttcaggctgaaaccccagagtaaaagagggtcagggcaccaatggagaatggtacccagggcccaggctgggcaacctccaacataagcgtgacagttccttctctttaccggaaaagcggcagcaatacaatctttctcccttctgctctgaaacagaactccactcaactgatgagtgatgcacatcagcatatggcctcccaacacagcacaagtccagctagctacctcctgcactgcacggcgagccatctcttcctcacggtcacggcagcatgccatgcatgcaaccttcatcagttctaggctcacttctgccactacccagtctaccaccaccttcaatagccttcaccttcccaatgacggcccatcaatgctgccagcggaggcgagaagacagagacccagccttgtttgtttgggaaagcttgagattgagaagttaaggtggtgtttggttgaagggactaaagtggccctctcacaaaaatataagtccctactatagggacttatacttctgtgagagggactaaatttagtccctagttcccaaacaccccctaagggggtgtttagatggggctaaaactttttagcccatgtcacatcggatgtttggacgctaatttggagtattaaacataaactaataaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaaattagtatccaaatatccgatgtgacatgaacttggaataagtccctggaaacctaacaggccctaaaaatgttagcttttccctgactcttaattcattttctagattttagctagtttttgcttgtctcagtgtctctctctctatatattttaactttgttgcccctttgtgtcatctcagtttccactctaaaaaaagagattatgttagctattgatgtttaaggaagctaaaacttttctccccaaacaagagcttgcccagattccgctccgatctccctccaactgaatttccgagcagaatttaaggcccccgcgaaggcgctgtacccagttctttcccagtccccagtccccactcgcggccagactgtggcgccttgccgcccccgcattgatgccgcattcaaagtagacgcgcgcgcacacatggcagcagcgaccatcaatctatccgctcggctctggcctcgcaaccaatcgcccatgcacgcattcaagctgcggttttgccccggtcgggttcttctccctccctcctccgcgatattgctgcatgcggctagcgtggtggagtgggatcagtactactactgtgccacggctcggccgcattgaagagcgtccaggagtaggagtagccggtgtgatcctagctaataatcggcgatccagcgagtgaatgagagcaagtttaaccgtgtagcccactactagctccaattcatctatagccaatctaatagccaattcatacaatagttgcttactatactattaatatatggtcccacctgtcatacacacattatattttggagtccgcgctgtagctggctacagatttataactcactgctcttctctctcatcttttatcttattaaaatatatttatagctggctaatagcctgctattgtactgctctgagcgtgatacggaggacgagccggtcggcgagacagccagccaggcaggtctgggtcgatcggcaggacaggggtactggacccagccgggtggatttcgattaaattcaccgttggatttgaccacagtgacccgtgacgtctttgaagagtggatctctgattctgtgtgtagtgtgttgggagatttcttcttcacttgctattggttcagtataaatgtataatgtactaacaacagtagtagcaagtttgatgaagcctgaaagacatcacagcactacagctagatttgtaccactgcgggccactcgggagaacgtacgcacgctagaattttttctggtatctacagaaatggaactgattccgtatagtagtagaaatgtagcatgagaattctaaccgggcgcgtacaaaatcgcagtcgtgctcgtctcatcccgctgtatataagcaggcgactcctgtgtacccgcgcacacgcaaaccatttgcatttgagccttttgcttgccttctctcctgtcctgactgcagcgagagatcagtagggagagggcaatggcattgacggtgcggctgcacacggcggtggcggcggtggccgtggccgtggtggtggcgatggggatggcggcggcgcagatgtcgccggcgggggcgccggcgccggcgggcgggatcagcccggcgtgcatggacgcggtgctcaacatgtcggactgcctgacgtacgtgatgaacgggagcacggcgcggaagcccgacgagccgtgctgcccggagctggcggggctgctcgagtccaagcccgtctgcctctgccagctgctcgccggcggcgccagctcgtacgacatcagcgtcgactacaagcgcgccatggcgctcccgggcatctgcggcctcgccgcgccgcccgtcaccgcatgcgcgcgtacgcacaattactccatcgcctctcttttgctcctcccttttttagttcgcttgcaagggtttaattctgcctagcatagttgcaaaccgtggattttgacgaatagtagaacgtttacttgcgtattactagtactagtaatgtttttttgggaatactcaaaagatttgcgcatctttgtatgaagagaataattacagctgaacgagaacacagaaaaaataattaatactccctccatctacttttttttgatagtcatattttatcttggcacacagaccaaggataagtaattctacttatcatccatataaacatgctactagtcattccttataaacaagcgattcactgatatttacgtttctcaatgcgcatgtagccaatcatgtgtgtaagaatggagagtcatgcattaaatccgagaaagtcattaaaatgataggttgttgaagtgaaatatgcttatcaaaaataaaatttttagatttggaaatatgactatcaaaataaatggagagaggactattaatactagcaatgtgcgtgacacaacaccaaaagttagaaaggagaacaacttaaactgcatctgttctttgttcacatcagtctgtagctagctaggtagcttagctagtggaaatgtgatcaccctaatggtttattaccctgtccaaagctccaaatatcatttcactaaccccaacagtatatcttaccattccattcatcgaattttactgttttaaagaccgtataaaattaacttttggttacacacaaaatgcagttcttggagtacctgtgcctatggcgccttctgcatcgccgatggcaggcctcgggccatctactgaaccacaaatgcctggtaagtactactgctcatgtgctttcttggttcagtttcatatcatatatgtatattctgagtatccaggctcaagaaaattctaaacagctcatgataattaattgtgctataacaaacaataaacggagagaaaattggcatgttcttaacttattttagctgcatatatatctagatccttctgtccatggtagcacggtacagtacagcatataatagttccactaagtatccattagtgctcataatttttttttgaacggaacggaagtgctcataatttctcagctgattttgcttacggaagttctgtagttgagcagtgtcattgtaggctactacagtgctagggatcctgagtcctgacgagtcagcctgtcactagtcacacatttgcttgatcagctaaactctgcttctggcgatgcatttctgcagagaaatcgccgtcggcctcgccgtccgagtcgagtaaccatgctcccggccgcttcaccgccctcgccgcggtggtcctcgccgttgcagccgccgggatggtttagaaaatgcctggattttcggccgatcgatctcaagatttagcccgacgattcttgtttattcttgccacacatttggctgtgtattaatttacaacacgttacagtacgtatgcgcaatgaacgatatttttctgctttgctttaaattcttataattaactagtaactcttccttgtcgtaagttgctagagcatatggtgagactatatgtacacacgtagtgatatctggccatccgcagtagctacttggggccttctgttaattattttcagtgtttaaatgcttggtttttggaggcgaggtggagaggatttttggaaagatgtgagctggagatgatcaaagtgtggggaaaaaaagcattggattcgccggtcggcaatacacggcggccggccccgatcggccgtaaggcgctgtaggttcatgaatgctaagattccgatcccttcattcaatcgcttcccaactgtttgagaaattttggttgcgtctcctcgtggcgggccatgtgatttccggttgctcctctccctcccgtgcgtgtatgtagggacgacgcacggcacgggggctggatggatcacgggatcaagcggatgaggcgcttgtgatctcgcaacaaagagctctaccaagccgtacgtccgtcgctagccatcgtgccatgccatcatgtgttccgggatccaaaacatgtcgacgccgccgaccgtacgtcgcgatgcgctcgatcgctgcgggcacatgtgtcgctgccagcttctgctcgatcatgtccgcccagcacatgccccggcccgttcgcgcctcggcttcgtgcgactgttcgtgggcacccgctcgttcgacgcagacgctgaggcggcggcgagctccgcactggactccgcgggagcgccgaagcgtcgtccgcgcctccaccatccggttgcagatgctggcaggctgaccgctgacggcggcaactcgacctgctcacatgctgctgaggccgcacaccgccaggacacccaccgtacgaactactccctcaatctcaatatacagtaacctaagataaatttaattttattctagaattataaatctgaacattagatttatagttttatgatgaatctaatcgtatcctaggttgttacatattaggaagttgaaaacgatataattcctgtggaaacaattctcgattggtccgtcagaaattcttggttcttcatgttcatcaatttaacgatttagcgacaacaggacaataacaaattaaaaaaaaatcaatat

SEQ ID NO: 67726 - DNA, 5050 bp, Oryza sativa
tgcttctaggcgcagctcctgctcatcgttagcatgcattatggcatcatgattgattcactctttctcatagaaaaaaaagatggacatcagcactaaatcactttgattgaatcgaagcaaacagatcctcaaaagataatccaaaaccagaaacaaaaatgcctatactgattattagaaatcttatacgaaacctgatcgagtaccaggacctagtatcaaatggatgttggctagtgataaagcatacttgttaataatttacagaaacaaccgaaaatttcctcgcattcatttaatttgatcaaacaaataaatcaaacattgatcttatagcaaagtgaaaggaataagattattctctctaaaagactgtctcccaatgcagcctgtcaaaaacaatgaaaaaacaaaacagataagaactgaccatgctaagttctacccaaaaaacaaaaaacttgatcaaaatattcatccacctaaatagcataagtgcattatgcaacttctaagcaatcaattttctcaaatacaagaaacatgagtgctattttagaacattaattactaacgaaaataattgcacctattccattcgaagccaaatagcattgcatctagagtacggactttaactttttaagaaaactgatcgatttaccaatataattctgcatcaaaagggcaaataaatacacatagcaacgagtgttttactgaaataaaagaaccatagcacgccttgtgtaaaactttgaagtctttttaaagttgtgttgcaacataaagagtgatcagtgaaacaagacttgttggtgatcgcatctaggttctgaacatttctgtgctctctgaattagtttgaacagttatgaacttgtccatttatctgatgcttgaacggttccaaaatccatcacgatctttgcttgtctagagtgttacctgggacttagcaatatttccaaaatcctgtgcgcttgtcgtccaaactgaagtacctggtgttgcccgggttggcgaagcccttgccgttcttccgggtggtgttgttgaggtagctgtggatgcaactgacacaacattcatcaatggtttaccagttgtgcaacctacagttaaagaagtagcagggatcgatcttcaatgttcaaaaacatttaccaagttcaaaaatcttgtgtctaataagttttggaaagctgcttgattttatattttacaccccaaagttcgggaaccacattgaccacatctttattacatggtgtctcagaagcactgatccattctctgtgctatttatctagctaagagaataattcaagttatgttacaaatgcatgacagtaacaaaaaacaatgaaattggcaagcatgatcataaccaatgagtttttagctgtagcttatgttcaataaatttggcaagcatgattataaccaatgagttcaacggaaaaaagataacttcaaaaaagcaaagtgctaatgtctagcgctgcctccaccagaggcccgactggagaatactttttccttttttagataaacatggagaggatatatataggcagggatgaactgtacaatatggttgaaacaaacaaatgaaacgtcaaaagtgaatactaagttcctgcatgggcaatcagaaaaaagaaattaaaatgctggtactagtcagaaaatgcttgcctaatatcaaatccaagtagtgggttcagttacttctcgatatctcaaagcaaataacaaattaagcattctgttgttataactttttcacgtgcacactccataccaggttcccataacaaactttgcaccaaattttttggagctcgtaatctgacaaatgagaaaagaacgaattgtgaaggaagtattaccaggacatgcttcaatatatatatggaattgaaagttgggaaagaacgaattgttgcggtcctccagtcaataccaaatgtttgtattccagtatgtacaatctgtcatctacatgttcttgtttcagatttgtttctttcctacaaaaagaaccagctagccataccagaaggttttaaaaagacatgggagacatttcccatcaatcaaatttgcatgtcttatctgaatgaaattaacgtttgcagtatgctacactaacaaaacattgctacggtcagcttcagctaaaattactggcagttattcttcagcacccatgtttcagattttgcgcctctttgcgacaatgctatttccttcagcatatttacaaagaaaaggacagtcatttttacaaataaaaattgaggaaaatcatttgactcaaggatcagaattattgcttacatgaatccctgagcatcataaaatacttttcaaaatgtaggattcttcatctacctgatcaaaactatgctgctatggtctatttttccctgtccatgccaggacgaatttggttcagtctcaacggttgtctgcaactctgcacatacctgatcttgttgctagttatttgcaactttggtaatcacatcttcagacaattggctgaaaatattggatgttccagccaaatctttaccgtcatagtcttgcagcgtaaattaattcagatataagtgcaaattttacagagaaatttactattaaaaacaaaactacatacaagccaaaattcagtgaacaaatgacaaagcattactaatactatgctaaccatagtatctgcagagtaagatcaaaattattcatctgccaagtcatctctgaccggcatccagtcgaaacttggaaatgcagtcggttagaagttttgcgtcttaaggcgaaattgctagcagtaagggcatatcaacacagcaagtatctcctctcatctcctaccctatcttaatgttttaagactttatttaagcttctcttggcttaagacaaggaattgaaaaacgattcaacagaaaaaaaaaagttcatccaaattcaccttatttaagcttctcttggcttaagacaaggaattaaaaaacgattcaacagaaataaaaatttcatccaaattttaaaaaagctaagcgctagtgtctagcgctgccttccaccagaggcccgactgcatgcatatgccgtatttgacaacttaccgttgccgtattgacatcttaacgtggatgcagctaaccggcagggggtcgcctgccgtgccccataacgggaggggatcttttcactgctcctttatctttttttttttacagccattaaccggaaggggatacacacccagccgatgcccacatttgggatcttttcgctgtattcggtcggggtgggtgcctctggggaggcgatggagtagaatcgaaccgcgttgataaacaggtcgctcgctctcaaaattggcgatgtgggacaaaactcgatagctggacgcgattcagtccgagagcctacagacgccgcgcagaccctacctagggagtagaggcggggcatacctggtggtcttcgctgaagccggcggcgagcgcgccgtcgacctggccggagctgaagcttcccaccgcccggccgccgccgccgatgccacggagactacgccagcgggatccagatcctcctggagcagcgcgggcgcatccgcagccggctgctcgccgctggaagtcgggaagcgccgaagcggcgccgtcggaggagagcgagcgagaaggggaggggaagcggtgccatgagggaacgtcttcgctcgagcccaacccgcccaaggcccagttcacgccgaaccgcctgggtcgtttcttttttttttctttttttcccttttccccataggagtataggaccacctggaccggaccggtgggggctctggttccggttttttccggtccgatcgccggttcggtccggtccggtcttaataactgtgcataggactgttgtttttgctcaaattggtgggttctttgctttcgctgttataaaggggtgtgtttagctcacgctaaatttaaaagtttgatcgaaattagaacgatgtgacagaaaaattgaaaatttgtatgtagaaaagttttaatgtgatagaaaagttaaaagttgaagctcggccaagctgcagccagaattaagaggagagtaagcggaccgtaatgaagtgtagtagtgacgtataataggaattctaaaaattataaaaaagacaacctgacgagaccaattcttaaacagaaaatctacataacagcattacgtgggaacaggataacttaaaagttaatataaggcaaacgttttttcgatcaccgatcagatacacccatgatttctgactacgtggtggggctagcgtttcacctttcctgcacaaggatttctaactcacactgacacatgtggtcatgtgatccgtttgagcatatgaatctgttggcttgatcacatcccatctataccatagaccatccatgtgacttttttttcgttttaccttttctcttgctttgttttttaattttcttttttttccagttggaacgcttttaaggtttgactagaaagtacccgcggcaaagtcgcgcaacagtagatgggccagctcaaattgagcgtattgaatgtatgcgtataccttaacatcttagctgggatgctagcagtgatgctatctcattcaacacttagaaacacaacaacatgttgtcagcaaatttatatatgcatagatactcgaataattaagctgctcttatagtctacgggaactgaacggaagacattgtggatcacatggcatccctatttgttgaaatgttcttttttctagaggaatttgcaaatatatcttaagacttctattagtcaagtctatcatatagagtgtctattacatgggcatagatagttcaggagattaaatgatcagagcttttgataatgccccatttcatttttctaggcaatataaactggctaagagcacccgcaatggtaaagtaaggtgctatctacaaaacatgtacatctcagcaatagactagattaa

SEQ ID NO: 67727 - DNA, 9440 bp, Oryza sativa
tgtcagatgaggataatgcggaaagtgacgatgaggtgctatatagacgaacagtcatgctctagtgagtgtagtttcttcttcttgtctttctttgaaaaaagctgcagcatattagtactttgtgaacattcacaagattaaaaaaaaactggccatttttgttccagatttggtggaggataatcccaaagatctttcgtgatgtgctcctgacagcatcatgcacgcaagtgagttctaattttctatgttttctatgtcaaataccatctagtatagccctgataactaaaaccgactgcaagggattgaagtatacttactgaaactgttattattcatgcctgattagtgacgaggaacggccatctgatcttgtatattttgctcagcattagtagctgcaagatattgcatcaatggctactccaataagctagaagtagaggggctataacagggaagtaaaaatgaaaagataatgagttgtaatcaggaatgtgcaagtaatcatacccttttctgcaaaactaataaaatggcagactaggagataaatttaaatctctagcatcaagtcgtcaacacactttagaggctatctttgagacacagtgagactttcactttccaagtaagcttctcaaatgaatttgtgatagaatacgtcctctgttatttatacccacttagaaactaatcataaatatgagtaatctataaaaattgttgatgtcgattctaattatttgcttcattttgttcatgacttcaaggctataccatcattatcggtaaatagctgcctggttatttgcatttgcaaactgaaattcgctaaccacgcaggcatcctcaactgcaagatgaaaaaggctttggcgttaatggaacattctcacaccaacagaggtcattggagtgctggcctaagcaacagctcgaagggattaacaaaggtagcagatgtactccgtgacagcctctggctttggttatgtgcgacttgaggcgaaagctggagattcgtagaccagttttggtaggagatcaaagagtagctgtggtagagtggagataatgtgccagtgatgaaaaatcctgttcactgaaattttactctaggacaccatatgatcccaacataggattcagatttttgtagcctgtagactatttactgtctgtaattcaactgctgagaaaagtattgcctaatgaacttattactagcacggtgtgtacagcttacattgtgttccacataaccacatttcagtgtctatggttttgttgccaatctgaatgtcattacagatagatagagagttcacttcagtactggaaatcactctgaacctgataccacctctacctgccttccctagctaaatgtgagggagttgagctgtccttttgcacagaatgagctctgtgccagtgactgttcaaagcatttgtaggaaaagcaacgatgcagacagcttcgttggcagaagttcgcacaaagcatcatagggctcttaggtaaagcatcggtgctcatagcactgatgcgtcttgtatctgaatgcacttcagcagcttgtggtgatctttatttctaatcagaagcaaagttagacagccatgatgagctgcccctatgactatctgggcatctcttctgattattgataaatgttcatgtaaaatgcaggtattgtacagaacattgttgaagaaaaactccaacaactcacccagttaatccagtcatcagataggagcaagatcaagcatcatgtcaagatcagtcaatcaagtcatctaattagaacccaaatcacattagaaaaaagatcagaatcgtgtggtaaaccagatcttcagactaacaaatcctcacacactaacagaacaaaaagtttctgcaaacagaaacagaatgtcagtaaggacaagaggacagaaacaaatctttatctgcttttttctcccttattaacctttcacttttttctgtcttgttagagtgcaccgtttttgtgcgaacatttactcctttatccattaatcaggagtccaggaccatttcctttgctccatgcttgtttccagctctccatgtgctctgcattgccagatgcctctttgcaaagctgaccttgcattgcattgcccacagctcaaccatgcaatgttctatcttcatatcttgctaggaggattagcactcactaattatctctgaagaaacatgacttattatcactgattatcagtgaagcttttaccaagattgtgaaaattttctgacaagtgttgtttgatcaaattttaatcgagttatgcaccagaaacttaatcactgaacttgttagtactttatttaaaaagttgtataaggttgattcataatgcattatgagaaacgcctagggttcttccggctagcttcacaaggtggtgggttagacgatttgggttcgaagcctcacccattctaattatttaatattaggtcattctccaatattcgcgtctaatgcattattgacgccactagcaaggccacatttgtgtacttatactctataaagccattggtgatgtgcttgtacattgcacccatgcatctacacacgcatcaagctaaggacatggaaacgcttgggaggaggaggagagtggccgtccttgcatggtgcaatgccattgcaatggcgctagctctagcgacaccggtggcggctgtcgctgccaaccacggcgacacggcggcggcgaaggacaatgtggccgtcgtcccgaggattgccgcctcggcggcggcggcggcgtcgagcgtgaacgtcacggccatctgcatggcgacgccgtacccgagcgcgtgcgagacggcgctctcgtcggcggcggcgcggggcgcggccaacgacccgttcgcggcgtcggtgcagttcgcgatgacccgcgccgagtcggcgcgcgcgctggcgcgcaacctgtcggcgtcgtcgtcgaggccacgcgtggcgccgagcggcatggacgactgcgccgagctgctcgacatcagcctcgaccagctccacgacgcgctcgccgcgcgcgccgcggacgcggccggcgtgacgacgtggctcagcgccgcgctgacgaaccagggcacgtgcggcgacagcctcgccgccgttcccgaccccgcggcgcgctccgccgtacgcgcccgggtcgccgcgctcgagcagttcatcggcacggcgctggctctccacgccaagctcaacaatggcggcagcgggagctcctcgccggcgccgccgagccgcgccgcgttcccatcctgggtcaccaagcacgacaggcacctcctctcatccccggcgagcaccatcgcgccggacgccgtggtggccctcgacggcagcgggacgcacacgagcatcagcgacgcgatcgccgccgtgaccgcgccgccgccgccggcgcaccaccccacggcgagcggcggcggcggcggcggacggagccgaaaggtgatctacgtgaaggctgggaggtacgaggagagcgtgagcatcacgagcaagcagaaggacgtgatgctgctcggcgacggcaaggggaagacggtcatctccggccaccggagcgtcgccggcggctacaccacctacgcctccgccaccgtcggtgcgtacccttcccactactcacgtcgacacgacgcgccaccatggacgatatggatcgtcgtacgtacgtacgtgcgtggtgtccagatatcttccattccatgcatgcagagatgcccatgcatgcatgacagttaatagttcgatcgatctagtcgttagatgcgcacactttttatagcctttaatgatcgccaatctcgtcgaaattaatcctcaaccgtccaaatgctaacgacagcgatgttgcacttgccaattgccatcaccttttctctttttttttctttttttttttttgccggtgtgtgctgtacactacactcccatgatcaaatttcacaagcagaaatatctcattttgtactagtagagtagtagaaatggatataatcaattaactgaattataacaatagtgaattggtgattatttgtgcagctgcaatggggtcggggtttatagccaagggcctgacgatcgtgaacagtgccgggccggggaagggccaggcggtggcgctgcgcgtcggcgccgacctctctgtcgtgtacaattgcggcattgaggcgtaccaggacacgctctacgtgcactccaaccggcagttctacgccgccgacgacatctccggcacggtggacttcatcttcggcaacgccgcggcggtcatccagggctgcgagatccgggcccggcggcccagcccgggccaggaggacaccgtcacggcccagggccggtccgacccgaaccagaacaccggcatctctatccatcggtgccggatcaccggcgcgccggacctcggcggcacgccggtgtatctgggccgtccgtggcggaggtactcacggacggtcgtgatggggacgttcctggaccgttcgatcgcaccggccgggtggctcgagtggtcgggccagttcgggctcagcacgctctactatggcgagtacggcaacaccgggcctggcgcggggacacgtcggcgggtgacgtggagcggcgtgcacacgtcgatgtccacgtcggacgccacgaggttcaccgtggcaaactttatcgttggggatgcgtggctacctgccactggagttacctacacttcaggtctgtagtggcgtactagtagcgaaaaagaaaaaaatgaagatggtgttgtgttctgttctctgtatcacctgattaattaacttggagctaaattgcatgttgttaactagtaatttttatttgctccggtatttttatgtgttctacttgatgttatgcatgtttcagattacaatgtttctggatgtgttgaggttaattggaatggttctttatgtataaaggattctacaccaaattgaaacaatcacagaaactcgatgttctagcattgtgctgaaggaatacagaaggatccagttgataattgagacgaacaatactaaaactcatttatcagcaagaaatgataatgagtatatatgaaaatggatagagtttcagcttattcatgtagcaattcttaggccttgtatgtctgaatttcagaaaccttatttcagagcttccccttctgatctttcctgggctgcagagaatcgacgtcttcgaaaactcgaagcgtcgacagctcgatgaaatcggtgacttgaacccccataggcctgcatcacagaattgacagcacaatagtaagtttgatcagaaactctagtacgatatcaatctttttttctgaaataaatggtaaatcaagcaaagtgtttgccagcaccatgggaagcaggccttctccggcagccgcatgccaagcctaggcccttcatcgtacccttcgcagatcatattccccttatcatctctgtaacataccactcctctcacctggtcttcaaatacctgaacaatcacagcacagcataatcttgtgtaaaaaccatgaaccatttagcaacagttgcatcagctaattaagttggctgtacttaccatcttggcaggtgctgcagtttgggagaggtgagcattgctgcagctgcagctgtgcactggagctctgacgaacttggccatggttgccttccttgtgccaaatcttggggtggaaatggaggaagaaaggtgatggcaagagctcattgccgccatttggttcatggccttgctagtttgggaaggagaagggtggtgaactagttgcatagagggcaagcttttcaatgatggatccattggattttgacttcttggtgcctagcgtgtattattggggatttctattggtctgtttgctgatgctgagcaagatggcaatttttatatgcaatgttgctatatccacaagtgatgctaacaaattgaagatttgtggtcactttattgcattgtgaatcctgtctagtggacattgtgtaacatgattataaggttcctttttctggtgaaaactaagaatagcaaaaaaggggttcaaagattggcatggcatattatggtgttaacaactcggcacaaacattgtagtgttcatttagcattgttcttttgttagagtagaaagtaatgtttcggcttatcttgtatccttttgggccgtgggaccagctgtcccatcgtggacattatcttcatagtctttaataatatactatcctatttggagaaccgacaaatccttatctggtgatgtggtacacaaaacaaatactagtagtcgatttattttgatcaccaaatagtgtacgactgaggcattttacgcagtaatgaagttggcttcatcatgtggttattgaaaacactaataacattgttatattttatatttataaaattgcatgtggctttaaacagagatgaaagataatagtaataagcaaataggagtaccataattttatttacacccgaaaatcggccgctatttacacctctgatgaaacacaagttcccattaattcatctctgtttggacagagccccggaattacactgacgaaccctagttaatttactgtggtaataataatatttccagagagcaactctaacctggtgcttggggaggtcgaccaggtttactacatctgcaagtctcttctgcagcagggcttcaggccgcagcaattcatcccatccactgcaaaatgcaccacctccttggctacatgtttccgagccattccatcacctctagggccagaagcccaagcagaatacagtgactggatatcctcttccgacaacccgttccgactgagatcgagcaccttcagttgctttgcagaaatgatggcatcagcgagttcttggatggcatgacagccagaagaggagtttctctggcatgaacttgcacagctcccgtctgggccggtcgctgcacgggtgtcctcgtggactgcctcttcgtcttcgctatccggcacctccatcttatcagggtctatgtgatcgttcgcttcagcattggtacgttggttttggtcagtacctggtgatacatcctgcgcgtcttcatcgtactgcaatgttctctgtagtgccaggtttgtgttctcagcaacgcgtagttcctccaattggtcatttcctgaaagtagcaggagactattgaggttgatgcataagcttccatacttgttggtttttatgtagtagttgttcctcacctgctagtgcttgaataatgcccacggtgccagcaagcccaagattgcatctatcaagggtgagagatctgagactgcattggggattcgaaagcaatgccctaatagcatcacattcctgcgccgtatacagcataatttagtcgaccaagtttaccagaatatgtataagtgtatcaaggcattcgagaataggaaggaaacctctagggtaaaagaattgcctccaaggttcaagtcaacgatattaatttgagaaagatttgtacagagttgcgagaaatcaggagttgtaagcccacagtttgataaatccaatctcagcaattcttgtgatgcacaagagagtgcctcagtaagcttagttgcccctccctacaaaaaaaaaaatcttcacagataagaagaatgttatttgtataatctgaaaatactaaccatgcgtgggaagcagggctgtgtacatccattgtggatgtagaggccggattttaatccattttctaaaaaaaatgcgtgggaagcagactcactgatccaatgtaagttccacctagcagaaatcctgataagcatgaggattgtgcaagtacacacagcttatcaaccattaacttactcagttttataccagtcaggcttagttctgaaaacctgcagtgatgagatatatggctcatccattatttcactgcacatctattcctaataggtatcaacaatgattgaacaaatgtttgcgaaccttttcagagaggcaagtttggagagaaggctaagcattgtatttccagaaattggattgttgtttcctgtcaaaaatatgaaagtttgaaacataagaatgctgtacatgaaacatatctgatagtttttaactatgcagagcaggagtaataaaagtacctaaggagagatgtgaaagggcagacccttcatgcagtgcatctgccatcttctgaactgttcttgatgtgatagaacattgctcgacattcaagctgtacagtgctgttacgatatgtaaacagagcacacattctataagaggaaattaaaggttggtgccattaaagaaaaatatggctggcaaaaacacagaaaatgccataaacagtacctacctttgcacttctgtaggattgtgaaaaggtaagaaccgcatgcatctgtgaggcgattcccagacagattaagtacttccaatcgattagtcataacagcgcactcacatatctgtatcagtaaataaggagtaaatgatttcagaattctgttcctaaaatgaacgtgtgcctgaaagcaagacagcttattttggtccgataggcaacgatagaataatttgttctggtaaagggtcaaccctcgagtttcatcagagtatggaattagaaccatccaaatggtttcagttagttttaacaggatcattgagatttgcgactaagagggacatccaatctcaatgcagaaaatcaaccagcacttgttatagcacattcccgttgagtctaaactctaaagtaagtaatagagtatagcttctagtgatctaaatttctcacacagtaagactaaagagagatatcacaagttaaattggttttcggctgaaattcttccaggaacactagtagacgtaaggactgcgtgtcgttcgggcctttctcggccttgttaaaagcattatgggacatctctccccaagagtcaagttttcctttttattgtagaagaggatccagtccattttaatgttcaatttttttgagctttcaaaagcagaaataacttgtagtttcactttgataaacaagtttagggatagtaaaaagacctgaaataaagcagttggaccaaatcgattacaatgtaaatccagtgtcaagccaccatatgtttggcttgatgaagaaaatatttgttgaagcctctcaattgtttggtttcctgcagttcgtgaacataaactttagtcattgtaaaagcatagaggaattaatatggtacacacacatttagcttgaactggctttctgcgatgccaccaaatcattggtgcgtagattacataagataagacaaa

SEQ ID NO: 67728 - DNA, 2771 bp, Oryza sativa
tcgatccacagctccgttgatcccagccaaggattaatggacaccgtacgttttgtacttgcgagaaattaagcaataagcatttcgcaggcggatgtatggttcaagaaaaaaaaaatccgtctggaaaaatggaaggacctcatctgcgaaaatagttttgctagtagctagtgttcttgcatctccaccaactatagatactccatacagctatactttctaacgtttgcattttctatcggcctctacctgcttcctccttgtcatatgctatttcttaaaccagaatcatataatatgtagtcatttgacagtaatgaaatgatgattaggtcgatcatttcctcctgcaaaacttatgtcaaaatataatcacttgtagcacgaatactactgccaacaactctctcacccttaccctcccttatttaacaagaggcaccaaattcttttcttataaaccttaatctcttctaagcaaccaacaaatgattatatctcataatagatggatgtgaagataacatatacacataagattcatgtgcatactccgtgtacaccaactaacaaatatcacaataaattctagaaaaaaattgtgcatatactgaaattcagtatgtattattacacttatatgtaaaattttaaccccggagacattatagtttagacgtaacaaacatatttaatagttttaaagctataattctatctgaattttgtattttttctctttatatatggtgaatttaaatatgcgactttacgtgtagatgtgtaatattactaaaagtatttgtttctaatgtttttagtgatatttgttagttagtgtgtacgatgtgtacacgtgaagccctgtgtagatatggtacattttcaagacaaagtgtatatatattccctcagtaagaaaactatatatgagagcaggtacaatagcagactataagccagctataaatatattttaaagagataaaggaagagagtaaagagtagcaggctacagatatgtagccagctgtaggacggacttcaagacgcagtgtgcatatgataggtgagaccatatattaatagtatagtaagcaactattatatgaattagctattagattgactataggtgaattggagttagtagtggactatactattgaacttgctctgaaccttgacttataaatcttggggagaacattgaacgttcctcgatgatggtatatatgtcatctgttgacatttagcactgaattaagtttttttacacggttagagcgaggatgccgtcttgttttctctactaccaacaataatcagaagtcatgtatgcttctgtaagttatcgacagccaccattcgaaacatcgtaattaattaagcgatacaaattattttgtgatgctgattgcatacctgataaatcattaaattatatctctactattataaaaattgaagatgtttccgcggtcattcatccgtgtttgagtcggttataaaaaattatagatgtttccgctattcgtcatccatgtttgagtcgattttaattttatgttttggtttaatctatatctcttctctactattataaaaattaaagatgtttttgccggtgttttggtacgtcatccgtgtatgagtcggtttttaagttcgtttgcttttgaaaatacatatccgtatttgagtcggtttttaagatcgttcactttgggtaatacagaaggaatcatgtaagaaatctgtttaaaaaaacttgcatgctaacttgagacaatcggactcctaactataactcatgattttcaaatatatatattcaagcggactcccacagtgaattttctcttaactaaaccatataacaataataagattaaaatagacttcaccccttgcaacgcatggatattttttctagttacggtaaatgttaggatgccatctcagcgagattgctaatccgcgcagacgcaccagattagcaactcgcgcgcactccgagtgcgtagcgcctcgcgcttcttttttttatcgttttctgtattttcggtaccgcttcttgcatgggaggttaagcgcgtggacccattagtcattagcactaataatagtgctaagcgtataaattaatttaattatagattttattatcaaaataatatacaaatagttaagttgaaaagtttcagaaatatgatgaacattttcaaaatttgagttgaagtttttaaaaaatgttttgaaagttaaaatttcgaggtgacggttttgaaatttgagttagaaatctttcaaattcaagtttggaagttttcatatttaagttaaaagttttcaaggtttgagctaaagttttcaaatttctagttgaaagttttcaaattcgggtcaaaagttttcaaattcaggtagaaagttttcaaattagagttgaaacttttcaaattttgaattgaaagtttcaaaatctttcaacccaaaatttgaaaactttcaagtcaaaattaaaaactttcaattctattttatagaggtgtgtgaaagattgaaaaaaaaatcgaaaacaaacggcaaaaaaaagaaaaacacgcctaaaataaaaaaatgtgcaaacagtaaaagaaaaaaaagacacggggagagggctagctaccacgcgcgccagctaaatcgctggcgcgtatgcgcgcgctagcacccccatctcagacacatgagacatgtttgttacaagctagtttcgcgcatct

SEQ ID NO: 67729 - DNA, 3402 bp, Oryza sativa
acaaatcacccacatattttggaaatcctctattaagggaattcgtttcactttttattccaccaaaaatgtttcacctagtatacttataatattttactatgtatgaatcaaatgttgcagtgaaccgaaatattctttcgctatttgctaaaacattgtttttatataaagtgaaacaatgtttcacgcccaatttaaacgattgaaacattttcgatctacttagtgaaacaattccgatatatctagtggaacatcatgcaacatttaaaaaaattcaataataagctatcggaatatatccatgtgtggtcttgttttgaagatttaattgcaatgaatttaatgctgcaaattttctaggatttaatggctttgtgctttctgtgataggcgacgtacccgtcgacagcgagacgcctatagtgactttgtcgatctccaggatttgtcggtccagtcttcgaagatacttatagggatagggtttgcgtgcgtgcgtgcgttcataggggtaagtgtgcatgcgttgtgagtgtctgtgttgtactgtgtaatttaaaaaaaatatgttctcaatttaatttacacattatagtggttgacacacatcagagcgccattaattgtaatcgatccacagctccgttgatctcagccaaggattaattaacaccgtacgttttgtacttgcgagaaagcaataagcatttcataggaggatgtatatacggttcaaactaaatatccgtctgaaaaaatagaagagtctcgtctgcagaaatggttttcttagtagtgttctagcatctccaccaactatagatatacagctatacttttttttaatgtttgcattttctatcggcctctacctgctttcctccttgtcatatgctatttcttaaaccagaatcatataatatgtagtcatttgacagtaatgaaatgatgattaggtcgatcatttcctcctgcaaaacttatgtcaaaatataatcacttttagcacgaatactactgccaacaactctctcacccttatcctctcttactcttatttaataagaggcaccaaagtcttttcttataaaccttaatctcttctaaacaaccaacgaatgcttatatctcataatagatggatgggaacataacatatacatataagattcatgtgcatactccatgtataccaactactccctccgtttcacaatgtaagtcattctagcatttcccatatttatattgatgttaatgaatctagataaatatatatgtttgagttcattaacatcaatataaatatggaaaatgttagaatgaagtaacaaatatcacaacaaattctagaaaaacaaattgtgcatatactttcagtattacacctatattgaaaattttaaccccagagtcattatagtttagacataacaaaaatatttaacagttttaaggctataagtctatctgaattttgtatttttctctttatatatgatgaatttaaagatgtgactttacgtgtagatgtgtaatattactaaaagtatttgtttctaatgtttttagtgatatttgttggttagggtgtacgatatgtacacgtgaagccctgtgtgtatatgatacattttcaagacgaagtgtatatatttcctcagtaagaaaactatatatgcacccgacttataaatcttggggagcgcattgaacgttcctcattgatggcatatatgtcatctgttgacatttagcactgaattaaatttttcacacggttagaatgagggatgccgtcttgttttctctactaccaacaataatcagaagtcagccaccattcgaaacatcgtaattaattaagcgatacaaattattttgtgatgctgattgcatacctgatgaatcattaaattatattacggtaaatgttaggacgccatttcagacacatgagacgtgtttgttacgagctagtttcgtgcgtctagtagattagtgaagaatgatgtactcaatctgcaatgcatgaaagaatatttacgagaaccactttacaggcttgttttagaatagaagtttttgatgaataaatttaatcttaaatagaattcaaaataaaattatctgtactgtggaccacaaatatgaaaatatgtggaaaaaaaaaactaaacagatggataacattacttattcagcctgcaaggttgttaatgcaaattttacatggaccaggaatttgttctgaagaaacctgtcgagcatgaaagcaagaccttgtgtttagcgatttagccaacgggtcgctggtgttttatctacaggcaaatctatgaggaactcctgtaaaaatcttggcaccgaactctctgtagctgtattataaagaagaaattggatcaaacccacagctttcaagtcggtccacaagttcctcgttgtacacagattgaccttcatttttttgttaacctgataacttaggctgagttcggatgggggagatgggaacccaacttctgcgcacggaaaacggagcagtccattaacgcgtgattaattaagtattagctattttttttcaaaaagggattaatttgatttttttaagcaacttttgtatagaaactttttacaaaaaatacagcgtgcacgcggaaaacgaggggaaggggatgggaaaaggtgcatgcgaacacagccttaaatgtttcagtttcagctactactctgagctctgaacgtttccttataatggaagcttgtggttcatacatgcaaattatctgtacaaatttaatttctgaaaaaaaaagttaaggagacaaatacatataattgttatgaaactattatctcctgccagagataaatatgggctcataccaaatatatagaaacgtatcctaatagaactcttcctattatatatatatatatatactgagagagagggcttgagaggttggttgatgtatccgcatatggttaaaacaataaagctgtgatgcccctctctatatccgtgttcatctactatatgattgtgtgcatgggatcgccgtcttctactccggatcagcgaataggccactagttattcaacacgttatcagcacgagtttgctcgttccgttgatccgggtaagtatttttgctagatcaatttttttttactaatcagattgatctactgtgtttatgcattggtctatcatcggccgagacgatcgcctccaagcgcagccgcgcaccgaggcagcccaccaggtgacacgcgtgcacgtcgcactccacgcgcgcgatagccggaggagcagccccgccacagtcgtccgcttcggagctcctaagccgacaacacatgcgcgtgcacatgtgtagatcgaa

SEQ ID NO: 67730 - DNA, 14214 bp, Oryza sativa
atgctatagttaattaagtttatggttaatctcagttgtccgacaagacacacgggaatcaagatgactactgaaatatttgtaagacttgtaagcaattatgtagagtaaaactcaaccagacagtcatgtgcaattacaacacggtgttgtgttctacgatggaatataaataaataataactgagcatttcatgttgatacttagtacaatgcaaatgcaggcaaaagcctacatgtagtcagcacatatgttcatattggtaaaggagttggtgcaaaacaagttcagcacagttgaaacttcaataatgcaagcactgaacacacatggttattagttaatgcatattaagttctaagtccaacaagaagcttcacaaaacatcgatacttccatcaggcaaagcaacaagagactatcttctgacccacacaacaatcccccacaataaaagactgaggaagtcacctttatgcattaactaatggaataacgtgatcatgttctttttctaacaaaacagtaataaaataacatcataagcggaaaatagatccaactttaaagttaatgtttgtggctaaagatcgcatagttagttatccctcacttacttttggccatgcagttatcatccttgccttctccataagattatccagccaagcatactgctcaaggaggagcttcctctctttagatgttccacgagcattagatgtgtctctgacaagctttttcagcttctgctcgtatatcttcatttcctcaagtactttggctgctttggtaacagtttcaatattctgatggatttggtccattagtgcatcctcatcttccaagcactttgttatttgaagagctttattgtaacaaagctttgcatcttcatacttttgaacacgggaatggacctcccccagatttataaatccctttgcctcgccttgagtatggcgtatttttctacatatctctatgtccttctcaatatggcccttggctctgttccagttgcgtagttcaatataaacattacctagattgtgatggagcctactgcgagcatcgtcatactggtgtacctcttcctcatcacatatcttcagaccctgaacaagtaatttctcagcttcttcataattatccagttccagttcaagcatgcccatattattgtacgcatcaataagctcctttaggaagagagacttctgagacgatggattctcctttagaacccttgctagcttcatggatgatttgaaatatttcttggcattccgaatggcactgtgatcattttcagatcttagaaggatctcatagtaagttctgccaagctgggtgctagctctctgctgctcaacaaggtcatcagcctccttggcaagttgtaagtgcttcttctgtgaagcatcaaacatcaatgataactagaaatatggattcatgtaatagaaaaaacatacagctgctttgggttaacaagagcattatgatgagtgttagaaaaataaccaacagacaacatgaaacaggagatcagcacttaataccatgagttgagtgaacaaattactccaaatgatcatatttgaacaggggtgctggtaagtctataacgggcctgagtacacacaaccagggtttacattaccgtcggtaaccgcgcggttaccgtggttaccgcccttactgcgggggtacggtaatagaaataccgcggtaacctccttaaattcaaataaatttaaaaaataatttgaattttacggtttttcactattaccgcgcggtaaccccggccccggcggtttgggaaaccctgcatacaacacatgctaacaattagccattccccctcacttcacataaaagggtaatctgattcacatggttggctcctcaaaggtttacatgcaaattagatgcaactaaaccaaccatatgggacaaaacccataggcgaacctgagccagattgattaagatcaccaactaaccaaacatgcagacaaagagtgcaagattcacaaatatttttttctcattttggtaataccacacaaataaacagcagataaattataaatctcaacactggccatactgaaatccataacataaaatgtttgcatagtccagcaaatgattcaaaccatttgtgtacatttctacaagcaaaagtccaccataagtttgccaaagtaaagcataatatcgaagtatgcagcttaatctgatattcagttaaatattcaaatgcttgactaaatcattcatatacagatgcaacaccaaatggcccaaagcatagtggcattgagatgagcaaaattccctgatacagtggtgcgtcagtgctaaggtacgccgtagaaaccatagcgcaggttgtaactagcaacaattcgtttgccggcagaccccaaaaaaaaatccaaaaactcaatgcggaaattctacaacttaacccacacctgcctataacgactcagacatcagaaaacgtgatctgatcatatgcgtgcgatgcgaaatggaaggatcgtggtaacctggtaggtgagggcctcggagaagttgccgaggcggaggtggacctcgccgagcgactggcaggaggggaggaggtggcgctgggggaggtacttgacggagaccttgtagtcgatccgcagccaccggagcgcctccacgtactccccccgccgcttgtggatgtcgccgatgacgttcgcccaccgcgcctcctcctcccggttcccctccgccaccgcctcccggtacccccgcttcgccgccttcagctcctcctcctcctccttcgtccaccgtcccccgccgccgcgccccatcgccgccgcctccgccgccgctagggctccagctccagcccgattttccccttcctttttttctcgtgcgggttttggggtttccggtgggcgcaaaatggaagcgaattctcccgccaaaatattggggaaggcaaaggcacggcaccgcgccatgttgttgggctgcgtttctgtgtgggccttcagtgaaatgacaacgtgggcttcaagctgatttgggcctttgcattttgggccaaaagagaatccctctgaatttcaggttaaccgagcatttgaaagtgcactcgtaggaacatattgatattgctattttttttatggactagtaataatactcgtgttttgtaagtgtgtaacgggctaggcacataattaagaattgattgggtctgtgggaaggaaacagatggagaataatagtaagataataatgaacacaatgtttagtttatactcccaccgtcccaaaataagttcaattttatactattcatacccaacatttgacttttcgcgttatttgaaaaaaactttaattttgaatgattagttttttattattattagataataataaagcatgaatagtctcttatgtgtgactatctttttttagtttttttcataaattttttaaataagacggacggtcaaatgttggatattgatactcacggctgcacttattttggaaagaatatatactatatcagtacaacctattggagttaactagaattcatacacgcgtgggaaagaacggctctgatcagctgaacctagtctgaaataccgaaacgacgaggggttttctgtaaaattcaatggcgtagatcggctgagctcgcggtgaatctagcacgtttaagatatctaatattccgagacagtgtaatttggctttgcatagcagccagccagccacaggaaggcaagccaaacgggccagcacttgttcaccgcgcagtgctcgtcggccgccagctcgcgcggtcgcgcccatgtctctaaactctctctagatcaaaggacacagttttttctaaaaaaaagttcatagtaactgcagctttttctaaaaaaaaattaactcttccatctatgtgtttgagagaagagaaaataaaaggactgaaaatatacacaaaataagataagctattagctattagcatgagaataattaactattagtttttttacgaaactattaattgttttagacttaaactaaattaatatatttttaagcaactttcttatatataaaactttgaaaaaatacgtaccatttagcagttcgggaacatgcgtgtgaaaaacttttatactctatccaccgatctcaaacgtagccaaatactacagattttcgtttatatactgaaaatttgtagtcacataaaaaatatatatgtcaaaagctgagaaacacatttttcaacttttagaactaactatcaaccaaccactactttgttcaagagtgggagattgtgagttgttttccacgtgcacgcttcccgaactattaaacggtgtattttttgtaaaaagaaatgctatagaaaagttgctttaaaaatcatatgaatccatttttaaaatttaaaatagttaataatgaattaatgatgtgctaatggtccacctcgttttgcgtatcttctcaatctcctcaattcccctcctaaagggtatgtttggtataacttcaactcttaaatttagcttcaggagttgagtgtggagtggagttgtggagctgattaaacctaactacacctctctagttcatcttgtgatagtgtttcacccagctccgcttccattttaggtagagctaaaactgtttgcctgggctaccgctctaaaagaaataaagctatagctagaggtgtgccgaacatacctttaggggctgtttggtttttaagtaacattaccataactcactttagacaatgttaggcaagtgtggctgaccacgcttttcgtggcctacaaattgtaagccacacttgtggcaaagctaggcaaagaattgagtctatgacatataggataagatggtaagaaagtgtagcttgtcataactatggcaataaaccaaacacaaggttaaagaggtgtgacagtctaaagtgtggtctggcaagttaaagtattgaacaaaataacccctaaaatcttatactcatgtaaggcatgggacaaaccgatcgagtgcaaacggtcatagtagtagctagccacgttacgtaaagttacagcgcgcgtgcgcgcggcggcgcggcagctcttttctccgcggcggccacgacgagcgtgctgccagccggtgatgaaacgatgatgtcggcacagcgcgcgtggcgtgcgagtgaaccgtacgttgctcgatcgatcggttgctctcgtctccgagattccaccgagcctagctccgtagctcgtgctcgtggtccatctatcccgcgttagattttgtcaatctatggtcaatcgtcatggtcgtcggccgctagctgccgtacgtacgtttgtagtaataaaatatgcagtgtcgattgacgtcgatgcaaagcatttttcgtagttttgctgcgttgaaggcagccaacaattgatttgttaatatttatagtattaaatatataatattttatatattttttatttattttaagatgaaaggagtagctagtttagatgccaatttacggtgtagccagtaaggctttgaaattttctcacgtcatacatgtatatagccttttttttttctttttacaagacctagcgggcgcattatagtcgacattgtgtctgtatgtacagtgtcgtacagtacattgcagcagcaagatatagaaaatggaaaagaacatatttgccttgtttagttccaaactttttcttcacactttcagcttttctatcacatcaaaactttactaaacacataaacttccaacttttccatcatatcgttcgaatttcaatcaaacttaaacacacccattatatatgtcgagcgtgtacttcctggaatcggctgtaataaaaaaaaagctatgccctctttgaaaggcgcgacaaagaaattgaaagcatcgctgcaactctatgcaagttgtcaaataaacatgagccctggtattgggcatatttgcaaacggaatcccatcgagaaataagttaaaaagtatatttgcataaagaacaatttatgaataaaattattatatacatgttctttagtgatttaaaagtaaagactgaaaaataaactacgataaaaaaacccaactaactttaaattggttgaaaatttattaaattggttgaaaatttaaattttgactgataattataaacgtaaacgaaaaaacgaggcgtatgttaccaactactcgctaggttctttcgccctgatcttctgtcaaaaatggagggccctgagatagtgagatgccgacgccgccggccagccggcttcggctactactacagtacttgtcgccaacctgccaattaactggttgctcgatcgcctaagaattagcttcacaagttcggatgcttaactttccagctggttattgttcagaacagcaaaatgaccactcgttttcttgttagttctgcagcaatagacagtggctgttactacatgatccatatactttattaattaaccagaagaaaaggagctgggggaaaatgttacatgaacatcgtattcaagattaggtgaactgaaacattcaaacatgcacgctaatgctagctccagaaattgtttgatgttttcctgaagaacaaaaagggactcggcacgatgtctgaagaagctgcaggcacaattacacgcgcgtcgttggatagagtcagtcgacgagatgactagaaagtagaaactggactaatccaatatgtaaacaagcgtgtctcgacttatagacttttgctgctgctggcttcaacgatcgatgtcaccttgctggctggcctacttagtaaaagaaaacgactgtgtttttggtggtcataactaattaggcgagacactgatgaaccaaaaacaatgtaacaaagtcgcagttctagctgcacttaacacagattatttaattacctcacctaattgctcggagaaaatctcggcaacaaagccttgtcgcaaaagccagagtaatagcagaaccgatctttctgggagcaactgatactttccaggaaatcttttttaaaaaaggatagtactactagtattaacacgttgttcagatcatgcacacgtctttgcaaggtaaaagtatgagtaaaacacaagggaacaaaagcaagatagggtgattagcaacttccaggtaaccgttttgtctcctctcgttaaccagcgaccgagattagcacacgccacacgcgccactagctttgagcggcgttcggccgagttctaaagagccactcagaaaagtctactttcttatttcttacgaagaaattgttatacatatgatccaactattcgactcacgtacgactaaatttaatcgacgactataaacagctacactgcgtataaacatgttctttttcgattgatatatgtttgcatgtatctagttatatagaagatatgtttcatgttaaattatttaatataaatactttttaaaacatatcaaataaacatttttttttctcgtgtcacgtttcgccgaaaatcagggacgaacttctttgtcccagccgttttctccgccagacagccaaggcggaaacgtgcggagaaaacggccggagaaaaggccggaaagaccaaagcagtaacgcaacgcgatggctatcaacagggtggcaacgcgatgcacgcacgcaccagcagcacacacgctccacgcagcagcagcagcgagagaggagatatttttggtctctcgggtggttggggcatggaggatactagtactaggtacaattcatcaactggtcacataaaaaacgcatcagtttgctattaattttaagtgcatgcatctaccgtgacttgttccatggaggaacactgcaagtacagtgtcgtgtagtggaccacattgtgaggaggtggtggttaatttgggcttaatccctggaattttttgattgaaacctataggtcctcagtttggtgcattattacagatgagatcctcttctgaaccttaattagttaaagaaatatgggaaaaccttaattagttaaggagatatgggaagtagggtaatattaataaaaagatcacgcggaatgattttcataaatgattaaccatgaataatatttcgaggttattattactcgtagtactccctccttctaaaagtttaacacctatttcattctttggtttttccaaaagtctaagtcctatttgtagttattatgtactaaattaaattgttgataggaaaaaaaagtattttaatacttatttgttgcatgtttattggctttgtcatatgataaatgaattaattgtttcttgttcttggtgaaaaagaaataggacaatttttttttgaaggagggagtactacgtactactccctccattccaaattgatctacatattttataggtacactaagaccaagaaaagctaataactctctcatattacatttactctagcaacaaattcaatacatgcaccatcatcactattttctagtcaatagcaaatcgagatattgcatgtgggttataaatacttgtgtgcatggatgcatgcatcaatgtccatttactctaatgcacaaataacgaatagacttaatgaatgaacacaaatatgtagatcatttaagaataacccaaaaaaactatatatagatcaatttggaatggaggaagtatcagtttactcatgattacgctaattattccactcaattctcactttctcagtgccagcaatcaatgctagccagcctactccggcagtcgatgcattcaatattcaaggagtaaaacgcaaaaatgaataaactgaaggtgcaacattgtaaaatgaccttctccgaaggggcgaactgaaaaactccaaaggcagcacaaatctcgtccgtacctgccccgcttctacccaagcgccttccgctgcaagcatccactggctgacaggtgggccccaccacgtgcccctcctccacctcccgccatataaaaaccccaaagccccacccacccacgcttctctccaatattttgtcgaaccgattgagggaaaaaaaaagagaaaaagaaaagaaaaaaaagaagaagaagagagaactcgaactctcgcctaccatttcgcccccctccgcaagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagaggtatgggcgtcgctgggagcggcttgatttgtgtagtttacttgttcttcagggattgattgctgttgtaaatcgttagttctacggccgattgggaatttttttggggatcgaggacgctcggtggatggattgggaggaaaaaaaggggatagataattttaggggttgatcctgagagatcagatttggggtgatactcctgtttaattggtgatttagggtggaatgatgtgcctccatgtcttatttgtggtgatcagggcttcatgtgctgattctgtctgctaggattttagagatgccatttcagctcttgcactgttcgatcttttttttttctttttctaaattgcgcaatccatatgattacctttttctccaaggagttgaattcgcagtaaaggggaaattattctccgttctctttggaggtctccccatctgggttcttagttgttagatggatgaccctagtatcgcttgatgtggttgtatgattgcgagaggattgttccggacgtaattcaactattagtcgaagtaaaggatttttatgatgttgactgtcaagtcctacatgccttagcatatactcctggctgtttagtcgtcctggtgcctgtttttggttctatctttcggtcaatagcgtcaaatcatttttttgtggtctttgttggcctcttttgcttagacatactagttcattttatttatggggatgttacctcttgtgtaaattgtctaaatcggttgtatctagtcagtcgtgtgagctaaaccacagatctttgttgaagtgttgcaactcagttttggtgttccttgtttacaattaatgttgctgcagcatattgatgttagtccgtaaagcacaactttagactgcaattgcagaaatgatgaggtccattcatgggttttttttcctacaatcttgaatttcatgatttgagatatgctttcctaaaatttgaatgtttatacgcatggttgcatgttccaacttcatgtttgtgaccaaaagaaaataacatcagcaagagaagttcatctgtgtaatttcttgccattgatgttgaccttccattgcagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggtaaggattatcaatttgattttttctctctgaatatgcacgattttttacattgctctaattttgcttgtgtttttcaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgactatatatttatatattatatcttgttagattgcagccttgcagggttgttgctcttgctactgggcgcgtgccatccagaatcaggatttctggaaagatgcttcacttcctcttttcttgatgtgaataggcagtatgaccggccaggtataagctttgtgataacaagaggggtatttggcacatgttgtcactttttcttctcgagatatttttgttaagactatgactaattcagagcgaagacctacgagcttcgtgactgttagatattttttaagaagggcgaaatttcaatgaatgtttaactgcagcactattctagatgtctttggtccaagtcaaaatatccttgcatcacacttggatcatggtcaatgtcagtacagtctttacgagttgtggacttgtggtcccatgtcatggtggttggtcgtgatttgatgccgacatggttgcgcttgcgcatcgcattcttgatttgttacggctgggtcatgcccttttccttctctcgcatcattttttgctatcctcataaatcacatggcttcccctaaagacaaaaggattatcaaacgtggtggccactagtgttccatcaagggagcatcacaagccaaacactaccaccgtttgtctcccgttggccagggtcattgtgcgggacagagcgagacagctctacctaattacctaaagcttgttaagatttcaataggctgccgttgtatatgaacccttcaacaagtttagaaacttttgagtgagagagcttgtgcaatgcatgttccttcagctgcaccaactttgacttgcctctcttgaagctctaatctcacctaccttcgctagaaaactgaaaactgaggttagcatcgaactctgggtgcggcaggttaatcacaggatctaatctgatggttcgctcctaacacattctctgttaggttggctcctaatcgtattgtattaccttgtactgttggttgggattctgataccgattgctgagcatagcgaatcattcattaaaagaaaaaaaggaacatattcgttcaaatctcgaaggactaaacattcacaagtattatatgtagccttcactccagatctcacatgacctcgaaaactttgagaaattaaaaattacaatggaggctgatgaggagatggcatacgcatttgatttgagtggagtaccatttcaaatatcagagtatgttgtgacgacaagcgcggatgataatcaacgaaccaagccacatatagtggacgatgctttacaatccaccttgtgacctcaacaacccaaaacacgccaagcataaaataatatttacatatcaaacggaatgttcccacaatggtacatttttcgaaagaacaaaaattatatatccatatgaatctacctctactttcttttcaaaaattgagaaaaacgcctatctacttgctcctacaagaaagatgggaacaaataaccagaatgttatactttcctaagagggctatgggatgatgtggacatatatcacaaggcgaatgtctgaagtttgctgtgccatctatctcttctcactcctaattccctactcaaatcaccaattcccgtctcatgaccacttggaaaagacaagtttggccttcaaagtagccaacgcgtaccgcgtacatgacacaagcatcgggtaattttaataccaaaaggtgtctccgtggttaacccactgcacgaaatgctcaggtaaattctgagtatagatatcagcatcttgattttcctgaaaagtttgaaatttcgcaattggttatgttattagcacaatgatattgcatatttgcatacatgatctctaccctaccactataaattctcacacaattaatctccagaattggtctgaacaaatttcaacaaaatcaaagaacagaatttagcggaatcgaactgttgggaacatatgctcaccatggtctcagaatttatgccacttataacattctccgctgaaaggttcacatctggagtactaattgcaatggacctgttcaagcacaatccatcagcattcaatgagttacaaaaaaatgtttcagaggatatcttcaaattagcatcagtgaacatactggaagctcagaagacacttgttaattggatttaggaagtgtggcaacataatatttccattttactccctccgtcccataatataagg

SEQ ID NO: 67731 - DNA, 575 bp, Oryza sativa
gccgtccagcggcagcgcaggtggcactgtgcctgcaggcgtcggcgcgcgcgtggtcgcggacaagcaaggtgctggacctcgacgcgctgtcaacccacgacgccactgctacggtcttctgtcggcgtgcccttcctctgggaggaggcgtctaggaggcctaaggttgtggtcatgccggaagacgttgcgccgccgctgcccattccggctaccggcgagaggacacctgtttctcacggacgcgatggcattgtccagcagcagcgcagccgctaggttgttgtaccctaaggtcaaagagataatcagacgatcagacgatgaagatgaaaagaagcgaattaatcgcgcatttagtttctctcgttgcaacgggaagaccgtgtagtagattttctgtttcttaaaaggaaaaataatcttataagaaacacccaactagacattaagatatggtagcagaggagatacattaatgttttgatatgcccttattgctagcaatgtcgccgtaagacgcaaaatttttaacctcattgccaagttttgactggatgctagtgatatgc

SEQ ID NO: 67732 - DNA, 1131 bp, Oryza sativa
ttataagaggaatggaagatgaagagtaagagtcatggaatatgaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttagaatttatttgatttaattgatttaaatggattaattacccaattaaatctaacatgcacaaccaccgtattgcaattttttatgtttatcttttttttttatatcggttacatacaaaacaaaccttgtttttctttttttttcccgattgcgtggaaaacaaaaaagcaaacacactacacgtctgcacataccagtgagtggcttttttttaacaccataatagctaaaggtgtggattagtcggcctaggttcgagctttatcactctcttaataaatttcgatactttcctatcattcatatctggcattattttaacaataggcattttgtttgttcttttgctcgtacaaatgcaggtgacgtgcatttgctactatagttatgagatgattatattttgataatgactacaattttaagagaagacctgcatgtataaaaagatgtaaacaaaacttatttgcagtctatcattaagaggataatgggctaagagtattcatttttgcaagtacgcagacacacagtgcaagtatagttgagatgctgtgacatgaatacactgttttcactgtttgatttcttgataataatactgacagtatcactaaaattatctttaatctaatccataaagttcgcttgctcccatggcatttttccactgatcaaatcctaatcggaacaaaaaaaaattcctcaataaaccaagccaaaatattgcaaactttagtactacccaacacctattcagattgggtgacata

SEQ ID NO: 67733 - DNA, 5035 bp, Oryza sativa
acagacagatatcctctccactccctgcaagcggggcccatggtcagacgactggtactgtgaagtgggccccacgaccccagcttggtgcgggccaccgtccaccgtccatctttcctggcccggctaccatccaagcgtttgcagtggattcttcccctgcttacctttttctcatccttccaaaattccatgggatccaccttgggaatccaaggccataaaaggccacatgaccaaccacacacagctaaattctactctcattttttttcctggagtttgtaggcacaacaaattaagattttatgccaagagaatatttttgataaaaatactaataaaacaaggctgcatatatgtgtttttttactactactagatttttttgtgcttgaaaaaggtgaggaaatgttgccaaggtcattgccttatcttccaggggaatagcttaaaaccgtgtgaacgcctatatctttatggttgagaagttctcaaagaatctgcccgcgtatatagaaataaaagtacaagactcgtcattttcacgctattttgttccaaatctatttgatgttgaaccactccttgggttctatatcttgtgagctagcgatggatactttttcttcatttcctttttataaaattgtattcattatctagtactataagatatatgtatcttttaagtaagtacacatttgcatgcatttattaatttgaactacttctatttttaaagataaatccaagtctaaaacaattaaaatatgatggaatattacctacatccctaaagactcttccttttccctttaatatgagatgttaatagctagatgagacttaagtcatattcctctaaacctgcctaccgaatcttgatattgtagagtagggcagccaggaatatatggcaactatccacaatagtgttgctgatggtgatggagattgtaaaatcttaccttacctacagagatcatgatttttttagacttggaaagaagaagagaaaaagttaatggtgtataaaaacaagctatacaaattgaaagaaaaaagtgcatatatctatatctaactggtctaatttactcgagaaagatgtgaggattcgaatgaacatctttacaaagagaatgctccaattgtgatcacatcaaatgcaatgtgaaataactttagtttcggcataaatgagaaaaggggttcgataacgaagaatgatatatgtattcagagcgcatttacactctcatggaaacaccaatgtggcaacctatgatgaatattataatcatgtgaataagcttaacatagttttaaaaaattaaattataagagaaaaaaatgccacattggtgtttactgttactattgttaccatggatccaccaccataggatgcgtgggctcgtcagtggatcatcaaaatgagaccctcactttacattttttttctcttataatttatttttttcaaactatgttaagcttatttacataattattctaatgaattatacacatttttttttcatattttggaaaatacatatttctaaaaaatatattactagagcaacttgttttaagatagtactccaagttgttaagcttattccaaaaccatgtaaataatccgcgacaataataatccgtttggcaatctaaatcaaacggcgcatataggggttgtttggttgatggctaagtttactatacctcactttgccacaagtgtgttatgccacacaaagtgaggctagcaatttgttagccacaagtgtggctaagtttggtaagaatttgagtctataacgcataggcccaatgactagtaaagtgaggcatgacacaagtgtgacaaccaaccaaacaatatactaacaaattgtgacatgtctaaggtttggcatggcaacctttgagagccaaccaaacagccccataatacatcgcagcaaatcaaatgaaaatacaactcactttttgcagcaaaccccctcacgatcacctaaatttcgaaaagatcctcaaagccccaacccttcttctccatcgcgtcgcctataaatacccccctcgccttcctctcacttcttccgccattcccctctcctcctcttcttcttctccaccgaataaacccccgcaaaaaggtggtgagttcgagagagagagagagagagagtggaaggctagggttagggttagggtttcctcctcgccgccgtcgcgtggcgcgatggccgccccgccgccttcctccccgtcgccgccgccggcggcggcggctgcggcgacgcagcagacgcagccgcacccgcagacgccgttctacgagctcgtcaagggaaactccggcatcgagaaggtccttctccgcggcacgcgcggcttctccgctgaggtatccgatccgttctcccccgccaatcccaacccaaccctcgcctctgtgcctctgtctctccttccgtttgtggtgtgtgtgtgtgtgggggggggggcgattcgtgcggattcgggcgccattaccgcagatccggcgggaattcggctgatccgcgtccgggggcttggggcgaattcgtaagagggctcgtagttttccggcgcgcgatttcgtctcggtggggatggtttggtggcgcatttgcacgatccgccgctcgcggacttgtaatctagctggttgagatgttaactgcttagttttgcgtaatctcaatgggatgatggcgcgatgtgcgatcgcagtagggacggccttcatgatgtgtccggtcgccattgatgtttcttggaaattcgttaggcgtgcgtttgcaatgtgtgaaatgctgcaatcttattctgaagattgtatgaaggtggtattgtggggattgttaagcgacggatgccctgtttacaaacctgcgtgccgaaataggaatttgcttatcatcgatataatttgacaaggacaagggattcttgtgttaccctgttctttttctaggtcaccttgtacagggatcggatttgtggtccatgtatgttttttagcccttgtatgtagaaatcatattctagatggaagacattctttctgacaaatttggatgtatcctctgttttggtactgttttgtacattattgcttatgtttcttatggttgtcatttcgatgtagctattttttagtagaagctaatgccaaatagttcatcaaattgtataatgctcagtagaggagcctcttgtgctgttcagccatttaagcttttggtttaggtttttggtacaaggagtggatggaattgttaatctccctttatatgtcatagtgtcatacagagtctagtccatcatttcaatatattcagataattttcatcttctgaaccctgtaaaatcatcattatgtaccagttttgtatctctctttttacatatgtaactctgcagttgtgttgatctccgaattgctgtagtagtgcctcatctctgtgtacacaagcgaagtgaaacacatgttgaaatttttgtctttgctgtcatgctcccctggatgggtccacattgcccatatcaaagtgaacttcattctgtgatttttcttatcttatttgttcttacctgttccactattttcaaaacagaaaatttatgccctgtttatgccctgaatttacatgagaatatactataatagccaaaaataaaatattttgccatgatgagtaatgactagttctccattttctcaggtctatctttatggagctcaagtaacctcatggaagaatgaccatgcggaggagttgctttttgtcagcagtaaggtgcacagtcattttctaaaggatcttatcgccaacagttgtatgaccaaattatgtcaatgaatgatctctgtatttcatagctcacccttgttttgcctctcccctgtaaggctgaaatgtctgcattattttttttagcaaaatatttttacctcattgctgcacgccattagtttttttcttctgttgtcacctcttatggactattggaagattaattaaacaaatcgatccctttttttcctgaaatattactagttgcctgtttctagttctctgatgttgctttgctggccatatgttcgaatcatcatatcttttgaaagtaatatattcttttgtaggctattttcaaacctccaaaagccattcgtggtgggatacccatttgcttcccccaagtaaggcaacctttacctataatgacttcatgataaaattttgtctgctcaaatcaccaaaacacaacttacaaatgcagtttggaacacatggaaatcttgaacaacatggatttgcaaggaaccgattatggactattgatgataatccaccacctttaccagtaaaccctgctattaaatcttttgttgatctgattctgaggccttctgacgaggatttaaagatctggcctcacaggtttgtgttataatatttaaattgacaattgattgtttattttattccgtttagtcatgcaatgtgttgaaggtacctgattctgttcttggcctattcattgtttacagttttgagttccgcttgagagttgctcttggtcctaatggggatttgagtctcacttctcgaattaggaataccaacactgatggaagatctttctcttacacatttgcatatcacacatacttctctgtctctgacatcaggtatgtgtttcatgatgttttatcttctccactttatttttgtagtgttttgacctctgtaatgatctgttccaattgttgatatagtacttgatgtgctggaaacctaaatacttttgtaccatggatgggttttactgtgttatgtatgtcagtcaaacagtgatctcattgtggatttttttcatctgtatttggtatcctttttgtgagaagcatagaaaaaaaatcttagttccttgttgatatcacacattggaaatgccacacatggaacattatagtagaaagtaatcattg

SEQ ID NO: 67734 - DNA, 1191 bp, Oryza sativa
cccttccaatccttgtcgctgtaatttgttctcttaaaagaacatgtatacattcatcatcactgcacgaagcgatactttttatatcagagattattctgcttgatactaaaatgtgcaaattctacaccgatactgtagatgacatatatgcatatggtattattatggttcgaaactataataatatcacagtatataaaaatcatgatgctgtggctataattaataggtcgaaatatataatgtagttttaagaaactacatacgaatttagatggcttgacaagaaggggattgcaccttgcagctcttttgagtaacattaagttcacacgtaataagaagtggagtacgttactaattaacaattaccgaattgatatatatcatactcctgtcactgctagcatccaagctaagctatagtaggtttataatgcatgtgcgctccttcctcagtaatatatatctgtatatgtttgaatccaattgaccaatattcaacattggcattgcatatagccgctgaagcgggtttaatttgttaattgttatagaatcttttgtccaggaccacggactataccccggcaaaggaaaaaaattaactttcccaaatataggaagcagaagcaatcttatgggtcatctgtttttaaattaaaaaaggttggtcagatcacacttgaatacatcggcactcaatactagctaacaatagatagccatacaatccgtgatgcatgatacggcatgcacctaccagggcatatacacccaatattaaactgttcattaattccactagtttgttctcatatactaacaattgttttctgtttccaggtaagtaatgggtttctctagccttgtaagaaaatgaaactttagttgatttcctgatatgttcagttaagccgcaacaacattgtctcttaactctcaacgccaccagctccaaattaagcacatcaaaccaaaacttgttactagctccgtcccaaaaaaagttcatttttcacccatctcacacatatcaatataaaagaaaacgactagaatacccctactttattatatccccaatgtaattattcatcactttatctatactctcaatatcattattccctacttttcacaaactccgatgcaataattactctaaaaatgaatttattttgtaac

SEQ ID NO: 67735 - DNA, 9502 bp, Oryza sativa
tgtgctttgcttgctctctgctacggctctactctactttctctctactgcaattgatgatctgttcattttactctcttgtttgttgggtgcggctgctgtgaatgcattggattggaggactgatgttgtttgatgtacgtggcttgtgattaatttctcttttctgaaatctacaaagttctcaactctccatgccgtcattgatgtgttcatatgatgttatattgtgtctacccttttgtgctatatgcaagtagttgctcagaaacccctgagcaagtcagccttaagcggcatctaggcgtcgaccatctagcgtttatcgccttcttgaacattgattttaccaaacatgtatttttatgttaataaaatttgctaaagaaagatatctacaacaatattaccagaagtgtgattcatctacaggagtgggttcatctttaaaactcctagtacttcagcataacagaaaagagttatgaagtttgctacaaatgctggcagcctcctgaagcaagtcctttagaatgtagcttcatcacaatgcagttttaaaaagagcataattgggtatatatacactaaaactttacacccactttttaactttttagtactaactatcaataatcacaaacaattttttaattatggcaagagtgctgcctaatgcattaaagtagaggaagaaaaggtatgtttacatgcctctcactttcagaagatgacatgtggcgagtactaaagaaagaaagattaactgagggcatggctatattatgtcatacaagaaataccgtttattgaatgaatgagccaaaaaaaataaaaaaacataaatcaaatgagttaatctcttcaagctagtagtacggaagaaccttattgttaatgagataagaaacctggaatggatcggtggaaaaactttgaaagatacttctatttctctccttccagctattccaccaaatatgaaagattagtctgccatagcttctgccattttttataaaaatctaaattgccattgccagccaccatttgtttgcattcatattatttttatgagcatatctgctcttataagacaaagaggatacggcacgtgggaatttattatttccttttgaatgattgcatctatgtgtaacctaaataaaatattataaccctaccaaaatttgatgtgcacttgaaacacatttcttggttatatttctatttcacccatcaaaattgcattctgaaactatttcagattagcacgttacgtgctcacgctaattactattagcaggccctattgatccacaaggaactgcgaatcacgaaacatccatccgtactcagaaagagaaacaaagggtgcaagtaaaaaataaaaactgcctccagtaaatacctattaaagagtcaaacaacacaaggaatgcgcaacattctagactccaatgggaaccttgaagatgtccagccacgcaacatcctaatatggggaatgtacctattggatataaaagaataaaagaacagatatactgtcaacaatcaatgtagtagcaatctggattattaatttgcagagatgactgcattaaaagatatctgcgaagaagatgaacactggtttcaaagtgctcaactctttcaatgcaatgaggaacttaatatcgatgccaaatcaacaaaatagatatgaaatgtgtagtataatacacttaatttctatcacatatataattcaaaaatatatgagatgtctagtaaagtacacttaatttctatcacatatattatatgcaatacaattcaacaatccgatgctcgttcagttacattttgttcagaccaagtatactgtataccactgaacaattcccagacactacagcaactccaacttttcaaaatagagaatcattgatggtggtttcaatttgccccggactccccttccaatctactgcaatcccttatcgaactaatcgaacagaattcagacaagtagtaggggaaccgatcgctcaccaagtatggctcggagtcggagcggctgctccacgcggcggtgcggcccccgtcagcgatcacgcctcgagtaaccctgcagcttcctctccccccaaccttcggttgcgggagcaatcgatcatcggaaactggaacgattgggacgtcgccaggtaggtcatgggtggagcggcgaattcgagatcgcggcgggtctcgtggacgcaagaggattctggaggaggggagcgagggggtccgtcagggcagaggcggaagcggaggcatggcctcccccgccgcgacgggcatcgccgccgtgagtgcgccggcagccggcggggacgcggggtctcgggaaagagaagggaaaccgatgggattgtgtgcgctcagcgaggccgcatgtctggcccaaaataaaaagcccaggaacgtgtgttcctcattcggcccggcccatttaatcccatctaaatgagcccatctaaccccatctgcgcgaaggagaacgaagcagaggccaaccggagagggcggagacgaatcgccggcccctcctctcgccggcgggcggccgccaggccgggaggtcggccggcgacgcgccacggcgaccaacctggtacgcacccccactgcgacgaacttctcactcttgatgcgaccgttgcaccgacgcctccccgcccacgtgcataggcttccaattaccccaagtcgcgatcggttcagaggcggcggtagaaacgctgtttccgccggcagcgagggaggggcggggcggggctctccccccggatgccgccgtgcggggaatgattccgtagggaaattaaaggggatcgtgttcctccatcccgccttgttccattgctcaagttgcgcgtcctgcctgcatacggggtgatcattatgcttgtggtcttgtgttggtgtgggggaagaggaggaggagggtagccccgcatccagagatagttcaaacaagcaatcaggtgttcttgtggtgttgccatcaatacagatttctctgtctacctgacctggtcccggccgtggcctgacatgtgctgaccttgcgcttggtcggtttgtgccaaattagtagaattgtagccacatggatgctttgcttgcggattgttgtacgaggggcttcttgttttctagtcattgagtccgacgaaattttcttcgtgctaagctattgttctgatagaacatttatgatttgatgcgttgtagtatagaacatttatgatttgatgcgttgtagttggtcagcgtgctaaggcaagttgacggaactggcgtgctaaggcaagttgacggaactgtaggatgaatgcaacttttttttttcgccggatcaatgtaactctttcttgccatgaaaggttgaaagtgggaaaaatgcaagtttcttaaaaaggaagaagaaaaggtgaagaaaacggcacaaagcttcctgcttagtttagcttgcgtataagcctggtagcctacttgatgtaaccaatttttttttagctaagataagatgcatctgttttgatcgatgattttatcgatgtagcttttgacacatatagttgtcgctgatcctgatttcgcacagcgttagtagtttttaataaaacggtttaggggtaccagagcatttccctagcatttcttgtgtataattgtttcagatttttcatctttccgttaaaaaaaatcatcttaaacaataaaaccaactgtttgaagccagggatgatagcttgatcttcaactagttgttctgtcaccccttccgtgaatctggtcggtcaggtgatactattgtatactgcactacacaagaattataacccactagtattgtatctttgtcatggataagacaagtctcaaaatgtatttcatctggttgccatacatctcagtgccatatattttacatgaatgacatatataaatgttaaatgctgctatgccccataatctcaatttggatataatcttccagaagaaatgggattgcggacatgttactgacagacaatgatctgttatgtactgggatgcatttgattgtaagggattcatgatacgtagctggcactgttttgcaatgatcttgtgcagctatactcatttctacttgtccttgttcatgatgtacatctgttgacatccaaaaccatcattttcgaagtgaagagcaagtattttttacagaattagcaggtgccaggttgcattcatgtttttgtttggcctcttgcataggctgcccggaccaaatggtcccgaaatgaactctttattatcctcatgtggtattttttggggaatgcaaggccaaaatcatggtccacggaagcaacatgtcctacatattacccttgcatgtcatcttttgtgaaagttaaaaatagtttcactccatttggataattggatattgatttagaattcctttcatgtcttctgaatcaaatggggagaaacgacaagtaggccgtgagactggtatgaacatccaacttatgtgaacttgattgtttatttctatactctggtttttgttgcttaatgaggttgtactagtatatagttcagagtatcataaaggcctcttgtaagcccagaatttttcctgtgctacaatcacaattcacaggtcacagcgcagaccaaaggtttgagtggagggctataccactatagtacttagttgtatgtttcgtggtgaaactgtagtagaagatagcagctgagcagaggatgatgtgttgatgtgatcgaggaatggtgataatgtatgttctgtcaatagctcctggattcttggatatgtgggacaaaagcaaagtcatgataagaaatgtacagtggttcttgtgcagctcaggaatgttgagctaatggattttatactatatgctatatatattaaatttgttctaatagaacttggtggcttgtgagcaactcacaaacacataatcaaactcaacaattataatgcagtgttatattctcttagagttaagctctgcactttgtactgacatttgcaaatgtagcattcatcgccaatatggagtaatgactatggtagtttactttaaagaacacaatatgtgttctctagtgtagccaaaaattttaacaattgatttcaggtgatcagcatattatagctgatagctagtgtgattaataaatactacctccatattttaatgtatgacgtcattgattttttatccaacgtttgaccattcgtcttattcaaaaaatttatataattatcatttattttattatgacttgattcatcatcaaatgttctttaagcatgacataaatattttcatatttgcataaaaattttgaataaaacgaatggttaaacgttgtttgaaaagtcaacggcgtatatggagggagtacttgacatcattgtgttccacatgctgagatgccttttttttctcattggcaggttactactggagattactacttcatatttgctcattggcatattattagtagatggggactgtttacttcacattgattttgcttgctccatacagaggcagagaatcattatggaggttagtgtattgatgttgtgtttttgtttttgtttttgttttttttttctgctgtgttacgctgaccttgaggtttctagtataggttttagatagtgactcttttatggtccttagaaagtatggagaggtatacatatatcttactgtttaactattttttaaagaagggcaaaagttatgtcatgtacatgtctagattcattaacatctatatgaatgtgggcaatcctaaaaaatctttgtgtttaatcattaagtatgataacaaatcaaagtattttgaagtatgaatctaattgtacaagttttatacactaaatgtacttttatgttaactaattattagtcaaaatctttcacatttgactttctgaaatcaaaatactacttataaaagcagggagtacgttttaaaggctgaggaaaaggcataagggcatcagccccagttccatttttattaaattaagccaacaattcttgtacagtttgagttcgatcagcaccatatctacatttcattaggccatcttaaatagagatcatgtgatctttgtttttttaatcctttggagtatatccctaataaagaacctccatacttagttttggtgcttgatttgaaactactaacgtgtttatgatactttaatttgcacaaaaaggtcttcaatatacggataggcagaatccaaagtactagcataatgcattaaattagaccggcacattatcatcaaacaagcagtaaatgacatttgccatattctggctcgagtggtgctcaagaaagccaggacaggaaagcaagagctgctgaaacatcactgccatgtagtaagcacacagcgacccaactatgtatatatactcctagttgatttagcttatatatatatccatccgtaaggaccctgctacaaaccactaggcgcgcatgcagctccatggctaaaaacactaagcaaacgttcctaacacccagagctaaaactcttgacggctacaaactacatagatcatgagttcatgacagccacgaagctgcattacttggcggccgtcttcttggacttgggcacggccttgtcatggccgtgcgccggcggagccgagttgaggtcggggagggacgcgcggccgccgccggcgggcatgttgccgttgccgttagccttggtcgcggccgccgccgccgccgccgccttcgtcttggcgagccgctgcttgagctcggtgagcaaggcctggttctcctggttcagcagcagcgccttcttgcgcagccgctcgttctccttcatgatgtagcagttctgcaggtacagcttcgcgttcagcctgtccatcttgtgccctgctaccaacaacaacaggataacgaagtttagcagccatgtggcgtcactgtgtggacccctgttttggacttatgttgcggtacgtttttttttaattgctttttcgcatgctcgagtctcatattatatgtactctgctatggctgcagagaggggggaagaaagacgacatcgaagctgaaacagtggactattgtgctcgagatccgataaatattatcctgcatactcagggtgtccctgctttggctacatcctcagaggtactgtaagaagctgctgctatattactttcttattattttcacattgtgaggccaaaacagaatagacactgaagcttctacgtaatcaagaaagtgaattagccaagtagggtcacacttaataatacatatttaacatgctcttccaactactaatggaaaaagaaaacagcttgaacaaaccaaaggtggtactccatattggaggaagcagattgcatgcaaagcagaaacaaacaaaaagcgtgccaagcgcaaaggcgttacgccgagagaaagtggaggagaaggccccattttgacacccccgcgcatgattgtgcatgcatgcaaacaagaagagcaaatcaccatgaaaggaagagagaaaagaaagaaagaaagaaaaaaagcaaaagtgacgggactaatagaacatcacctcctctctgcagggagctgagagctgtgatgaagatgctgctcgctgctggggagttggagacgagaggcgagagaggtcgagcggcgacaccagaggaggcagggtgggcagcgagtgtgaagtgatgcgagaggctgggctactactacctaagctacgagaccggtcgctgtggggcaaggcagcgagaggcaaaaggtgagtaaggaacaacgagaaggagcacgcagtcctgcacctcctgctggtatgtgcgtgcttctcctcctgccttcctgtgcgtgctgtgcttgctagctcgtttctgtggtggggcttatttataggcgcagaaaagcctcccttcccgtccgtccggctcgtcgccgttcgttggtggatacgaagctctttccccctcgctgacgcgcgggccacctaagaattgggcgttgcacgtacgagttagagcaagttcaatagtatagcccactactagctctaattcatctatagccaatttaatagccaattcatacaatagttgtttacaatattttaatatatgatctcacctgtcatatacacattgcctcttaaaatccgtgctgcagctggctacaaatctgtagcccgcagcccgctaaaaatatgtagcccgctgctcttctctcttatcgtttatcttattaaaatatgtttatagctggctaatagcctgctacctgctctcttatggggggattgtcccgtccgctctcatgatcgagcactttgaacgcgagggaacgaggggacggcgtaaatggtggctaatgatgaggttccgtgggggtccggccctcacgtgacggtggctgcgttattctcctcccctccgctgcacaccaccatgccggcaccgtcaccccgcccgctccattgcaccacggcacggctaatctcgccgtctcgtgccgatgtgaaaacatcgttaggccgccgcactcttttccccccttcaacaatccattcctatttattaaacacaaaaaatacgtacgttcttatcaatgcttaagatagttcttctgctccgatatacaaggaattttttttactatgcacctggacgatatttcaaaatataagcattttctatatatctggttagaggaattttacagtacttgaggtacctaaattaggtacataaattttatactaaaatttttagttaccttgagatacttcgtacttagtatctagagatactaaattttacactagaaagtatggtaactctagatactttctcaagaatagtaaaattacccatatgcttaaaaaaaagcttatatattggaacggttgcatagttgaagaatctctctaacagaagtggttatacggctctccatctcaaaaggggttttaatagactatccatatgtgttcccatcccatctaactaactaatccattgctccaaccacgtcttcctctcattcctttcccttcattggatttagacgaagagggtgagatttgcgtttctctctgctatgaatgaatttaattgaccattgaaggcaaaattggttatataacatcgaaagttcacgtttttggttttatagcaccgaaagttaccggttcactttaatagcatccaaagttcaccctgttcccatttttagcacttccgtcaatttttccgtccgtcttgatcgttattgatccagccacacacatgatatgacatttctacccctcattgacatgcattatacttgtacttgtgaggggtagaaacgtcatatcgtgtgtgtggctggatcaagacggacg

SEQ ID NO: 67736 - DNA, 977 bp, Oryza sativa
aatgatggctcatctccgggtcctcgctcatcattccctcctctcccctttttcattttcttccccctcctcttttaccaggattattattacttactgcacccccttcctttaataccaccctcaggtgatcatgatcccctcaccacccaattgaatgccgcacaattgtggcttctccttacactcctctctctctcacacacacacacctccaatttttactgcatgccgtatgactatgacatatccctctcatgtataccttcttttccctccttttccccttggcctatatcacacgcttgttattgatttcaaaagcatcttgatgagtatgatagtgtgattgttacaagtaacagaatctgtgaagaaaaatcctacttgcaatcacaatcctactagcaacttccagcgttcaaaatttgttctagaatatagcaacttttttatcaactttttcatctcaacctatcacaatcacctgccatttaatttcttcacgtactccctcatctttaattaattagaaccatctctgtttaatttcaccttcttagttcctatgaaaaactctaaaaatacttatatttagtaacggagggagtagtagtagtagtatttgacagcaaaaataggattggagctgagaatgggagaggaagaaaaagagaagcgggcaatgatgttggacagcttggagtcctggactctctaggctgcatatataagatagcaatctttgcagctaatacagctccctggcctaaacacaaggcttggccctagcttgcacagggggatccttgtggagacatgcgtggagacagccggattacgcttatgccctttcggaactcacaaatgcaagctggtacttggcatcagatgtgtggtccgtcgaggcacggagaagaggactgcactgcacatactctcaagctccgtttcgtatcagtgaaatttatatggat

SEQ ID NO: 67737 - DNA, 28868 bp, Oryza sativa
gtacatgggcaggggggcagaaagttagatgtgcgtgggcataatgaatgggctttggcaaaaaggcagaacagggccggtcaatgtggcgcatcaattcgccccatggaaaacttttttctcccctcctcccggccaaccataccagctagcacaagaaatccagacacgttggccgtgtcagggggtggtgaaaaattatcatggagcttgcagactcttgagcacccataccccccataaccagcaaaattttcctgcatatacttgcatatgtagctggccaaattccatgctgtgccatgcttgctcacatggtgaaagtgaagagtaggtagcagctatgtagtactactgtgtacactcttgggttgtgttgtgtacgcacgcataatgtgcagtgtagtagcactgtggtaacatagatgggaggagtattttttgttcggtgtagtggcaatgggcatgatggctacactagcctagcaagcggcaagcactcgattaaggtgtggatctctgcgcggcgatacatgcatacacggcgtgcattgctaccttccaaaaactgctgcaaggaaccgaagaatgatgccgtgtttggacgcggaggtttttagacgaattccacgagaaacgacgcaggactacccacatgaacgatcaggaaaattacacgtgttttgatctggacccgctgttgcactcgcagcaaacctgtctggtcagcagatattagtaatccctccgtcccaaaataagtgcagttttacattattcacgttcaacgtttgaccgctcgttttatttgaaaattttttatgattagtatttttattgctattagatgataaaacattaatagtactttatgtgtgactaaatatttttaaattttttacaaattttttaaataagacaggcgatcaaacgttgggcacggatatctacggctgcacttattttgagacggagatagtaactgtgtctttttttattattatttcttgatagagagattaattacaccctccgtttctacaccaatgacggacccaaaaatcttttttgattgcaaatacaacaacaattataaacttcgttaatcactataaattcaagaccttacaatgagcccgaactctgggttgtcgggtcttggatccaccattgaacgaatagcttaattttagaacgaagataaaattatcttgttcttattagggttttacttatcatcgatgaataaccgataaaccttaggtgtgttcggaacatctatctatgataacagcgtaactactagactcaacaagcaaaaaattatactaatggcccctttaaatcgtagggttgaaaaaatagaggaatagaaaaaacataagattctaacaggaaatgaagtgtaaaccagataattgcaaaacacagaaaaaacacaagaatgaggtttgattagaccgcaggaaaaacacaggaatcggatgaaagagatagactcaaaagaaattttccaagagattgaacctcttgctaagtttcctctaaaatccacatgaaatgtgtcattccataggaatttcataggatttggaaagtttcagggccattttgaatcgcaatattgaaaaagtggaagaataggaaaaatacatgattctgatatgaatgcaagtgtaaaacagaggattacaaaacataggaaaaatataggaatcagatgagaaaaatagactcaacgaaaattttctaataggttaggccccctttgattcaaaggaaattcatatgaattttagaggattttatttcaaaggaatttcatagaaattttagaggattttattcctataggaatttttcctatatagccctttgaatcaaaggaatgaatcctatgaaattcctatggaatgtctcttcccatataggttttggaggaaatttaacatgaggtagaacctcatagaaagaatcctttgagggctcctttgaatcgcaggattgagaaaacgtaggaataggaaaaacgtagaattttgataggaatgtaagtgtaaaacagaggattgcaaaacgcaggaaaaacacaggaatgaacgtttgattgaaccgcaggaaaaacacaggaatgaacgtttgattgaaccgcaataaaaacgcaggaattagatgagagagatagactcaaaggaaagttaccaagaggttgaagctcttgctaaattttctccaaaatctctataggattgttcattccataggaatttcaaaggattggattggattcaatcctttgtttcaaagggtttcataggaaattttcttataggattgaaatcctccaaaattcctatgattttcctccaaatcaaaggggccctgagtctttatctctcctcaaattcctgtgttttttctatggctcaatcaaacggtcgttcttatgtttttcctatgttttgcaatcctctgttttagacttgtattcctatcagaatcctatatttttcttattccttcatttttttatttctatgatttaaagggcccgcctctttaaatcgcaggaatagaaaaaacacaggattctgataggaatgcagatgtaaaacagaggattggaaaatacaggaaaaacataagaatgactattcgattgaaccacaggaaaaacgcagaaatcggatgagagagatagactcaaaggaaattttccaagaggttggacctcttgctaactttcctccaaaatctctataggattatacattccataggaattttaaaggatagtatagaattcaatcctttgtttcaaaggctttcataggaattttttttcataggattgaaatcctttaaatttcctacatttttcctacaaatcaaaggggctcttagagtggatgttaaattttctacgtttttcctatagaatcgtaagaacatgaaagttacatatatttttccttttctcatttctacgaatcaaagtcatgaatagtgtaggatttcaattcctttatttttttctccatttttactctaattcaaaggggcctcaatcctttaaaacaaaaggccaaataagaaaatttcctacagaatttaaatcatataaaatttttacataaatcctttaattcaaaaagccctaaagtgctacatcgttgtggctgtgcaggaactgtccagctgaaccgaaccaccccttgtcacagttaggattcgacaaggaaaaccccggttctgacacagcaaattaatgggggtggcaacacaagacgggcacgagcataccctttcaaaaattttcacctgacacatcgaatattcggacacatgcatagagtattaaatatagaaaaaaaaactaattacacatattatgtgtaaattgcgagacgaatcttttaagcctaattgttttatgatctgataatgtagtgctacattaagcatttctaatgacgaattaattaggcttaataaattcgtcttgcaatttatagatggaatctacaatttattttattattagtatatatttaatattttaaatatgtatccgtacatccgatgtgacgtggcaaatctttttatccagacagccatagacggatgcagtccgatagcatcgcattgaagcgcatgcctccccactggttatttggagtcaaacaaagctagagatgctcctccggcccccatcatggcgtggggtggcacggcatgcagccggtcgacacgaagcgagggatcaatgggcatcttgccggcgcgcacgtacgctctcgctacgtgcaactcccgtcccggccatgccatcatcacgccgaatcgccggtcgacgcgcgccagccacgacgatcgacgacgtacgcatcgtgtaaagcgtatcacctcaccaccgtgtcaatgaaacatgtgcaaaccaggtcccactcgtcaaatctcttaaagaaaatgtgtgtacacttcccactactgtctggtagagcaaaaatgcacaatgtagtagtactattacggtcggaagtggattgtttattagtctatgatagattgatagaacagtactcacactcacgatgcacactgctaacgggaggccgacaactgggtcccagtacgaggtgccgcgacttaatattagtaaatgccgcatcactcttcaagtgccgtactggtttcatggtgtggtgcggcacagcacatcgatcgccatcgaccgctctcgcttgctgggctgccgtgcgtgcacgtgagaggtaggagtcacagcacaggacttagctgctgcctgctgcaccggtgcccctgcatccgctggtccgtctcggctaatttgcccgccgcgctacgccctcggccggtctgacacatccccggccgtgttggcgtcgcaacagtgtcgttcatatactactcctcactgcgcagctaaactctagcggtagcagcaaccagtgcgtaggcgtagctagctatagctactcgcgcgctgcgcgccgaatcttctttgagcacgcacggatgacgcatgttctctctgatgtagacgcccccgtgtcagggccgatcgatcgatggatcgtgtcggcaagacgccaaaaggacacgttcttttttttcaactttgctgtacatgcacggcgtagatatggctggagtctggagagcaacccggtcgtgtcaaagccgcactcgatcggcagagccaggagtcggatcgacccggccgcttgtgctcatgcctacccataggtgacatcgctgctactgtagtagtagcagtagcagcgcctaggtcgttcaattgttcaaagttgcacgagctgatcaggaagtatggtaggagtacgtacacagtgatcagtagtactccgtagtagcttagcctgctgcctgccatcgtgacatgatgcacctgagagaaaaaaaggggccaaaatgattggatacgcctttcgctttggtaggggagggaattaattgccggcgacacgtctggtgggtcgcgtcgctcgcacagccggaccgccgatgatggcgcggttgaatataccgctccccgctcgcgcgttgccgacgacgcgcaacgtgcgtgcaaggccggtgtgagacccgatcgcgaccgatctgccgccgctactgatgatgcccgctgctgctgccctgctgcctaattaacatatgcttctcctcccgcgatcgatcgatcgatcgacgccaggacggcgacgacgaaagctggggacaaaacggagcccgggggaaacatccgaacatggcagcacacgtgcatgggcagaggcgaagcgaacggtgcgccgcgcgatcgatcgccatcggacggcccggaccgtgtgcggggaaagtagaggaccgaggttagctggcgatcgagcggcgactgctacctgctccgtttgcagccggccgcagtgcaggacgacgcagcggcagccttcggtttcgcaggatgcatcgccaaagcggggagaaaaaaggcaaaggttttgcagctgcagatcgaacagatggaatgatgatggagagacgaccaaaaactcggaattaagatggccaggagaaaaaggcattgcgactcatgcatatgcatgttcactgtccaggcaggcaggtcaccaatctgatctgatctctgatccgagtccaacccgacaggaccgtggaaggtccgaacaggcgctcgtttggctgtccaggactgtagtagatgccaaggaaaacaagcttggaaaatatcataaacgtgttttgaaatcggttgctcactctgtttcaaaatataaatactttcaatatcaaaggctgttttaacgtaggatttgcgaaaaacaaaaaaaaaatcctaacaataaaacaagctaaaataaagaattacaaaacatataataaatgcataaataatcgtttgagtagaccgtagaaaacacacatagaaatcaaatgagagtgatagatacgaaacaaatttttcaaaagattggagctttactgacttttcttcaaaatctctataggactctctattccatagacattcaaaggaagaaatagtattcaatcttttgtttcaaatgccttcttaaaaatgaatttgctatactacttacgacataaaatttggtggaaaagcaaccaaaattttcaccatggcccgagattcatgcacgggttggagagaaaaaaatcaagggatctgggatttgaaagtgtgatgtgcaaaaccgtcgggcgtttcttcaccaccacacgacggggtcaattttatagttacattataacgggacctaatatatatagcagttatatagtggttacaatattattacagagccaagttacatttgaaatgattttactcaaaagcttgcgaaagcttttaagataagatagtccccttacaaatcctccaaaattttcatatatatactttcttaaaagatgctggtggtggtggcggttctgccactcccatctatctgacaagtgaaggccacaatctatcttgagctcatcattgttgaccaacactgtactagagtgtgaagttctatttgcttcatgtacagtgtacaacacattgtttatcctatcatcgttaatcagagcttgagagtgatgatttagttttaatcagatcatctaatataattagagcccgctacaacgcacggatatttctacaattcaaagggagcctaaaagtaggtttaaactaaaatataatcattgcttgtcatacaaatttgtgagggttacggataaggcataccctctattccaggagttgctagatatacaaatacgatatatcttatgatatacgtaaaggaatatgtaaagtaagaaaatcagtgaaatcgtatgagaaatattcttcacgagtagggccatatacatatcctactcggagaagggaaggactgtattgtatcgtgcggagtctgatatctccgagttctacttggaaaccaagatgaaccatggtataaatacacacccctgagggatacaaggcatcgaatccttagtgcaagacacccaccaccgcaaaagcaatccggagaacttttgaagcctattcgccgatagatcccgtcgagtccctctcgacaaggatctcgtcggtaatcttagagtctatttatcttcttttgtactctgttgttttctttataatcccatataaactgtattagggctattaccttacgagagacctgaactagtataatccttgttttctgtgtgtttgatgccgtatcgtgtagatcatcgtagcaacgtaccccaataccctcataatacggtctacgggcatcccccgtgaacacaattaccttttatttaattttcatctcaccttaccccaatcatccctggttcattaagaacattatactagttcttttctactcaatcttaatctttattaaaacctcaaaagtttttatattttcaaacagacagaatatcactcctctaaaatgaagagtaaaaaacactagaatccttaaaattgtaccgtagtgtcacaatcatcccggtctctaacttttgaaaatgtagatctacgcccctgaactatcaaacatttttcaaaagtgtcatatacctttcggttgttgacatggctggacatgtgatttgtcgccttgactgtctctatgttggagaccaagttacttcatatttatttatttgagtaaatatcagaaaactacaaatacttcaaattatcacaaaagtataactttaaggtgatgtatgacaaaactacagatttaacaataattttataacaaaactatagatttagtaacaaagttatcacaaaactacagattttggagtttaccttcgcactagtgttatatttgagttataaacatctaagttttgggattgaattgacactaaacctatagttttgtgataattttgttactaaatctgtaattttgcgatgctccaccttatatatgtagttctccgagaaatttaatgttaaatctgtagtttttcgatgcattaccttaaatatgtagttttatgataattttatgaaagttcctatagttttgtgaaatttactctatttatctttgaagactaagccaataagtcaagtacgtgttacgtagtcaaaatcgctctcaataatgttaatattgtcgaaaaacttgatttgctctggtgtagaaattggaagttgttctacttagtttgtggagtagttgagcgatataaatgaaactcggtctatagttgagctatataaactcgtcaagtggacttttttccataatttgatctggactctgtagaggatcaatacatcttccaacgaacaatgcaagaacgcgcatcttaaaaaaagaataagttcactttgactctctcaaatataggtccaatcttattcgtattccttaatcatgctggatattttgatccctaactattaaaactgatgtagtttaactacctcgatggttttgagagtgattttcgctgacatggctcgttgataggtataaccgactgagtcagcatatggggcctacatgtcagcgccacctctctctctctcttcttgtccgcaacgtaacgtatcctcgcttactccgctacgcgctttagcgagtccagctggggtagtcggtgacgtcactatcaacgtcttcaacgccgacgagcgtgggcatgggctcaagggcagccacggtgccatcgcccgtctggagcaggaagtagcagcggaggaggcgtcgacgctggggtcaccagaggcaaataggtgctggccttagagaaggtaatgatggcatcgaggagagtggtcgctgcagcaaatccagccgtgccgtcgctccgcctcaggtcaagttggtgcccagctcctagcccactgtgcttcctggtcacgctccccttccccatagcctctggtagaaccactgccacgactactttcccgcccggtgataggatggtacgagagaggggagagaaatcacatccgtcgcaacaagagatggaatgcatcttgcctccctgagcacaagctgcatgggagagggagcttgccggattagggatgagcgggtgagcttgacaggacacgttggtcgccaccgccattgtcttccttcccgcagacaagcgggtgagcttaagctacctcttcgccggagaaggtggccgccatcctgggaagcagctcaagctcgacggtgttgccccgggctggtgcaaagcttagagaggaggaaacactaatatgtgggccctagagaaaatcaccttcaaaacaatttagtgagtcaaattacaccggttttcatagttaaaggatcaaaatattcggatattgcagttgagagatacaaatcatattgaaactgcctatccattttgttaggtgatttctaacaaaaaaaaatcacccagattttttttacccttgcatcgaatggactataaaaaaaataacaaatacatatttacttacataatatttttatcaaaattacagtgcacttacatgtcatatcaactaaatttacaaatgtaattttggttatatatgactgtaattttatattttaaataaaataactaatacatatttacttacacaacatttttatcaaaattacagtgcacttacatgtcatatcaattgaatttacaaatataattttagttatataaggctttaattttatattttattttagttaaaaatgtcttaatttttcaacagttaaagaaatcaatttttatttggaaaagaaagggagagagagcgataaggaagcaggaaaagcaagagcaagaaaaaaaaaagcaagaaacgtcattcgcgctgattcctccactaatcttgacgcacgatcctaccgccaaaaaaaatcaaatatcagagaagaaatcactcgacagatgtttagcaaaatcgaatcatattagacatacataccaatatatgagggtgtcaaagtggactttttattcttaaaaaaacgactgacaggcctacagaggaaggcataatcaatgcggaagtgtttcgagtcatctcatcacatggtacgttgtgttattcggcctataagagcccatttatcccgaataggtccccagaggaaaaaaaagaaaaagtacaccgaaagtccctcaacttgtcatcaagttacaaacgtcccccaaccacaaaatcagatatccgacgtcccttaactaatcaaaaccggtcataatatatgtcctttgatggttttgaccccggttttatcctacgtagaggctgagtcagcatgagacccacgtgggccccacatgttaggccgagtcatcttgctcccccttttctcttcctcggttcatcctccgtgcacgcctcgtcggcgatgctggcatcgaacacctcgatcatccactcctcctgcaccacggtgcgcacccactgcggcatatcgacgtcgtcgatccttggcaccacgttcgtcggcggcttccccgtgagaatctatgacgagccggcgccaacgccatcgccgtagatgaatgccacaccgcgtggggccgccaacgcgatgtgcgcctgcgacgtgaagccgaggcgcacgcggcacacagcgctactgtcgccgtggaggaggaaggagaggactccagcgccgacgaagtacgagacaagaagcttctcgttccctcgcctcctccgccgccgacccggtctcccccatcgccctcgactcgctcccttccccttcacccgccgttcccatccccacccccgctgccgccgccacccacctcgccgtcgtggcctacctcgccgtttccgcgcctgacttcgacgtcgcggtggggccctcttcgcgcgccccagcagccgcgcgcgccgcgcgatcgaggagggtggggccgcctcactcgcctccgacgaggccgatgccgtggcggaccagctcgaagccgtagtggggaaatcattctcaccatcgtggggcgaccgggccgcgacggaggagcagtcctcccgtgtagcccacgacctccctcctctcccgcctcgccccggcggcatcctccccagccgccggccgacttgtccatgtggagaagagaagagtgagagagagagaggaggaagggagagagatgatgtggcaacctgacatgtgggacccacatgggtctcatgctggctcagccgctacgtaggataaaattggggtcaaaaccaccgaaggacttattgtaaccggttttaattagttaagagacgccggatatctaattttatggttgagggatgattttataacttgatgacaagttgagggaccttggtgtactttttccaataaaaaaacgcttgagttcttgttaagagaggaagagaaggagaaagtacatcaaaggtccctcatcttgtcatcgggttacaaaatcatcctccaaccacaaaaccagatcgtcatcctccatcttataaaaccgggtcactttgggtccttaggtggttttgattctggttttgtcccatgtggcagctgagtcaacctgagacccacgtggacccacgtgtcggggtgaccaggtcatcacccctctccctctctttcccttctctcgcttcatcctctctctctgtgttctcatctgggcaggcggcaggccggccgacgggtggggaggagggccggcggggcgaggcgggagaggaggaggtccggcggccggtgacgggcgacgcgccggcggcgacaatgcaggagcaggagggcatcggtggtgggagcacaaaggagcgcgaagggggagcatagggagggccggagccgggccgaagcatgggggtgggtgtggaggcggaggcggggcctgtctgagagcgactaagcttcggctcatcaggcaggaggcgacgggcagggatttgggggaggcgaggtggtggagcagcggcaacactcgcgcggggccaacttggcctactgcccctctactgcgtggcaggagtggagcggcagcggccggcgggagagggcagccgccatggctccttcaattaagcagcatcaaaccactgcccaatccccacttcaaaccatgtagtgctcgccgccgcctccctgcgcccggcccgtggtcgagagtgtcagtcccagccaggcggcgccatccctggggcattcggctcaggccccgccacggtcggtccctgcgcgaccaagcggctcgccacgaccgtccccggtggcgcccctactgcccccgctttgtcggtatccgtggcgacgagcgcgcccgtgctcgccacgacaggcgcctacccggcgataccagcaggatcacagggcacctcagcctgtgcacacgacgatccacccgtccgttgttgggtattttggtggaggagaataaatagagaaaaccgaaaagcagcagaagtttctctgcccaaaaatattcagagaagagtgctctttcttcagttttcacgtttcctgaaattcttcgactactgttgcggtcctgaaatattcagggaagagtgagcgtgggaaactgttttaaacactcgggtggacgttcacccgtttctcgggtggacgttcacccgtttcttgcatgtcatctaaatggttatgaaacattttcaaaaaaaatgacataatatgttaatatgcaatatatcacttcacaaacatacaagttcaaattcgacttctacaagttgtaaaaaaaataacaaatttaactgtgaatatgtgtatactagttagaatttgatttgttatttttgttataacttgtagaagtcgaatttgaacgtgcatgtttgtgaagtgatatattacatattaaactatcttgtgaattttttttggattttttcataatcatttaggtgccatgcaagaaacgggtggatgtccacccgagagattagaatccatcctcgagtgagcgtgagcgttttcagtttgatccttgtgttttgctgacatccgcggtcaccgccggcgtcgccggtcaatacatcatccacgcaattgttttgctcctctgtcctcttccaagaaaaccacgcaagggagctccgcggaaacgtcgccgccaccgatgagatgactacaagacatgacttctgctccatgttcttctttcgcagcagccgcgaccacgtcaatgtccccataagccaccatcctgccgctaacgccctcctgctcccgcgttgcggcagggcgaggcggcgtcggcgagcgagcgcagtgtcggcggcggctgcgacgtgaggcgacgctgcaacgccgggagcgttgtagtaggcgttgaggagcgccgccgtggcctcccgcagcagcgtccgatagatgtctcccctcccgtccagcgcctcccgcagcgtcatgtcggggccgtacctctgcgtggcgacggggccgaacaccatggccacaggcggcgagggtgagcggcgccagatgggcggtaggcggcgaggcctgcggcgccagagtggcgggaaaggggcagctggcgaggacatggggggcggcgcgaggcctctgcttcctgctcttcgcgacgtcgccgccaccgccgccgtactggagcagagctgaatcctcctcgtccttcttcttttgctccggcttctcaaacgtctccgccttgaccggtgagcgccacatgccggtgtcgcgtgagagcatcaggaggccgagcgcgacgtcctcctgctccttctcgaacccgcccagcactggccgcggtggcacgggcgccgacgccgcccatcgaccgccacctccgcctccgcgtgatcacagtcacgtggggaggaaaggagagtgagaggatgacgtgccatcctaacatgtgggcccacgtgggtcccacgctgactcagccgccatgtcagccaaaactggggtcaaaaccgctgagggacctagtttgcactggttttgtaagttgggggatgcgcggttttgcggttaggggactattttgtaactcgatggcaagttgagggaccttcggtatactttttccaggaagagaaaggtccggataatgtgcaaatggaatattgcatcggtatagaattgccttgccatggcccacaggcccagtaggcgatagtccaactagagcccaaaaaaccggagttcagaagttctcgcaaattccgaaggcttagcccaactcaacattttgctgtctcgcgtttccgcggcatatctccatcagctttcagctctctgaccagtgccgcccactacccagcaggcaaaatgcttgaagcgaagtatcaggtgtgtgtcagttgggtctcgtgcggtgaagtccccgctaagcaaaggccaaagggcgagaggatcccgtacgtggagtatgcgaacgccgcatcgctctgcggtctgcaccacacagacacaggtaacaggttgctctcccactcacctttgtgcagcgcgtcaagcgaaagccatctcccattccttgacgccatcggcaacccgcgccgcgcgcacattgccgtagcccaaccccacgctatatggtcccatgcacaacgacgtcgccggtctcgggttgcttccacttgcctagatacgacgcgccaaggaagatgacgcgtcgcgctgatgatctcctggttgccggaacgctcgtcatctccatcgtcttcttcaggtgcgccgctgccgtggcagccaccgagtatgtccggcctccccccgggcgggtcatcttcactgagcacaccaagcccgcctcacatcctcaacaggtatactacgtacacaaatgcgagttcttgaggatgcgttctatattcgtttagggaaatgacgatcgatgattgatccgtttgtatctaggttcatgtgtcgctcgtcggggcgaaccatatgagagtgtcatggatcacggaggacaagcacgtcaagtccgtggtggagtatggcaaggtctccgggaactacacggcgtcggccaccggcgagcacacatcctaccgctacttcctctactcctccggcaagatccaccacgtcaagatcggaccgctggatcccggcacggtgtactactaccggtgcggcatggccggcgacgagttcggcctcaggaccccgccggccgcgctcccagtcgagctcgccgtcgcgggggatcttgggcagaccgagtggacggcgtcgacgctgtcccacgtcggcaggtccgactacgacgtgctgctggttcccggcgacctgtcctacgccgacgcccagcagccgctgtgggactcgttcggccggttcgtgcagaagtacgcgagccggcggccatggatggtcaccgaagggaaccacgaggtggaggccgcgatggcgctcccgggctggccgcggccgttcacggcgtacgccgcgcggtggcggatgccgtacgaggagagcggctcggggaccagcctctactactccttcgacgccgccggcggcgccgtccacgtcgtcatgctcggctcgtacgccgacttcaactcgagctcggagcagtacaggtggctggcccgcgacctcgccgccgtcgaccgcggcgcgacgccctgggtcgtggtgctgctgcacgcgccctggtacaacacgaacgcggcgcacgagggggagggcgaggccatgaggaaggccatggagcgcctcctctacgaggcccgcgtcgacatcgtcttcgccggccatgtccacgcctacgaacgcttcgtgagttcgattttgatcagcgccattgctcgaacggttgatcacacgtacaattctcaactaagcagtgcacgtcttgactttgtcgctgcagacaagggtatataacaacgaggcgaacccgtgtggaccggtgcacatcaccataggcgacggcggcaacagggaaggcctcgcatttgagtaagcactaaacattaacaccggcaaaataacttacaaatcttgatagctaaccatagctcacggctaaatctggttggatatcagctttcggaagaaccacaagctggcgccgctctcgttgatgagggaggcgagcttcgggcacgggcggctgagcgtggtgaacgcgaccgccgcgcgctggacgtggcaccgcaacgacgacgccgactccaccgtgcgcgacgagatctggctggagagcctggctgccaacggcgcgtgccagcagagtagcagcgccgccgccgccgcggactctcagaacgacgagttgtagcattgcacattgcttgatattaattcaacaaattaatttgatagcgctcttaatttgcttgtcacgtgccggtgaacctgggtgcttactttacgggcaaacaatgcatttgtaccatagtgtggttagtggccagtagtgcttaggccggcggcatttgccgtgcctctgatagctagaacgaacaacttctgtgcctgtttgtgggtgtaatcatggttgttaccattccagatttcctgtgtgatgtgctttgcacgctagttctgcctacccttgaactcaataattaaaatgttcgtccatagacacacggtagtcatatatgtgcgcggacgcgctagcttgttaagaatttcgtatattggtgtggttgggcaatgcagttatgactcatcgaagtagtggtttcccaaaccgctggagccagattaccgcgccctgtcggtaagcactgtaaccgcggtaaccgtgacaaaccgtatagtaaaatttattaaaattttaaattattttttaaatttatttgaatttaaggaggttaccacggtttttctcttactgtactctacggtaaccacgcgaaccggcggttttggaaacccttcattgaacttgaaccaatgcataaacagcatatcagatcaatcagagaaaccagaagctagaataacaattagagacagtatgtgacaaaaaagtattggtcaatcttacattgtgtcaaattgtgaacgtctgtgtacactactaaattgtcaacattagtagtacatatgccggcttggcggccatgacacacgacgggacggggtcgccggctcgccgccggggcgcgccgacaccggccacctcgcgcaccgggtggcgcgctcccgcagccacgcacggccggtgcacacaccctgcgcgcgtgcagcctggtgtagcgcctactccccgacgacgaggacgtcgacccggcgtcttcgtcgacgccgcatgagccggcgccggcgcaggaagaggaggaaagcgaggaggccgagcagcagggcgaggcggcggagttggcgtccgcgtcgccgccgctgccgccttctcgtctcgcgtgcatgcgctggcgggagccgaccgcgcagaggctcatcctcgccggtcggccgctgcaatcgctgttgtctcctctccgccggcgaccctccaacctccatcgctgctcctacccttacgccatggccggcaacctcacgaccagagcatgcggcgttatattactgtaactccgctgcgaaagcaagctgtcatcttgcagcgaagcgacgcaaggaatacgactaccaggactggatcgagttaatggctaatggtgatcgcctgatcggtaacgatgctatgtggctcgcgtcgcgccgagaagagggcggagatgatcaaaaggcgtcagcgcgaggccggaccaggaatccagcagggagacaggggtgcgtggcgtttgtttcaaggttcggcaaggaatcccgtcgcgatacaggaccggacttctgaaaaggagaacaggaccagacttcgttgatgagagggcctgcaaagactgaacggatttttgtttgtcacgttgtactgaaccaaagtgcgctggggtcaaccggcaaactgatcaagttggttgcatctccttttttttttccagatagtgaatacaaatgagtcatgacacacataattgtttcaatttcagaatttcttagcagccactacataaatacataagcaaatagagtacgtaacaaattaagcttcagtgttcaacttttattctcaaacacgattacaaaagaggatataggattgcaacgacacgattttgaagtttgaaccgggcaatctcatcctaaatcacggcactgacaagtgagaaacactttgttcccttcccagcgtttgctcgttcgacgacgactaacacgcgacaattatcaccaaatcttttattctttgaactaccactaataaccgtagcagcagctaagcacgtatatattactatattagtttatataggtaattaaacaccgagaaaaaacagctctacgacttcgctttctcacctcacttcttgcagaccaggccggcgctgcccttcccgctgccgcagagcgcgtcggccggcgcgtcgaccatgccaacggacgaggcgagcgcgccgtcctcgccggcgaagcgcgccacctcgcagtccgtggcgaagatgtcggaaacggcgtacttcccggcgctacccatgaccgggatcttggcgcccacgtccacgccggcgctgacgtagtcggggcggtaggtctggcccagcacgccgtgcacgtcggcgctgatggagtagaacttgaacgccacattgaggtgggcgaggctgtcgtcggcggtgaggccgtagccgtggatcctcgagtcctcctccgtgacgggcaccgcgttggcgacgatgcggaaccggccgtcgaggcgcaccaccacgccgttggccgggccggtgcggaagaccgagagcgccggaacggaggctgggctccagctggcggcggggacggcgtccagctcgacgggcgcgccgtcgaaggtgatcacgaggcggtcgacggcggcgtcccacctgacggtcctcctgacgccgaggtagaggcggtggccgccgaagcggatgccgagggcctgcacccaggtgaagtcccgtgccgccgccgcgttgcgcttgccgatgaagtgcgcgttgatgtgcaggttggcgtcggagagcaggcagaagtcggcgtccttgcgcccgtggaacaggaacttgttgccgtcgccgccgacgaaccgcgggtcgtagcactccgtgccggtcagctcacacactgcatgcaccagtcacagtccaaaacccgacatgcaaaaccgatcatcaaaaaccaccccaaacgtaacgcgcctacctactattaccatgcatgatatgcattctgttttgaactttttgatgcgttttcttacggcagacgagcttgcaggtggggcagtgaacgtagcacatgtcgcggcagccgcgcgggcacgcgcgcggctcgaccgtgcagtcggggcccgacgccgtgttgttctggttgtagcagctcgccacggtgggcgacgagccgggggtcatgtagatggggatcacgttggggtccctcaggatggggctgtccgggctcagcggctgggcgcccaccgcgacgacgaggaaagcggtggcggcgagcagcagcgccgccgcggacggccggacgggcaccatctccggtgagagattgatcgagccggtgagatagttgttaggggggtgagatagttgttaggggggtgaacgcacgttagtggttgtgatacgatggaacaggctcgcgcgcttttttataggcggggtctattggtggcatattgagctctgaccaagcgtgtgtcgttggaattaagcatggctttttcgccaatcaagtctggggaagtcaacttctctctcactcgcgcggcgagctccacatgaaacgattccacgcttgacatcccggccaacggaatgcggttgcttgttcttgatcttggtttcgagtacaatcttctctacgttatggcaaccgcaggatccacccttatcagcctgttccaaagttatttatattttccttttctccctaactcacccttatcagcctgttccatagttatttatattttcctttcctccctaacgaaaaataaagtgtttatctgcttgtccatcttgattctaacgcaaaaacgtaaatccaatactcccattcttccaatactcacatccatttttttttttgggggggggttgggttgggggggggggggtacctgaacaatctttccacactagacttaaacgccgagaatatgtcctaacccaagtgagcatggccacaaaggttcaacgaatcttcaggaatgcggttttgagtggaataactgatgaagacacgagtacggtgtaatcttcatcgtgaggcgtaaagcatgacctgggacgcacgtgttattgtccatgaaaacacactagatctcaagttgctatcttgcttcaggatgttgctccaagaaatctaataggctattccggatatctggatcaatgtacttcaacaataccgtactggattgagtgtaccagctaattagtaattactctactgacaacgaaaacaatccaggcaatagtggaaaaattacagatcatttggttggctatggtaagttcacaaggcacagcaagatgtatgagtgtattaggagcaatggctccacggttttgacttcctggatctcacattagactcgcagctatgactgtgtttagttactgaaaaaagttgaaagtttggggaaagttggtagtttggaaaaaaaaaagttaggagtttatgtgtgtaggaaagttttggatgtgatgtgatgtgatggaaagttggaagttgggggtggagcctatgtataaatgcaaattgtactggttagcaggtgcgattgttggtttggagacagcatactgtggaaaggaacgagtgcatgcccatggccaataatataccatatgctacactggtttgcaaatcagaaaacgaaaactaacctaccaaaggaaccacctcttcctgactgcaggagttgtctcttgcactggagaactttggctccctctttttacgattccactgttcagcgcttccaaccttttcctgcaaaaaaaaacaatgtaaaatggaacagcaaaaacacaaattggcatgcaaaatagaataacagagaaaaaacaacttggcatgcaaaatggaataacagagaaaaaacagcttggcatgcaatatgaagaattaagttcatttctgaactcaaataattcaaaagttcaactggagtgaccagaaattttgaatgcaattcctttgtatataatttgttcagtactttatgcttataatggggaaatcatgactggaagacatcccagaaataaaaaggatgaaggatggcacagtgcttgaaaaacaacccttcacaaggctcagcacagacaaccacataaaaggacacccatgcctacacatgggagactagggttgtaacagcttcatttcatctgaagcagatcctccacatcaccaaaaacataatgcattaatgatacttcagatgtaaatttaatctcaactgcacggaaggaaaaaaaatgacaagccttgttttttatatgtatatattgcaattttaatccaccatctggatttgaattaataaattattcaaatgcatacgaatagttaaaaacatggttaatcaccataggcccactagcttcttaatattcaaattccacatttacaaattacaagtgagctctttcgagtttcaactatgacatagatgatcacaacgcatgaccaatacaaagtttaataccttgtgtctccaagctgtccatgtaagctccatctttggcgaaatccttccatgccctcaagtccactagcaagaatcatgcgcctataatagaaatatgaaagcacatacaagcaaaactgatgaaatcgtgtggataaatcattagaaaattcagaaaatccaatgattcattttgtatggtgctgaattatggttacaaggtactcttacaagtgtttggccttattcctggtgatactcatagactcataggtctgtcaagcacaagaacaagtacaactcatcggaacagacaaccgcgtgtggattgtgaggcctaggaagatcctgcctgtagtctatcaggcaggaaccacgtagttctctcatatgccactaaatccccagagcagatgcaggcaattataagtgttacacagagcattaggttaagcactatacaataaccatctaggaatctcaatctgaaattcagtatagtatatataaattatttacgtcgcctttctttatgcagtctaaatggccattttcgtttgatctcatcaaaatatatggccttacgtattaccacaagaaaacaggcgcaaggacatactcttggaatgtctagtacagtatctcttatttaggacctgaacacttcacacgggctcacaacagttgaatgttaatcaggaaactgtataaaacgagctgctaatcacactttgatcattgaatacatgtagggtagaagtgccatgtttggctacctttcaagcagtgtgatttctgattggagttgggtagctctttccttagcttcttccaggggcattgaaaaacccagcttatattcactatcctgcagccgctctcttatttccttgtcctgtaaaaataggagataaagtaacatgttaaacaataagggaaaatttacctgccatttttcaaataattataatacaactgacccttttctcagcacattgtcggtatagtacaatttcatcttggcaaaacggctcaatatcattgatttgcagacctgtaacatataattgctttattatagtacttactacatatggagtaaggaaagcatgatttttatgtcagagaaatcagtaactcacataagaaaagatttttgagtatgccatcacaaatctcaacaccgtcaaggacatgtgaagcaatttcctttggtatgacaggggatggcaacccacgcatgagatcatcaccaacaagaatggtctcttccatcgtttcctgcttatcgactgttgaaaaatatgtatgaaaaactaccatcatttgcacagggccacgaatagaagttacacttgaaatgcacgaacttggaaagtaagatcaggttctctggcatgctggttatactgcatgatactgactagagagttagttcctgactgtgccacagtggtttattaatgctgaattgctgatagcataggtctggttcttgcatgatcagcaaaagtcatcagttttttatgatcgagagaaaaaaaagagagttatttcctcacagttgccattacgaacttcaaaattaactcaagcccaggcaactacaatcgccactaagcttgcattaacaaccaactgcacaacctatgtgctaaaacacaatttgatcctccaaactttttaggcggtttgggcaagagaggatgaccaagttttgttaagatttacttccccaactgacacaaaataaacaaagcttaacgaaatgggaatgggcaacagagccagcgcgtgcgtaccatccatgattgcctagtaaaccttcacctccggagaacaatcagattttggcaactcgaaccgacttcttgcagccaacaatcatggaaaaaaaaacaccagaaaatgtcagcttcgattcgtcttaggggaggcgacggggagcagcgtgggacgaatcacatacagatacaccaaccaaccggagtgtccgcgacgaatcccgcggggaaatagaccggagaagaaccagaaggcggcggcgagcggcgaccgacggcgcgccgcggaggtgaaggggaggaaggagaccggaggaggagagagggtttacggctcaggtttccccaactcctgccgcttgtgggctttctccaacgaagatatgggcctaaacagtggcccatagacttgtcttacggcccatttatcgatagcccagtgcaggcatgaggcatgaggcacacggttcaggtttgcttttctcgagtaccagttcaaatttcaaaacaccgagaaagagtatgctttctactagtactatgtttgatcggctgcttactgctccctccgtcctaaaatataagtatttttagctataaatttaaacacatagctaaatgttgttatattttagggcggaacaacggaggtaatagtaatttctggtgaaccacgttttttctctctattttggattgtgcctgtcatgattgtgttttaccatgttggctccattttcctcgtggttgattcattagcaggctgttttcacaccatgatatttctgaaaaattctgggctgattttcagttgtgagatggagtatgactgtatgagatggcagaaacagcccgatgcctacacgatgcccgctttgctcttgccgtcggagcagcaccgcacgcatccacgtagtcctgagtcctgacaatttgaccgttctgctaacacgcatactacacctgtgagacctcacatctgtctcaagtcttcaggacagaattgtctgttatgtgttcttgcacagcacctggctacaagcttccaactcgcccgtatgaacttctctgaaatggatcgctgcatgaatccccttactccgatccggggggcttcagtgctactaggagtgttgtgagatctgcaaacagtatctacacactggcctcttgttaacaggagctacacatgcttattatcattactcatgagtgggcattttgctttcctttcctgactgtccaacaccaacatctccacttgcaatttgcagactcaaactgtatatgtctgtgtctacctaccactgtataatgttttgtgaaattcaaagaactgataagtaccggcctgttgggacatcatgagaatcgacaggtaggccaagtacattgctgaatgttgattattccacaccgttcttggattctcgatcttatacgaagttttattttatctcaaccagacgatgatacaattctgcaaccaactccatggctccacctccatactcccatacttctactcatagttgataccatgatactatcatatcgtgctttcattgtataccatccaaggataccagcatgtattcaggctactgtacgtacgtcacaggtcatagcagctgtttccttgggtacagccaaaacgactccatcaagcaggagcacagatgcatttgtaaacgccgtacttgtcttctcataaacacaagcagtacacagtacactccttaccatctgcattagtttctcgcctccggttaatttccagcacagtgggcggtgaaatttttggtgatcaatctctttgcacggtctctcgcgccctgtccgacagttctgttttagtggtcaatccaaatccggcccgctcgtatgcatgcaggtaatctctctttgtgttagtatttaacaccgtgaaaggaccacgcaaaaaggcagagtttcgacagaaaaaactctagctggttaatggcgtgtgtgacgcctcacctatgcgtggctgtacacgagaaaattagtgccacccttttcaatctataggtaagctacaagtaacgttaggtgatgtactgatgtgcccgtgttgacctgcgtggcatgaaaatcactgctaacaactggtctaccacatatatagccgaagcgaattatggcctagctagcgagatagatgctgtaagtaattaacaagaaataaaatggattagttagtacctatatagtctagagatattacgacgttggccgtgccaatctcctgtgttactgtgtgcgcccgtccaaacttgcaacgctcgagctgagcagatgatctgctgatgatgatgagagctgatgagctgtagagaagctagaggcaggcacggcgccgtggaacacgtcgatacttctcctcgcggagacgaaggatgcattgcgtccgctgtacacgcccatgcgctgtcccccggtagtagcagcggatcgtgacatcgtgttgaaccggcagaaacatccaaaacgaactgatactactagcagcagctagtactagtattattagacgagagggccccggcaccagtcactgcaggttaagcgcacacggcctcgcgagtctctgtagatatgcacgatccgtcttatctcttctctgctcctgaggccggccgtgagaggtttaacgggattccttcgttggtgtagtagtagacgtgtagtcctgtttgcctcgcggtcgcgggctagccaaaaaaaaaaaaaaaaagccttggatacctccgcggcggcatgtggcacccgccccacctgcgagcgcgcgtgatacgcgtatttgtgtgtcgcgccttgtccgcatccatccgacgatttccgatccgatgcagcgagcgaccgcgcgcgcgctccgccccgcggcccgcgccaacgtgtgcagctgcgtttccgtgcgcccagccccggttgcgctagccgctgttgctgccgtgctacgggcctacggcgtactccttcgtccaaaaaaaaatcaaattctgaatttatgtgtctaactttaaccatccgtcttatatcaaattgttttataatttgtattttcattgttgttagatgatactccctccattccaaattgatctacatatagttttttaagttattcctaaatgatctatatatttgtgtttatttattaagtctattcgttatttgtgcattggagtaaatggacatttatgcatgcatccatgcacacaagtatttataaaccacatgcaatatcttgatttactattggctatgaaatagtagagatggtgcatgcatcgattttgttactagagtaaatatagtatgagagatttattaacttttcttggtcttggtgtacctatgaaatatgtagatcaatttggaatggagggagtaaaacatgattaatattttatgcctgacttgtctttttaatttttttcatattttttttaaataagacggacggtcaaatgttgtacacagaaaccggagtttgtctttttttagacggaggaagtacgtcgtggagagacggacgctcggggtgcgggtggggggggggggggtccccggcacggaaggagatcgttgctgtggccgagagcgatcggtcgcctcgcgcgctttctttgcctcgttgctgtggctgcgagcgacctttccgtacgactaggagaagagaggaagagatactcctcctagtagtagattccactctacgggaggccagccggggcccccgttttgacacacggtgaaggcgaacgatccccctgtttccgcggtacgagtcgtaccgtacgcgcgccgcggtggatgtgagggtgaaacggctagcgaggctatgcaaacgagcaaatcgtggttggctggtacacggttgagccgacacgagctcactgatcagcaagccacatattgggccatttcgatcaggggatgacttgtttgatgagaaaatttaaagttcgcttggactttatacgagccacgctacgctagctttcgccttgtttctctccaagagatgacgtgcatgctactgctcttgtttaacttttcgaacatgatctcttttttgaaagatcaaacgcgatctcaacttgtggctagtccggtagtaccacggagcgtccgttttgaaatgctaaaaaatcgttgataatactccctctgtaccaaaataagtacagttttacactattcacgttcaacgtttgaccgttcatcttattttaaaaatttgtatgattagtatttttattgctattagaagataaaacgtgaatagtactttatgtgtgactaaatatttttaaatttttcataaattttttaaataagatggacggtcaaacgttgaacactgatatctatggctacacttattttggattttggtacggagtggtatatgccaacatgggagtggttacatcttcaggcggcagaagaaaatccagaggattgtgacgatcgaggtcgtgcacagttcaaccaatatactactgcttcgattgtgatttgcgcacacattagtaaacaaataatactgtactgtactagtttggattcgtctaaaaaaattaccagtctacatactatgagccttgttaattttgatgtcatttttaaccttaccaagttttggtaaagttgttaaaaaattatctacatttagtttgctgctaaattttagtaactatataaaaaatactactaaaattttggcaagtgcaataggtttttttttatcaaagtgaacatgccctataataatttaataacatactgtactagtatcaacttgcagttggtagtaccgaacaagtactacaagccatgcttgcttttctagctagtcacctgaattcgcaagcttaaaatttcaaaacaccttaggcaaactgacatatgggcccatggaaagaaaacaagaagaatggcgttttattggttactactaaccataattttttacttaactttaatcgtccgtctaatttaatttttttaaaaaattaaaaacataagccacgtataaagtactacccatattttattatctcataaaaataaaaatattaattataaaaaaatttcaaataagacggaccatgaaagttgaacacggaaactcacggttgcacttataatgagacggaggtagtatccattgtttttagagaacagaacaaaatgaaaactactcaactattgaaaaaaatcattaccgacgtaacactaatttagggttgcgtcacaagt

SEQ ID NO: 67738 - DNA, 4741 bp, Oryza sativa
tgcaacaagtatctgatttatctactcctgcaataattctttgcaaagtcttaggtacacatactgcaaacaccgcctcattagattagaaatttttacaaggcctacttcagtttttatcttactgttgaagtgttatatgctatacagaagatcagagccagaaactagctaagcaacactataattgttccttcaagatacaacaaatatatgtttgagaatgtcttagacattacataaaaaatcatattcatttcagtctggcttcacacattacatatacataaacacaatggaatattgtcaaacatcctctaaagaaagaatattgtcaaacaaaagcaatcgccatagaccataccaatggcagatgcatatggagcaatcctttcatgaaaaacaggcttgtagtgttctggatgagcataatagtcagcctgaaaaatgataccaattgggaattacagtgatgcagttgtaaagtaagggaatactaatgagatatttaacaagaatgaaaaaaagtttacgagtaatatttgaaattaattttacgataaaaggaaagttttaatcaatgtaatgaaaaatggatagcacagaattaaaaaattatccaaattgcttgatggaattaagaaacaatgaccaatattatgagacaaagggattacattaggacacaataagataagttatattatgtacactaatacaaatacacactgtaattatctcagtattttgtagcacactttaattcatcttatgtttctaaaataaaagaattgtgcattactttgttgaagcatctggtgggatccttgggagtgaccatgtctctagaagagacaacacaaccatacagctggaatactctcttgcttgattgtggatgttgagacagacttctagcctgaaaaatgaaacaataaagcataatgaggtgtcttaagaaactaatgcttatgtttacaaataaaatcaaatagctaaagtatcctatcatttagtttttttttaaaaaaaacagagtgaaactagatgtatactatcattcccacaaacaaaaaggtgctggcagaaactacattcagttcaaacaggtcaaaagagaaacttacgaaaactacgatgcttagatagttaacactaaaacttctgacagagaaggagtaataccgcagaaagctctggaagcttcccagcatcaacaaagctatggggcagtaacttgaatatctcttgcgcaccctgagaaactgtcgtgcatgaagttatatatatgtgagggatacaatgttacaatgagaccaattacaggtctaaagagatgctatttttcccagaaagtaagattacgaaatgggcaacagctaagaacttttgtctcttcaaagcaccacaatatatccaaacaacggatattcccaacttgagcttatatgatgggcaaaaaaaaaaggtacagtaaattaccatttccagttccagtgaatacaaatactattgggcaaattccagatggaagtccaaatgttgctatctcttcaccaatggcaatgactgcagccttggctgcagcgagtgaaggatacatatgtgattgccctagagagagaaatggggtcgagtatccaaggctcaagtaccctgaaatttaaggtgaaaaatgacctgcttgaataatccacaacaccaaacaattacttgtgaagactaaatggtgcttatgacgaaaaactgctacctaagatagtatgtgcagatagcagatttgggtggcactagaatatcatatcatgtcagtacatgaactgagaaattaaggcaagcattcttcatatcatgtcagtacatgaactgagaaattaaggcgagcattcttacgttgtccgagaccgtgtaagaagtctatcagtccagctctcccagcaaatttcccaaatgcaagcaatcttttcccatcatctccagcaattagctcataatcaaacagggatactcttttttcaaggatctgagaatgtgacctagaagtttagtacctccacaaaaaatgattgtatctgttaacggaaaacatggatataagaatatggtagctacctcatctaatagtggcatattttctttctgggccttatgggtgtgagaaaagaatccatatgctctatgtggaagaatcatctccagctgcataaaggaacatagataagaaaaattcataatcgcgatactggtacaggctacggtgcacagtcgattagagcatcgaagatggtaatgtaacctttggttgtttgattcctataataagaccacactctgacaggtcttttgaaatctcacacccaacatcctcgtattgagcatcatgatggatcctctttgtacttggttgcacgataatccgatttaccccagttcccctcttgcctcctccaagcagaaggcgagcacaatgggatggggttaatggtgctctcctttcccacatattagcagtctcggcaagaatcccaacaactccattgcctagtaatgtgtcactgttctgtggatgaaaataaatacagttagaatgtgaatgaacaaaaaactgcatggtttgatgtctgatagggccaagcaacatacttcatttcccgcagaacccatagagaagccctgttaaggtgccacagtgaagaacctgctatttacaattcctgagaatgaaatgcatgccaatcagggtatggagatttacaacaaatgattatagttgcaattatattttacacaaacacaatttagagcttctggaagttgcagctttttctagaatctccaactcccgaaacagtctagcttttcacccagattctaagaatcataagctatagagtctaaaaaatgattataagccataagctgcaaaacccagcttttccacattctcactagctggctactcaccaactacttctcaaattctccagcttgtcaagactacactctattgctgaaattatcttattttccaaacatttaatttgaagtttgatcaacatgacctaaatatgaagggaaatagtttctttttgtttcttaaaaaaagataaagaaatatcaagtagatgagctctcgaactgttccattgttaaacggaacccctcgtttaaacactcatgttgtcatgtgccaagtatcaatcaaataataaaaaagcaatagtgtaacgagaaagaggaactaaacatctccctttgtctataggtggagactcacagtctctcactgtgcaccatggtccactactccactctgagcctctgatgatgacaaccaaggaatctgaggtcctaatcaatgactccaagaggaaaacaatactcataccagtactatctttccaacatgattgacaaaacagaaccgttgattcttcatggaatctccggacggaccggacctcggagacaaatggcccaacggcccccaactccgcacctcactcgcacccatgccctgtacgttggggcagggatgatgatcaataattgatcatgatatgctgcattgctacctcctcacaggctccttgctgctatactattactggcctcacactttgtttctggccttctgttcacagcgtctctcgctaagcgaaaccgacgcgtaactcgtaagcgttggcaggtgtcacacgccgcgggcaaatgcgcatggacgccaccgccgcggagcacgagaggctcctgatcgtgaatccgcgccaccgcctcccccagcggccgcaatccggccgagctacccggaatcctcgcgaatgtcgtcccgatcgtctcctaccctcgggaaatcccctctctcccccgcgccgcgaatccccaaaacacacagagaaaaaaaaagaaagaaaaaaaaaagctcggctaggttggtgatggcgtcgtcgcgtacctcggattgccgcggaacggagacgacgacggaatcgtagcaggcggcggagtggaggcgcagccggagggattcgaggaacggatgcgctccagcttccagtttccaaggaggtactagtaaaataggaaggcggaagaagaagaactgcgcgatttggacacgtcggctgcggcggcgccactggccgtgggatggcgacgccgggccgacgacgccacgggagaggaaggcggcgtcgctggacctggacctggacaggagttggttctgggcggagtggaggcgacggcgacgaggacggggacggcaatatgaagctgcagcgtggccgtgtacgggggcgtggcaacagttggcaaatttgtcctctcccccctttccaagcatgagggggtgaaggatttatccagtgagtcagcgcctcagcggaatttccactttccagttgaaaagtttgtattgtttgactagttttttttaaaaaaagttattaaaaaaataacattggcagacgcacacgtacactggtagagaaaccatttttggtcggtcaacccatatccacaatagtcccggttccattaaaaaccgggactaaaaatgattttttagtcccggttaataagagaaagatctttagtcccggttgttgttaccaaccgggactaaaaatcatctttactcccggttggtaactccaaccgggactaaagttcatttttagtcccggttgattccatgtcaggctgtgtcagggccctatgatctttagtcccggttagt

SEQ ID NO: 67739 - DNA, 1062 bp, Oryza sativa
aacatgttcaagtgacaagcatgacttgccttgctcagctgctggaggaacctcggcgactatttcaaagtacaccggagcgtcgggagagccggaatctaagcgatatacaaagcaaacaatacaaacaggccataagactactgaaacagagaacaaaaccattttgaatggattctatgcatttttcttgatttactgatacttgaatgtacttaaacggaactcggatgaattagatatgaattttagaagattcactgcgtttttactataaacagaaaaatccttaattgatttattgcgcaataattaaaatcccggggagagaggggacggcgccgacaagcgggccccatatggcagtgactcgggtggcggtctgcggtggaccgggtccacggaccggggaaggagcggcgcaccacgtggcactgatgtggcgtcgacgtggcgcacacgtggcggccacgtggcagccacgcgggcggccgaaccgacggccccgatctacccgagggtatatcagacggcggcgggagcgcgcggctggcgcgcacgggcggctcaagccggcacggtggccatgccgcacggcggcgctaccgcggggcggcggcagcaaacggcggtgaccgacggcgagcggcggcggcgcgaccccgagcggcgaggggcggcagcgctaggaggggaggggaaggacgacggggttctcaccgaggattcggccggcacggaggggcgacggcgaacggcggcgaggaatgagtgggaggcgacgacgaacggtggacggtctccggaaccacctagcggacatgataaaaggggttagagagagagaggaggatggaagagggctaggacgccggccgaaggcggcggccatggcggtgctcaccggtgcacgatgcggagtgggtgtcacgcccggaatttctatccaaaattccaaacgcttacatgtgtgtgaaccctcgtccaggaatcagccgaggcacacaataacaaattgataatagagtacaaatattactctaattaataagcgaataaaat

SEQ ID NO: 67740 - DNA, 25511 bp, Oryza sativa
aaagaacaggatatctcatctgctagacggcaactaccacatccaagttgagcaccacgatgtatgcaaatttaacccagttacctacgctaacatgtttttaacttcagtatttgataattagtataggcacccataacttcaacacatatctgacccatttccgatagttcagcctacacaagcctttcaaaattgtttccaaaaagcatttgtgaaaggaatggatcttctgcagaacaccaaatggcatgcgctaaacatgaagggtggacatgatggaattcgcaatcaggaaacaagtcactgtgataattgataaagcttactagtggaaattttgaaaattaccaataatagcagcagcacgcatatcagaatatggttcttcgccagtaagcagctcccacatcacaataccaaacgagtatacatcaatctacaagtaagcgccatatcagtttcagttggaatataaaaaatgaagaacattagttttaatgacttatgatccataagggtgcttataatttataaagccagtgttcttaccttctctgacaccatattgcttttcccactcagaagctctggtgccatccatggtaaggttcctctaacaccgccagacaccaaagtgtgctgcttcacctttgatagtccaagatcaccaatctgagcagaaaatggaggtgggatgacagtcaggtaacaaccatttgaagcaagagctgaggaaatgaagatgagagggcagggatcaaactttgcagattggtcgttgtggatccctcatgttgaccagtaggttctcacactttagatcaaaatgaactatattcttcccatgcaaatattccatgccaaatgcagcatccatggctaatataactcttttacggcgatcaattgtcctgtgcagttgctttaatttagaatttggatatttgagaataaaagaatcatagtgttctttgattaaacaagtaatacctgtctttttttctcaaaaactgtttgagagatccattgatcataaactcagtaacagttgctaagcttccatcaggaccgtcacgaactacaccataaaatgaaaccacatttggatgatgaagtgaacttagaatctgagcttctttccagaaatcagcaatctgcaaaaccacatatatatctgaactagagatcttctccatagaatacacaaaagcaagaaaatcactatccagagggttttaacagaaatctttaacaaggaaaaaaaaagctatgaaatcaatcctaaaagttctaaggtgttaacaagtcaatcaagcataccaaacgctctctctcagatggtctgccagcaaaacagctagcctttatccttttaatagcaacatcacatcctctccatttaccatggtaaactgcaccataagtacctgaacctagctccctaatttcctccaagtcatcattttttatagtctgcatgatccaaacagagcatataagcgggatacaatgttgaattaaaaacaatactacatatcaagagatcagaaaaaacacctgtagtccttttgataaagcttctgcttcagcggttgtagcctcaattccagaacttttctgctgctcaccacttccatgcacatcagaatcctgatctgtaccagtattctgcacataaaaaggattttagttaagagcactaggtagctaagccagtaatgtgtaaaggtcaagtattacttacaccagcaggtgtctcctccaacttctttccattgccttcctcatcacaagtcggcaaaagagtgggaccagcatcttgttgagccttttctttctcttcagaatcttctaatgcagccttcttaacagatgcagccagctctggaaggaaattcaatctatcctctgaaatatccccacattcctgcagtgctgtagcccctccttcatgcactttacttgtgacagtttcatattcgacaggcttcctctgtttgggatcaacttcaggtacaactccgatatggtgggtcaaggcacttggatcattcatagcatgcaaagaagttgtttcattcgcatttcgggtaaacttctcatgctctggaccttcaagtttcttcaatggattgatatccatcctggacaactgatcagtgaggggtaatgcagctactctgcatcaacttgtgatgatagaacagatcccccgcatgctctttcaggatgaatctccatcagtggagctcctggttgattttggactgattcaggggcaaataaaggctgaacatactggccactgtttggatttgaccggttttctacaacagcagggatatcatgtccaacaactcgatatggtatgcttccattgggtgagggccatgggtttgggattctatcatatgcaggcatacctggaatccgtggactaacatcacctgtatttttgacaaagttgccatttggaattggcaggtgtggtgattcatagggtgaacctgtatggacaggactatttgttctttccctcaaagattgaagtggtggcagattttgctgcatttggtaaaaggggtttgcaccatatgttgaagagtggctataatgctgacctgtagatttttcaaattctggtgtctggacatatggcccaccgactccaacttgttggttatgatatggatcactgacatggtcactactgccatgaaaatagtgcggactttcatggctagatcgactgagagatgtaactgagctgttgtcaacaatgtatggttccatcgctctagcactaccaggcatatgcaaccttggatcttcatatcgctgatggctttggtttgcatgtgcatgccaagctctatcatgagaatgcgattcgttataaaacatgggaggagggtgaccaccagtctgctctttgacataaacaccattttccagtctaacatcttggtttaatacaaaacgctcaccagggcggttgcaatctggacatgaattagtagggtgaccagaatactcatttgtcatgctcgtttggtcaaaatgttgaataggcctccaacgaggatccacatatcgaggatcaccttgacccttatggaatggtgaacggcagtgatcatacatactgcttccatccaagaaattgccagggcgacccaagttacctgggaagcctgcgttttgctgaattacagcgcctggaggaagccagaccaaattatccacatgctgtggtgaatgaacctcataatgccgatattttggcgaatgccttacaaagtcatcaggaatcctctcatcaaaatcttctgctccaacttgaaaccttggtgaaatgggaaaatctcgaggatcatgcactccatagtgccctggagagatatatgcagggctccaaggagaatccatctccccatacctttggctatgtgaagggcgaggaacattcaaatgccgcagaccagcaatatcaggaattccagactcgttgcctccaataccaaagagctgctccacggatacaggagaggaaggtgttctaacatcgccgaggctattaagtgcatcaacatacctcctctctgtctctctctcatctccattgtaatggacagccgctgctgcggcctcatcgtctaagtgctgtgagaacaagaaaatcctcaaccgagtaaacccctctcctgcagcaatgagcttgtcgtactcctccatcatgttcaccacatcgtcatcgttaacaaccgagaccagggcatctagatcctcatcaggttgctggtacttgatgatatcagcatcctcatagagctcacgcatccgcgctgctaggtcagtgtaggatacatcacgcggcagcataacaatcctggtctcgccgccgacgtaacgcagacgcccatcaagtgggcggggcaggatgcttcctccaaagctgcagaggaacttggccatgcgaggggctccatcagcctcggcgctgcctgcagagacgctggcaggggcagcagcgggcgccatgcgtgcggagactgggaaaaatgctaccaagttggggtgatttgggtgaagtacatcacacgattcaaatcaaacagttggtattcactttttttttttgcgccgattagtctcttcctgaagaacaaaaaaattttaaaaaaaagattatgaacacattcaagaaaaaaaaatctccatcttttatcagaaggatacacaacaaacactcattgaattccaacataaccaacaaatttctctcttttttgtctgattacctcagatcagagtgaaagatcgcacttcgatccacaaaagatgaacaccaaacaatgcaaaggctgaaaaaaaaaactctgcccacaaatacctgatataaatccccaaaacaaaaaatcttgagacaagctgaatgcaagcacagtcaagaaaacatttcgatgattgcaacaccgtggcaaatgaaaggaaccccagctccggctaaattcccctcgagcacaaggggaacaaaagatcgcaaccgattccacccccgatgaatatctggcgccgttcagcccgcagaaaagaaaaggctccccttttttctcccgcagaaatagggcgataaaaaaggataagaacgaacagaagaaacaaacaaacaaacaaaaatcaattccccacaccccccaagaaaaaaaaagagaggaggacaaaatcagcacacagcaaataaatcgagggatagacatagaaggatgctgctgcggcgttactgcgtacctatccggcgatctggcgctcaagcaaagcgagcaaccaatagcttcggggcggcggcggaggtgggaaaccgcctgaaggaggggaggcagggagaggaggagggagggaggaggaaggttgattcgggcgggcgcgcgcggatattctcccccagagatggctaggggggggggatcatgtcactcgcgggagcgcgagcgcgacgcgagggccatcgccgccgccattggaacgcaacagagagagagagagagagagagaggggacgaaccggggcgtggtcgggtcgggtcgggtggggtggcgtcgcgctcgtcggcgtcgagatgggtcgtgcgcgcgcacaggcgaggcgaggcgtgtggcgtgtggcgtggctgcggcgcgggatcggatcacgcctctggtgtgtttgtttcgttttgtttagggttgggttgggtcggtgtacacgcggcggcggcgggggaggggcgtgtttgttgttcgtttgttcgctggctgcttcggccgtgcggccgctcggtttcggtgtagagaggtcatctcatctggttggtttgcggctggggttcatcttccttccctgggcgaccggtagtgtactgtagacttttatttactcgtatagtgtacacgcatggaaagtatggaacgagtcgtcaactgaccgccggatagtccatccttgcagttagcacttgcaaggatgaaaaatgatgtcttccgacgcgtccagttgaagaaatatttctaactataaatatccagatttatagtagtaatttggttgtgttttaagttgaacaaagagaataaaagaacatcgtttttcacatgaaagcttaccaaactgttaaatggtgtattttttttttaaaaaatactttgtataaaaaggttgctttaaaaattcatattattatgttttaaaataattaatacttaattcattacgtactaatagaagtattaatatatattattataagtttataaagttttgaaaaaatatatcatttaggagtcttgaaagtgcgcttataaaagaggaggtattagtttagtagccttgactttgcattgttttaattagtttgaccactcctgttttataaataaattttgaagtattaaaagtatactatatttaccaaagtatgttacatggtaaatgcatataaatttataaatcccatgcatggtaattaaagagatgattaaaaaagatataggtggtcaaactaaactatctatttagtcacaattaccagggaaggcgtgatggatatgttgcagtatgtgccttaattagaaatatgacgtctccatgtcaatgtatatcattgaaaactgtcattttcggtgtagtactgtgtttatcaacggctattatctttcaataaccaataagaaaaggtcttttgtttgtaagagaggaatgaaagagatatagattagaaagatatttccccttttctttttatcctttatttcttttatttctatggatcaaatattcttttttatggaagaaaaaaaatagatttaactcatattcacgaagccctagatttttgggccgagctggatttgaaccagcgtagacaaattgtcaacgaatttacagtcaaggtgatattcgaacgcggaatgactttgtttggtcgttttcataatcccttctggtaggacatttgccctatctgttttctcatagacaaaatctgattagtgtttttttaaataataaataaaggtgaatagtcaatctaatcacccttattactgattattagggcatgtacaaaagtagagtcagatatgagctctacgttatctagagactagtcatcttacaacagttagagataatatggtctctaaccattaatgtatcaaaatactttttattactctcttttcctttcttttaccaccatgcaacaaaattggctctaataaatgctaaaagtcgactctgacccatggccatgcataacaaccatacccttttcttttttttccatgtcatcaaattaactggcttggcattagagagataccactaataaagaccattgtacatgcccttatgtttatccttgtggcatctaagtgggcccaatgacaactttgaactaaaataaaattttgaagttataaaataggcagattaaaacattaaaagtcaaactagtcttaaataaaacttggagaaccacgttaactatttacccaaatagtaaaatctgattactatttaggcacaacaatcccatttttataaactggatttgccctgcaactcttttcatataccaagtctcgataacagtgtgacatgctaaaaaagtctccagtctctactctctacccatcctttaatcgatccattgcatgtcctatatacgcagttaaaattggcacttttatttgtggcatcacttctctccaaaagcataatctcatgcaaaaaaaaagagagagagagggcatatattattttttgttttttgccgggccaccggcggtgaataaacgacccgaggaattttattaataaaattgacaggtcctctaaacgaacatgactttacatcgtccaagtcaaagcacacagcatgccgggtatatattatctgttgcaattatactttcagccaagttgtaattaagcttgctaacaactaagtggcaataagactgtatatcctttttcaatattcacatctgggaaacgcataaagagagaaccatggaacccatggcaccaaaaagcaaccacaaatcgcatcaggctatgactcagaaatacttatgcttgatatataccgtgaaaagaattggtgagatcacacccaaatttttttccaataatgaaaggagtgagactaccaatatcgttggtattatgctctaaaggaagaatcaaaccatgcgtatctctcagcacaaagagtgataaagagtgttatggaacttaaagatgggcacggagaatatgttcttcaggtttgtctggagcaggtacagaattataaggagttgcttccactaaagaaaatgccctaaaaataatgcttgaataaaaaaaaaaggtgctccatgctctttccattctgtcgtacattccgtcatttctagccgccagctagtatatcctatttctatagaacattgctattgaaaaggacaaagtatgagattaacatgtttcagtggaggctgcatgtatatgcatttatgcatgagtgagctgttttgtttagttaggatatactcctacatcgttccttttctgttcatagtaacatgtttctccaaataggttcatacaagtccctattggccggaacaaggaattcctattctcaatcagttattaccactacacaaaagggagaacaatggctatgtttatgcatttcctttactgacaaacccatttactacaaatatatttccccttttgctttcaaatgtgtttgcattatcatttttaggtggtccctcttaccatgttatcttcttttctcaaagaatgattttatgacttttaagatgtgccaatattaataacattttctaatatgaattttgatacatcttaatctatatttacaatacataatttctgaatttggtatatgtatctctcagaaagggtaaacttctctctcaaaaacaaagaacactacttctcgatcatttttttggagtttatctcacttcttactatgggaattagaccattcctagaaaatttacatgtacttcaatcatttgagttagggatatttttcgctatgtacggtccagcaacttttggcacgtagaccaaggttagccgcacgagtgacgcggcgatattaatttcagagagcccaaggccatcatcatatacacagagaagacgtagtcgcctcgcctcgccgcttgttcatacacagagaagacgtcgtcgcgctcgtcgcttgttgccttgttggcttggctatttggcacggcacgacaaaaacgaaagagcactggtgccgattcccaacaatgtaacggccgtttcgctggcaaaacgaaaaaaaggcagcagaccagagctatctgctgcctctttcgggcgccaacccaacctgtggctgcagttgccgttgcgctgtgtgccgcgtctgcgtttccgcggcagcgtgtgcaagtctcccggagccaaccaaattggtcgtcagctcgtgccttcacgtatccgccatgctatgcacgcgaaccatcctgtaatactgcagcagatggcatatgcgaaactgcaacccagataccacaagctttttggccatttcccctccttaccaatcctacgtgaaactaccatgaaatcaagcaagctggacagcttcttgctttctatttttctgtcaaccaagacaggtgtcacggcgatctcctccgtataggcgagtttccaggcatatgtctccggcgccgaaccaatcggcgccggccatctccgccctctcgagtttagtcacttcaaacatctcgttgtcgaatagaggcaggtcgcatcgcgtgattgggccgcctctttggtctcccctttccgtgtgtgaatgtctctgcatttctggcttctcccacagtgctctccgctctgctcgacgtcggcgtcgcgatcatcgtttccggtcctcaggtttggggctgcgttgcgcgccactcgaccggaatggcagccggatgcttccaaggttgacgctccatccagctcgccggacagcaacggctcggcggacggccggaggcggcaggatcggacggcggaggaggggttggaccacccgatcgacggctggatgggctccttgtctcgcatcggtagcacagggagtggctcagttccgtcctcgcggcagccaccactttacagattgtcacttcccaggtgatgtaaatgtgcaggcgcagcgctagctgccagctcgctttcacgatcgagctgacagtcctcgatgggcattgccaattattaccatcaggaaaagaacaacaaacagcatcatggctttcgatgctcacgagctgctgacaggaaagtggcaaccaaagatatactccattcgtcaaaaaaaaaaaacaactttagacaaaaaaaattatctaggttcattctcaaaagttatctttttttttttttgacaaaggaagtatctgagagcaggacacggtaattctgacaatggatgaggatggccatcgtgacaaagaaaaccaccaaacgacttggaaagtaataaagggtccgtggccagctctgaagggcgtcgagtacattccaaactcaaacgctttcaggcgttagccatccaacatcaatagttagcaatccatgttgatgactattcagaaccatgcctaattgccttaacagggggacacgcgcccacgacacatcagtgaacagtgcaatgcatatggctattaggctatatgctgttgtgatagtgattagctacgatagacagctacgtgtacgtgatactactttttaacaaacatggtgtaattttgaattttttttaaactctatggtgcatcttgtaaatttatgcttgtaggagcctttaccaaagaaagaaagtgtgcgtcaattcagaaatatactccctccgttccaaaataagtacagttttgcactgttcacgttcaacgtttgaccgttcattttatttgaatttttttatggttagtatttttattgctcttagatgataaaacatgaatagtactttatgtgtgactaaatattttcaaatttttcacaaaattttcaaataagacggacagtcaaacgttggacacggatattcacggctgcacttattttaggacggaggtagtacatgatactgccatgaaatatacgtgttacctctgatgttactgttgtacaaaaatacatctcctaatattgtagaataacattctgtatgataaaactttcccatccagggtacgaactaagtattgacctgtcaaaagggccgaggaaaaaacctcctcgagagaaacaatttccccctgcagattcaggcacttcattaattagccaaggaaaaatggcataacaatatcatgaaatgcaaggtagtaagaagcattcggtactgagatgagtgaaaaaaaagtagattcattgataaagtaaaaaaactatctacaataaccttcccaatgtacatactttacatattagtgtgcaaggcatacttacagaaaggggaagaatgcacactccaatctgcttcaacaaactaatggtacaacaatatggcaagtagctgattctctgcaaaaaaaactgccatggcctccaagatgttgctctaaggggaaaatccccccaaaaaatgctatttacattgtattcctgcgcctctccatctactatgtgttaaattaacacaggttaaactgttatccgtccaattgatttcccagtgccatcagcactcatgacactggtctattttgcaatgtaagatcagaaacagatgaaagctcctcctccaaagtgttaagaagatcaaggtactctctgaacacatcatgtgactgcaagttgtttgtaagcaagtcagggacattcttagaaagttcataaaccgtacaaacaagaatattttatgattgtaaacctgtaaggtgatgttatatgctttccacagtcgcaaatcatgtcgaaagagatccaccaaaacctgagaaacaagaaagcatgtgtgcagcaaggatgagtatgcttcttacaaaacattcaataatcaatccatggtaaaaatccaaaaaacaaaatgaggaaaaaaaaccctgcattgtcagatgcagaagcctgccacaagttagtcaaaagaacagtattttctgaaattgtgtgcacaattgttgaacatgtgaaagataggcagtacctcagcgcgtctcaataaagttgctagcacaacaatccattccttaaacttgacagaacacatgtgagcaagaaggaactcagcatcaagccgactttgaagagtgtccatttgaagctgtcatcagaatatcaattataaatgagaacaaagatccaaggcagataataatatcagcgagattgttctggtatattggttgctcaggtattgagtgatttactcaagtaagcactattctatttgttaaacaaacatccataattactaagcttgcccagattcgtaattttatatcatgaacaatcaattcagtacattatcaagctttgtaaaagtacaaactgcaggagaaaacagcagaaaactcgagaaaaataatccaagaccgcaaaatcttatctagtgtgtgatcttggttaatacctgttgtgttgctttgttttaaattgaagaatttcatctttcaggattacagagcattgaattttttaaaagaatatttttttttgcaggcccaaatgttatttattatgaagaaaaaaagtagaaaagctagacatgattcctatattgataggcaagacaaaaaaaaaatcatgtaattttttctttttttacaggaaaatttgctactaaatggaacacactaaataatgcttcatggtttgttaacgagaccttttgtccaatcagttcaagtgcagatgcaaaattctctagtcgagcagaccctagcctttctcgctgaagatattcctgcataaagttataaatatattaataacatgtggttttggatcaacaagactggtaatgatgatgaacagtgaaaatcttaccacaagatcaaactgagttcctttcacaaaagcaaccagcttagaaagctccttgccagacatcaaatagctagcatggttctccagaatattcatgacagaggcaatatgtgggctgagctctttcattgagttactgcacaaagaaagatttacagatgacatattttctaatagaaactctatagccttttaagttaacttcacaatgtaccttctcaaatcagaagattgtctcttgaatggtgaacgtaattgaaagtagctcagaaaccttggagaaagcttttcagagtctgtactggcattttcaaagtctctgccagatcttagcaagaagcgaacctaggtacatgaaggtatccccttactcatctgtggcattttattataggaaattaaaaagatatagcatgaatatcataccagctccccagcaagctcatagagagattcatcaagtgtagcctggatagtaacaagcactaaaaagtgagaactggaaatgtgaaacaagtaaacgtacagatcaaaaccagctgacagtgagaaggtaagagaatcacttgtagcaaacggagtgcacagtactgactgacagcagggccttccagcttcgcaatgacctgtaatagcaaagccattttcagcaatagttcttgcaggtattgatgaccctctgttgcatataactaggtttatcaaacttaatagatgaagaaattgtctgttcatgcaagcaataaatactggactttatagtatttaacgtctctagaagagtttaccgtaccagaatgtagcaagcagcagtcctataccatcgccgttggaagcattcctcaaacatcctagaacatgagggatcagttttactaaaagaattagcagaattattgtattgtattccaaatcttgatcaaattgagacactgttggtgggtaagttttgttttcactaaatttcattttgattctgatcatttccatgatacaaacactgtttgcaccatggtataaaagaagaatatgtgaggtactttggactttggagatgtttatagacagaatgaagaatcagatcttaaaaaataactgaaaaaaataaatcaaatgccacttctctccactcaaacaacaaggcagcacacttactctgtggatcgtccagctgcatggaaaagatctgcccagtgccgaccatcagttttcctagcaacactgactacaacatccatgtattctggaaagtttcgaagtaggtcacatgtcttgtctagaagagacttctttgcaggttcatttttctgcgaaagctggttttttgaagcactttggctgcaattggcaaaaaaagccaccagaaaataggatacagaataatatttcagcaaataacacaatagaatgaaatctagcaactcggtacacaaataatgcaagaatgctaccattaccaagttagaaccaatataccttgatatctctgcatcaaataccgtaaacaggagccattccaaacatctagagaagtgaggtttctctgcagacaagtttgccaaacgcagagcttcttcatgtttgtctctctggtttcaaaaattttacagaatgagagatgcatagggaaatgattattgccatatgagtttggcaaaccatgcatagttaatggtccataatacataaaatgatgcaagtagccaagtaaaggctccctgtaaacaggggatattcaaagtgaaaaaaaaatgtttttttttcccaaggctatggttcataatacatatggcttattctatgtgaaaactgtttcttttaatagaaatttcagaatataatatttcgatccctttacagaagtgattgatagaagagctaggtaagtgctagattcgcaacaaacaaaatgtcttgcagcacaactcggcaaaggaagatattacaatatagaaactatatgagaaactacatgacagtgcagtggtttgtaaattgttacaaaagaggatctcatataaacggactaaaccagaggaaagaacaagtatggccaacaacccataaaacctatactcttcttgtttcagcaatgagttctacggaatactaaaaagtgcagagaaaaggtggaagaaccaaaggaaaatgatgaacaaatgcgcacaacctagtgaattggttcattcagccagcagagcaacagaatagagacacctttatacaaattaaaactagtggcctgaaacaaggtttagatgctcaaataacaataaatggtggcagaccactttgggtgctcacgtcagtcttgataagaaatcaggtcattttctatttaaccatgacaataaacaggtttttcgcttggtttgcaccatcacataatccttagtgagaactcaatttcacgtgtaatattactaggagtcaaattttcttgactaaatgaagatttcatgatttaccactcttcttgcattaatgtcatatagttcctatatatagcatttctatataaaaagaattatgttttgatttacctgaaggagatgccgcagcaaacaatgcaatattgtttgggcttgaggagaaggttcaaagcatggaaactctgcagtcgagaaggacattctctgagaaataccaacaactacaccaacatttggaagaagaccaagcggatacacctcacggtcaaattcaagctccggatccagctgcagaaacaaatagcatgttctccattaactttgaatactaccaccaataagagttcaatgcaagaaagaaaacaacatatgaaactattatgattttgatcaagtttttccccaaaaaaaattgataaattcacagagtggatcgcaaaactcaaaagagatgtcaatactatcacaagatacaaaatctgtacctgcaagaaatcttcttgtttaaaaggattttctccatgggatgggtaccacacctgccaaaaaaaaagagaagggttggataaaaggatagcaagatgtggaaagatgttcgatctattaagagagacaagcataattccttaaaaataataaagaagaaaaccattaaaactaacctgcatccccttatggccatagtcaagccatgaaacctctttgataagattacccttctcttcgtattgggaacaagtgacccaaaataattcaactgaattagtaagtgattgttcatgtccatcatccatgtccaacacagaaagttccccattcatccgcaagattaggcatctgaaatatatataacaaaacaaataaaaattaaggagaatagaaatcatttacaattttaacatttgaaaaaagtaccttgaaggttgttgggacaagtcagaagatccattagtatcatgtttcggctttccttcatcagttggttcaggaatgaagcgcatcgaaacaggtggactctttggactcatgattgaaagttctcggactgttgaaagctgctgacccaaagaaaacaacaaggtcaaatgaaatggacaacacattcggtgcagtggttgaaaatattttgcttcacctgtaaaacaggactactagcaggtgacaattctcctgatatcaccacatggaaaatatgcacatcaaatggactgtaggtaacaagtatgtagtcctggaagacatccatgacaattggtcgaccaagaagtgatttccggtaaagtaatgagctataatcaaggtgatatcttgggaaaaagagaagctcatacctaagacaagtgcaacaaacatgtcatataactaaatagatagcaagtcatgcccgcatattggtatttaaataggaataaaaagctaggagatacagaagatggctctctgatatattagcacactatgcatttcagctagtattctgtgagttcaagcaccatgagatttgtgcatgaaactctcagctcaaatgtaatgacaagtaaaaattgtcatgtgtctgttaagaaaatctcaggctgaagacaataaacagacagaaacagagaaagtgaggaagcaagactaacgtatttgatgattcaatgtagttgcatacaataactattttgccaagccacaacaagcctttgcattgaatcttttgctcttgagtaacatccccaaaaacacgccaccttttattgcgcaaatcatacagcactagcccatgagagcctgcaactgccaagtacataccatcattgcttgcaacaacatgaagaactggccaattctgtgaaatataggatgcctgcttccagaaaaaaaaactatattataacaagtcttgaaataagatgcattgaggcatttttgcctcctaaataagtttgatgaaatcaaacacttaactggaacattaagatgcaacatcttaagttcatcagtatcatccggttgtaccaataggattcgatcttcaccataaagaatctggcgagtatatgttgtgcccaaaagtcctctgtttaggcaacatttggcaaatgagaatgcaagaatcctttctgacaagttttcttcaactgcaaatagtttatatccataatcatcccactgaatgtgtgacgtccctcccattagaggctcaaattttaaagcactaggtttaaccattggagatgaggcagaatttgatccggtttgacgaattgtgcacatcaaacgacatccagatacagaccacacagtaagtcccctaaatttccatccaactgcaaaagcacaattgtcaggcgtccaagatatacaagtaacaggaccagtatcttccactgaatacctacaatttttcccaaaggaaaaagggacagttatatatcagctttaacggaataactgaaatgcattgcacagtaaatacacaaaatcacacatagtaatgaatcagagaccaaatattaactaattggtacgtctgcataagtggagcaatcaaacctaagtacataactggagaaaacaatatacagattaagtatttaatctaaaccaccaggcaatccaaatttgcattgaagatatgtaattaaatggaaagtaacctaatgttctgttactgtgcaagcaggatatccttctaaataagcacaaatttgcaactatccaccagaaaattaggcagtaacagctatccacagaactaacaaatagttgtgtgagacttacccccaatcatacaaagaaattgtgcggatatgccttgcattttcagctaggtcatataaatcaacaacacctctactgcacccaacagcaagaatctgctgatcagaagccacagaagtgcacatcgcgtcatcagtgttcaaccatctctctactctgatgctgctggtttgctttaatcccttcttaccaactgcacaaagtccaatctgacagcccgagtacaaagcaactagcaatcttagcttcactgacaactcaacatgaataatggtggaattccctgtgcagcagggtgcaggacttgcatcagaattttctcgcaaactaggcgggtcaaacaccaaagcatctccgacagtgggagttctgttggatgaacatgcggagcagccaagcttgaagctgtccgagaactgcaaacaaacaatacatggaacatactaagcatagcaagcacagatcaagcaaggagataactatttccccatctcatcaaacaataacatagagaaacagtagcagaatacatttccatgtacctcagcattccaggagatgacctgcaagtgcccattggacagtccaagcagcatactcttgctgtcgcacacgaaattgctcctgcagcatatgatatcacacttgcaaaagttagctcccccgcatgaattcggtatctcgtttttcggataataaagaagcgaagcgaataccatacgttatgaaagcgtcattggcgagaggaaccttctcgacgattatttgcgatatggaggcgaggcagagccccggttgtggcttgcctccgatgatcagcggcttccccgagaactgcagcttgtatatgtacaggtagaaggacgaggtctgcacgtacaaaccactcgatgagtctctgcgcgtagagagcgagcaggagcaaagcggggggagagcagtgtgggggtggctgaccaggacggcgacggtcttggcgtcggggctccagacggagtgggcgttgtccccgtgggcggcgagggattccggggagcggtcaaggcgggcgaggcggaccttgtggtgggcggcggaccaaaggtggagggaggccgggcagacggcgaggaggtagcggccgaggacgcggaggaggaccacgcggtcggagtcccccgggtcgagcgggatcgactgcggccagccatacgccatgtacatctcggcggcggcggcggcggcggcggggtcctcgtcgccgggcgcgcgcctcgccggtgaggttgttgggcgagatgcgcgaggggggaagagatctgggaacgagcaggtgggtgcgcgatgcgggagatgcagcagtttttcttttttactttttccttttcttttctttttcgcttttctttttttaaaaaaaaactgatcagatcagagcgtcacatattgccgtcagattgcttcccgtcgccgagtgaaatgaacaagtttagcgtcccaactgatgaaacgatccagttaagagtttttttttcctttttttctttttccaaccggaactaagctgcttgatctttcagtgaacgtcacgtattgccgtattggtacagtgtaataataataaatgtataatgactggagtacgatagctctatcaattttcagtgccacattttcgaagagtttggtgctgcctttcagctggcagcatttgcgggtattagcaatttagcataggcgatttggtacttttggcagaaagatggatgataaattgacgtaagattacaccaatcttctataccaagatgtaatgacagtaatcacgatgcataaaccacacaacgttagggctttacatagtgctagtatattctgtattggatctagtgccatggagttctataaaaaaagatctcaaaaaaaaatatagtgccatggtgaggcccactagtgatgcttgcagcgacttgtacagcaattgtttttttctgggatgactatatgatctggacttctggagtatgaagaaatgacaccgctcgtatgaaaggacaacgggcataaatgtgacgtagtattactcccagaaaacaattaaaccccacaactaagtactccccagttaaattagctcacctcgcaagtttctttttaaccccatctgagtagtacagaacagaacaaagccagagaggaactcgaactcattgacccacatgatagagtctcctggtgtactgttacatgacaacctggcctagtgccttttagaggttaccaacacgtcttcgcacgatgagcagtgcaacaccgtgcattctaacagagtaacaggcaacacgatcaggccaaggtaaatcacgaaattttaaggcgtcttcaagctacttctcgttcaaagctgccttatttccatttacctgaatcctggccagttttagagcctggcatgctggtcacagtttcaccacaacttcagcggattgacgacgacccgcgacaacttcagaactagaccaaagaattgcatttgcacaggtcgtcaaaacgggacatggcttagtttcaggctgccaacataattgccttgactcctgccaaatgtaacggcgttactcatactgtatggtatggtaaggatttcagcttctttttttttttacggcacggcacaagatgacatgcttccgtcctttttcagcaaaagagatggcacttactgcgcatgagctgcaagctgttgtgaatcagataaaaatgatcattccatatcagaagattcatcctcatcctcatcctcatcttcatcaaggatataaaccaaagcatgccgccgagatgaaaagacacaagccactcctcttgaggctgaaaacaacatccaggaaatgtgaactctggcatcacgtatcatgttaagtgagtagcaacttaaaactcttgtatggaagtaaacactcaaactcaccactgactgccagtggagtggacacggcgtgaggtatgctacgaacttttttcccatagtcggtgtccaactggagctcctgtgcctacattcattgcgttacggaaatgaagatattactttctgacagtaaaagtaaggtcgatttcaacaattatgtgtcatttaatcactacaattgatgagataatatatggccttggtcacgtagtaataagttgtgtttgtgataacacaatgatgaataggagacatgcagtaggttattgccaataccaggttaccgtttaattattagtgtaagaatgctatgaaataaagtggatgccaaaagaataaaagaggaacatttgcaaagatcttaccgacagctcttgtacactgtaaatatttgaagggaacatccttgagagaggcacaaaagagaagttctccatctgcagcattacaatataagaacttccaggaccatcagaatatgacctttcactgagtagtacaacaatctggctgtcctgttttaatataaccatttcttttgtgagctatgagaaataatgtataaaaggtgaattatcgccaagatgcagcagggagtactaccttgtaaagagatacatcaacgcactcatattcatcaggtatatgcaatagaaatcctgaagaagatggtccgctggcagaagagttagagaagtcctttatcacaccaatgcaattcttcaagttcaaggatccatcgggtatcttgaagcatatatagtcagtcaagctatatgaagacccactattctgagaatcttcatcctgctattttgaataatcatttaatattatgataagaatttaacacaaacaatatagataaggtgaagacaagtacaaaacagaaaaataaatatcacttttttattacattatatttgaagtcaactaagagctatgtcatttgctaaagatgagatgggcacccgaaccactcctaggaccatgggtgaagagattaaacatccttccccgagccagcctattgcctattgaagtgttctcatatgttcattttataatgatgctgtagtggaataagcagaagtcaccaaaaaaacatgaaccttatagaatgacactgatgtcagaatacaggttgatgacaagtcaaccgatgacgtgataggataaagaggaagcaattcttggcaatgtatttgtgaagaaatagtggtgaatggcatcgagaaagcctcctccaggctgaaacatatgatagacaaaaattgattacatttaagcaatgagcaatggatttaaaatggctatgtctatataaacagagaacacaaggatttgactgtcaaaactctgattcaactgtttccagataacaaattatgtagaaggagtaaaaaataactctaagataatcaaaaaataaagtagtaaactggaacctttcatccagctcattaaattgcttcattaaagtcttttccaaaaaatgggtatctgtaaatccccccaaaactactagctgctcaagatgtcttacagtgtccctgaaaaggcaggtttaacacgattaagaaatgcagaaaaacacaataacacaaagagagaaactaaaatagtgatgaaaaaacacaacataagaacaggcaacagccctttgtaatttaatagcttttgactattttcactgctttggattcagggcacaagaagagtgtacacatcaagatattcaacgactggatttcatgtgaagcaatagtattgttttctttttgaaagcaatacagtacccaacaccaagagataaagtatatatacacaaaaaagactaaaaattatacatttgaaagttatgttcgtgttcggaggtactctcacacataaccatgcacttgtgtaacgtttaaatatactaaacaagttttgacatattatgcacattgcaaggtaacttgtcaacaaggattggtgaattactagcttgcaaacaggtaacatagatatgtgcagaacacaataccaaattgtacataggaaacaataaccaacaatcggcatgtttcattgttacttacaaatcacactcaaatctttgatttgcatcaagtaactgtttgattggatccttatcaagaaggaacttcagaaaaagcaccacgagttcactacaaaaaaaaagtgacacccaggtgattaatgacaaagtgtttgactcacaacttgagcatgaagggaataatagaaggggaaaagacaaaacctgttcgcagctggaacttgatcggttggttcacttaataaaatcttaacacactttaaaacccaactgaagaaattttggaactgaaaagtatatccataaatggaagttactacagaataacccttaaagtcgtagcacaatctataatcataacatcatgtaggaaagaatagagcatggaagcaaatatatcaaacaattatccccctagtaaacatgctcaacatggattaccttggtttgcttgaacttaatcttcagtctaatgatgttgtgcatgtagtttcagaatatgacatcttacctcagcagatactacatgcaccaagatgtcatattctgatactacatcaaaccaacagaatctagagtctagagtacagataataacattgaattcagaaaatgtaattggttgttttaacaatcagtgccaaattagcagacaaatgtgtgtccagtctatattgtctactaatacttcgagcacacaaaaggttctgtgcacttgaccagggaggggaatctcgggcagaaggcctaagttaaaacagaggttgagaattgagaacatggcaagaaaacaagcagagaagaatggtaccagataaagaacagtagccgcaacccttgaaaaacgctcaacttgaacaactagcattcctatcttctcagtcacaccataaataagcttttcatctaacccaacgttctgaaatcgtgagcgccatcttgcaaggcctcttagttccgcaagtctgaatgaaataatttcaactgcaggctgtaataagcaagtcattcagcgttcataacagactagctgatattccttgcttggatctcaaataaatgataccataaattgtagaaataaaactactcactcaaaatatgatagtaccatgtgtagcagaaaaagaaaaatatgaaattgcctagtttacaaagtacaaactctagaatacccattacccaaagcaacacaaaaaaaaaaggtagagactgtgacatcagctggaagtggctaacctgaagatgctcactgacaacaacacgaagttctcgtccagcactatcaacagccttagctattctcttgagagcctatccacataggaaacgacaagtttagacaggttctctcaaaaaaaaaaagagaagaggatagggaagaagtttttatggaagcgagaaataccgcttcaccaagtgagctgactaaaaattggtgaagtgctggacttgtacgtgtaccaaacaaaaggctcataaactcatcctcagagctagattccatccctgtattcaccaacagagacagaataaagggggcagacttcttgaggtgatggttatgacttgaaaatcgatcataccatgggcagctatcagagaaggcaaggcgctgaatttttcattaaataagttcatggcacttgaccattgtttggccatcatggatagggaagaacggacaacttcaaccagatcttgaatacttgatgcttgttgggagatctgatgtagctcatttttccttcacagcattgatgatacacaaacagattaaaaaaatttagtaggtaaagcactaaagtgatattaatatccttgcaaacctagtaaataaacacaggtgctatgtttttgaggaatcaaacaagaaagatgtttgcacctagctataaaacagaatgatggttctatgactaggtgagcttatcaaaattagtcatttcaggtgtcaatgagtgtgttgctctagcacttcatgtggaaatctccatcatgttttgaagttaccataaaacaccatgcaacaagataatggtttcttaacaacaacagaaagtagtcacaggcaatcaaactatcatgacattacctgttgaaaaagatagaagtgtccaaatgcagacaatgtaacccagtagaaatgtgattactatgagaaaggttgtcaatatcaatcagctttccagggcacaggagaactaactgatggaggtttcctgataaacagacctgatgtgaacgccattgtcagaatttcatacttaatatgtgcttatgatttatgaaacaaaaaattcattaccttgcttatggaagcatcctgaagccggtaactagttttgtttccagaggattggaaatggataggaacctcattaatgttctgaaatgccatagacataaaattagttatccatgagacactgaactagataaatgaactaaggcgtcatggcttacaaacaaaaagaattaggtaataggcatcagttgatcaatgtccacagactcgatccttaaaactacatggaacaaagagaaatgaaagaaaagttgaaacacactccacctgcttgtgtgcgcattaaaaaaagaaaaataaaaacaagcatgctttatcataatcccagtaggaaaaaaaatagaacactcccagcacttttgcccagtgagtttaagtttgaaaac

SEQ ID NO: 67741 - DNA, 25515 bp, Oryza sativa
gcgcgcgcgcgcggctgactggcccgcctgggccgaggagagagaagagaggttttgggccgactttcggaccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacaaacctaccccctttaaacagaatctcgtcctcgagattcggaagaactggcaaacaggtgcggatgagctgacttcaattcatcttctcgttcccaagttgattcttcttccgagtgattactccactgaactttgcagaaacggataactcgattcctggttcttctctcatttgtttccagtatacggattggtttctcaacataagtcaaatcctcttggacttctatctgctcaatattagcttcttcggtaggtacccttaaacattttttcaattgtgacacatggaacacattatggactcctgccaaagattgaggtaattctaactgataagcaacctctcctcttctactgacaatcttataaggtcccacaaaacgcggtgccaattttcccttggtatgaaaacgatgaactcctcgtagaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcggcacttccgaccatacagtgcttcgtacggagccatctgtagactagcttgataactgttgttgtacgaaaattctgcatagggtagattcttatcccaacttccaccgaaatctagagcacaagctctcaacatgtcttccaaaatttgattcaccctttcggtttgtccgtctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtttttaccggaataaaatgagccactttggtaagtctgtcgactattacccaaatagagtcatgtcctgatgacgttctgggtaaaccagtaataaaatccatacctatttcttcccatttccattcaggaatcttcaaaggctgcagcaaaccggcgggtttctgatgttctgccttgactcgctgacaaacatcacatactgctacgtattctgtgatttcacgcttcatacttgcccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaacgaaacctctatcgacaattcccaaatttaatctttcaaattccttgcataattccaatggcaactgtcgtccttctgtagcattgcaatagccttttctgctaagagcgtctgctacaacattagcctttcccggatgataataaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttgaaaacccttctttggatcaggcaaaatcaaaataggagctgatattaagcgacttttcaactcttgaaaactccgctcacattcttccgaccacttgtacttcacatctttctgaagcagtcgtgtcatgggcttagcaatcttggaaaaattctctataaacctccgataatatcctgcaaggcctaggaaactgcgaatctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaaggcgaagatgttcttcatgctcttctttggttcgagagtagataagaatatcatcaataaagaccaccacgaacttgtctaagtattccataaacaccttattcatcaagttcatgaagaaagtaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagttgatcaaacaaatcatcaatcctgggtagtggatacttattcttaatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattacttggggtactaaccatcaaaggacgtctaagatattctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctgggcagggacaaccttcacgcgtcggggcttcggacacttgtcagcataatgtcctggatctccacagttgaaacacaccacgggcttgttgccttgctccctcttggcaggttgttgctgtgctggagctgcaacaggacgtggagcttgattacggatgttgttgccagcattgttgttgaagaactgacgttgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggaaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacccgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctacgagtgttcaccatctggcatggacagggcacaagaagagaaaccggggaaactacttaggacagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagccacacacaagcaaacttaaagcaaaccaactaacacaacgatctaagacaacgacttaacaagtcactctagttcttccaagcatcggaggtcgattgaaggctcgtcttcatcatcttgagttgctacccactcaatcttggaattgttgcgcttagattcttcttcttcatcactacttatgatgatgaccggaggatccgcttgagctggagcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccgatcttcacgatcttgagctgctaacacagtctccgcacgactttcatccatagcccacaacatctcaaccaaatgtttcgtggtagcatcattctcaattccttcagtctcaagataactgccacggtcacttccctgaggttggcgaggatggtagcgatactcagtgtcggcggcggcgcgaccccgagcggcgaggggcggcagcgctaggaggggaggggaaggacgacggggttctcaccgaggattcggccggcacggaggggcgacggcgaacggcggcgaggaatgagtgggaggcgacgacgaacggtggacggtctccggaaccacctagcggacatgataaaaggggttagagagagagaggaggatggaagagggctaggacgccggccgaaggcggcggccatggcggtgctcaccggtgcacgatgcggagtgggtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacaaaacagttaagtaattaaacaatattaagccaacgctatacaacataccctgttgtataggcccaaccattctgaacaaccaccccggctgcacagttctatctccaaaccaggaatataccattccaaaccaggagctaatcagattattaccagtttaagcatctttttcaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataatccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctatgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcgggctagggtttgggtggaccggcacatgggcggcggttcacacgaacggacggccgagatctaaccgatccaagatggacggccgagatcgatcgggtccacggcggttcacggcggacggccttgatgacgccagcaatgacgtcaccgacggcggcggcggctcggcggagcggacggctcgggcggcgcacgctcaccggcgaacggcggcgctacggcacgaacggaggacaccaacgggaagcggacggcacggcgaacacaccgacgaccaaaacgacagcggagaagcaacggacggcgacggcgacgagaaggaagcggcggctaccttcgggttgtcgacggcgacgaagctccggcgggttccgacggctgcgaaggggcggacgaggacggcggcgacttggcgatgacgacggcggtcttcccgagcggcggcgacagctggagcgacggcggagcacggctgaagcggcggcggcgacggcgaagctagggcacacggcgctagagctcttccgacgacgagaggcgaaggcgagggctgcgacgggtagaggagacaccggggatccttttaaaggggctcggaggcgacggcggaggcccacggcgacggcaacggcgaaggaaaccttcggcttggagagagggaaaaccgatccgaatcgaactcgtctccgacgctttccaaagcgatttaaccaaagattccaaaggagaaaaggtagaggagatcccggagatcatttcccctctattgattcggccggagaaggaaaggaatggccggattggaaaggaaacggcggcggcggctcggcggcgcgaaactagggtttcggcccgaggaggacgacgactccgacaggcgggacccacctgtcagcgacagcgagggcgcgcgcgcgcggctgactgggccggctgggccgaggagagagaagagaggttttgggccgactttcggcccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattcgaatttattaattaaacttagattttcttttcaagacttttaaaattatttctaaaaattccatttaaacaacaatttatatattttgaattttcagggtgtgacagtgggttctggcggcggtttccgacggaggagatttggacgggacggcctgcacgacggcgaacgcaacggcgtcgaaggcacggctcggcacggcggctagcggcggccggagcggtggtggcggcggcggagaggagggcgacggcgctagggtggtggagggcacgggagcgggtggttgcaaaacgaaaaagagagaggaggagacggggcgctttatatagaccagcgggggttgatcgtggtcgggatggccacgattccgccggcggagtggggagaggtggggaggagagagaggcgggattctaaattcgaatcccggccgtctcgagcgcgggcgcgggcgggagatagaaggagtgggcgcggggaaggcgggggggaggcggtgacgtgggcgacgtggcccaggaggtgcgggagcgagcggtgcggcggttgcgggatgcgttggcgccggctggaggtaggagacgggcccgacaggtgggccccacctgtcggcgacccgaagggaggagggaggaggcggccggctgctgggccttggccttcggccggcccagcggggagggggaggggaagagaatgggccggcggcccattcaaaaaggaaaaggagggaaaagaaaaacaaaacgaaggaaatgaatttccagggattaaatattgcttgtgctcatttttaaatgattaaaattatttctagagctctgaaaattccactaaaaatcttgttagcatatttcggcatgtagaactcaagaaaaattccacatgccaattccaattattatttgcattaatttattagggtttcgctcttgcttttacaccggtattttcttgagaccatttataaattcaatttaggcttaggaaaagaacttcagggtgtgacagtttcttcccatcccgtcctaaccacctctattacaaatctattccaacttagaaatgttaccatgtttctctttgcctattctttcgacaaactatcttgatcgctcctctaccttatttcgtgctaagaactccactggttcactactgattagtaaatctccttagttaaataaacatatgagaggctagcagctcccttacgacaaccaacattgctagctaacgttctttatcatctgtcgtttgtgatgatataaatgttagactattggtagataggcacaagacacggtatggttgcaagagtttggtctggtgcacacacacgcaacaaggattttaggatttagtttaggtcataaatttaatttgttttggaaaaggaaaaatttaatgtgtgactcaagatagagagctttaaaatatcgtcttaaggagcaggatgcacacgcttgcattaatcgtgaagaagcctagaatatatttggggtatctgaatttgaactggtcgtgtcacttctacaacatatagatgattgatagcttcatagctatatctctcttgatttggaaaccatttactctctcattgcaaggctcactaggcaataaattgtaactttctatgaaggctaaataaactccatttagaaacttcctttcttgcttttccacatttattcccaccctgtccataccacttgtactacaactctatttcaacttagaaatgttaccatgtttccctttgcctattctttcgataaactatcttgatcgggcctctacctgatttcgtgctacgaactccattagttcactaatgattagtaaatttccttattaaaagaaaggaaaatgaggggctggcaacccccttatgaaaaccgacattgctaggtgatattctctatcatccatcgttagtctgtgatgatattagagtattcacagataggcacaagacgcggtgtggctgcaagagcttgatctagtgcacgcacgcatgcaacaaggatgagaggatttagttcaggtcatgaatttaatttgtttctgaaaagcaaagatttaatgtgcgacttgacatggatagctttaaaacactgtcttaaggagcaggatacgcatgtttttgtattaatgataaagagggcaagaatatgtctgggtagccaaatttgaatgtgtcgtgtcacttatacgtcatgtggatgatatacgtctatatctctcttgacgtacaaaccatttactctatccctctcgttatggggctcaccgagcaataaatcataactttttaaaggctccataaactccaatttagaaactttctttcttgctcaccacatttcttctcactccatcctaaccacctctattacaactctatttcaacttagaaatgttaccatgtttccctttacctatccttttgtcatactatctcggtcactcctctggctgatttcatgctaccaactccatcggtttactacttattagtaaatatccttagtaaaaaaacatatgagaacctgacaaccccctttgacaaccgacgttgctagctaacattctctatcatccattgttagtctgtgatgatagaatgttagagtattggtagataggcacaagacgcaatgtggctacaagagcttggttaggtgcactcacgcacgaaacgaggatgagagcatttatttagtttgtggcatgcatttaatttgttttggaagaaatgtaatgcatgactcgagacagagagcgttaaaataccttctaaaggagcaggatgcgcacgcttgtattaatggtgaagagcacaataatatgtctgagctagccaattctaaactcatgtgacttatacgtcaagtggatgatagatagctatatctcttaacgtagaaaccatttactccctctcattgtagggcttaccatgtaataaattgtaacttcttaaaaggctcggtaaactctaacttagaaacttccttgctcgccacatttattctcaccctatactaaccacctatatttcaactctattccaacttagaaatgttaccatgtttccttttgcctattattttgacaaattatctcgatcgccgctctatcagattttgtggtacaaacttcattggttcagtactgataagtaaatctccttagtaaaaagaacatatgaaaggttggcaatccccttataacaaccggcattgatagctaacattttctgtcatccatccttagtctatgatgatagaatgttagagtattggtagataggcacaaccaatttcttattcgtgtgggaaggatgaaacaagattgtctaattcaagaaatccttctcacaatgtcatttcttacactatatgattagaactaattatttttggtagttggcttttaatatgccctgtccttggaacgccaaaaatatttttagtagttggcttaggggagtgcctaagatctatgaaaaaactagttttatttgaagctagtgcactacgttgatcaattttgcactgccaaataataaagtttttttataacaaaaaaactatctaacctcgtgcaagttatgtctagctctttcagctaactccaatattggtctatgatgataccacaggaagagcaagatattatgtataaattgtaatggtgctacactcttaggatctattggcaagagtatgttgttccattatgggtggcatatcgcatatattcttaatttctagaatatgttgccaagagtacatggttattctagcttttcagcggatttttattacttaagagtagatggggattttgtcccatcactctttttattcacttcattagaaacttattatccgacaaacatcgagcccaacctctattgctttaagccgtccccattgctctcctcctccatcccatgaatgtggcggccctcccactccactctcgtgaactttgcggtggcaatggctctaaagctcgatgtcaccacgatggctctcaggcttgagctcgccctcgccatggcggtccttcgctccaccccgagcttttgatctgctccacctcttccctcaaacatttgatttgtgtcaccatcacctcaatccctcgattcagcggctaccaacaaccatgccaacctctatttgtggctttgccgctagcccgtcctggatccacactgatgccatcgtcgacggcatcatctcgtcctcgatccgttgtgcccagcttcatctcgaccttgatctacattgcccgcttcattcgggcatctcttcgtaccactggtgtgtgatctctccctcgaggccaatcgtatcttgccagcgtcaatcgattagtgatggcttctccaaagcaagcaattggttttgtcttcgatttgcagcaccaccgccaccagctgtcggagatatgggaaccggggtctccatctccctcaggtcaccagggcgctgcagaatacgacaagacatacaagacacatatattcaagccaccaaggttaaaacacccaaagaggaccgctaagtctccaggcgtgccctgaacacagttggtgccccgggccatggggtgccccgtgcccctagggacagcggccacctagagaccaagccaaccatctctaggcctcgggtaggggcccgagcactcgtcgtgccctgagcagaggaccggacataacctttgccttgagcaccccatagagggcatggcaagactgaagaaaagctgacaagactagaagagttgctcaatcactcccttgcattaatggcagtatggcgcacgccttccacccatcctgtcgagaatgttgggagcgtggggaaacatgtgccacgcgtcaccaggtggtcccacgacagtgggttgagggcaccttttgactttggtgcacctcatccgtcagtcaacaggggagaacatccctcctcgtttggttcaaaagagttcaacaagaccaatcagaccgaatttaatggagtaggcttcactcccacatcaatgttggcactgtggactctccttggattataaaaggatgatctaggctaacggatagagggttcgatcccaagcaactaagtatagacactagaactcgagcttccacactgtaacttattctcgatcatccatccatgagtaggatattacgcctccctatagcttgaacctatataattctttgtactcatcttccgcgcgatctacacctagattcgaaactcatcccctggctgaatctttggagggagagtactcgcttccccactagagaagtttcatactccaatacaacaacttttttcactggtaattgttgttcctgagaaacgcttcgtctcccaaacggccaagaacactttcttttcactggtaatttgggtaaccgaatattacaattgtgtttccattacaaagggaaaaagaattcagtgctcccaaacaatccctcagtcttccgtttatgttatccaacatcggacaatagatgtgaatcttccatagaaaccacaattacatgatggttaatttttgttgcatagctagcggcagttcacaagaacccggcttgtctgtactatccggtctccagaacggacccacctgacagcaaaatcttcacacgtcacccccactctcacatgcctgacacatgagaccgttgcccgggccccacgagacatcattaagtgggcacgtggctaactgtcctgcttttgtacacagttgatgaagtagatattttttgggtttcaactgaatcatatcatcatcactaatatgtagctttttgtttctttcatcccacgagctcaggttttaaattggatagatctaccatggaaaggatttaaacccagctttctgttaacagccaatgtagcaccctatcttcagtttataagcataggtgaaaatttaaattttaaaacttaaatttagagctaatttaagtgtcttttatcgtcatttattttacaacatttgcttttaaatcgctataaatgtgttcaaaaaagttttatatataaattaattttaatcgttagtaagctgtttcgattaagcgaaacgatttggctgctattattgttgcctactccctccatccaaaaaaaaatcaatctaggtagggatataacccctcctagtacaataaatctggactaccctttgtacagattcgttgtcctaggatttttgggatggagagaggagtagttatcatataggcaaagataattcgattcgctgtgtactaaactcagatggagaccaaaatctcagcacaactcaacataaaagactaacctgatagataaaatgcgttgtcattgtttatattatttgaccatgatacaaatttcgcatgtactttgacaagtgacaatcaatgtgaaataaataatatatatatatatatatatatatatatatatatatatatatatatatatatatatatatatatatatatatatatatatatatatatatatatatatatatatatatatatatatatatatatatatatatatatatatatatatatatatatatatatatatgttgattgaattattactacggattatctatactccattagggagataaattaaggattttaaaaatatacttaatatataatctaaaacaagtggtctaaaacaatataaaaaattatataaccatttataaaacatattttagaatcatagagcaacaacccacaacaataatctgttaaaatagctgaaaataacctgacctaaacaagtcgtctattttatccccaaaaccttgtaaaggataaataggtaagcagacatgcttggtacaccttgtatgcaagtataatactccgagactttgaatgcttggtagtaacatgtgttacatgttggcatcataagaagtgtacgggtacatgatggagtcgtaatcatagaccattggattaggactttgcagcagcatactagcccatgttggccacacgtatatatgtatgcatgtcatttgtcaaataattttacaaaggtcaatgtatgctctctccgtctcagaataagtttatttttattcatcccatttgtcacaaaatagttcttttttgaaagtaatcgttgcatcagagtttatgagagtaaaaaataagtttattgaggaataattgcattggatttgaaaagataagggtattattggttttctgtgttttcttttgatacatgtatgtagaattagaaaaaataaatttattttgggacggagagcgccgtatcttgtttgttgtgtttttctgatgatgataacgtggcttgcagctgacaaccatgcttgcatgcaacgcatttccaacgcatgtggctctccggtttgtaaagtcgatcgatcgagtgagagagttgatgcacggcaagcagtgagagtgatctgagctctgtttatgtgaaagctacggcttaattttggttggagatagcgaccaaattagccttctccctgtaggctgtatatcatttgttgtgtctgcttaattattgattagtttgggcactaataatatcagctgtgcgacaaaatatcagcgcacggttatattaatgatttatcttctcttcgactatccgaagttggacagttttctttgattaatttcattggcgcagaaagaaattaagggtaggataggaaattttgatactacccttcatctcataatatatggcgttggttagttaaaaaaaattcaggagtaaaagataagaacgatcgaatctacaatactcaataatatctggttttcaacttttactttcgaaaccatttgcttttcagtcctcaacgataaaaatttcacttgatgtggttacgtgacctaaggctaaaatattttcaaagtataaaaaacagtactagtgaaagaattaaattttaattatgatatagaaaattttgacctactaattacgtgcaaataaacttaaattccttttgggctcgaatttagtcgggccaccacagtgatttttgaagtaatctaaaatatttcaaattacgacatggaaaaataactatgtgtcggtatattctcagctcgttttgtagccatattcatcctcttcttttagcaaaagtacgtataggtgataacttcatcggcttgctggagccaatatacttgatgtcattgatgtgctaaataagtgttgtgaggtggttcaaattgcaacaaagacaaagttaggtagttcaaagtgaagctttgataataataagatggctctaagtatataattcactcaaatttaaatttggatgaagctaataagaaaaaaaaaacagaccatgagagggtaacataaatttaaccatcccattagcatgaatacctctgatcaggatgagaaaatcgggataggctcattcatgaccatgtgcagtagtctaatctccccccattaatcaaactgttagatcaaggctaataatataaccgatcttttgactataagattctttatagttttctctcagtctatccatataatagttagctctttacaattaatataaggcctacttgtctctctcacagagtttcttggttcttgtgaccaagccggctgtaagtttacagcccgcttctcctctctcctcttttctctcctccacctcagcatttagccgacttatagcctaccattatactttgctcttaaccgattaattaaaacatcactgtcagctgagcccggccaaatctcgaccaaacgttcaagcgcagaggaaatggcatccccctatcctgggcgaactgaagctgaattttgatggggctttctttgatgaaggcaagaccggtggatggggatttgtagtacgggaccatggtggccactgtgtgctagctggagctgggagaattgagctggtgcatgatgctttgtgtgcagaggctatggcatgtctttatgctctgcgcgccgcagcaaacaacggaatttctcatgtctcagtagaaactgattgctctgtcctagtgcgagctctcaaatcagctgattatgatcaagctacggctggtgtcatcttcaagtaaatcagattgatgtctttggtggactttgtaaaggttgatttgtctttcgcctatcgattttgtaatagttgtgctcatgaactggctcgtcgaggggctaattgggacccgggtcagatgtccatttggactaaccccctcccgtgttttataagatcttttgtggttcgtgattacactgaaccagcgtatcaataaagagcacggtttgagataaaaaaaaaaacatcactgtcagcagcagacggatatcaagaggtgggccccacggggtcgccgtcgttgaccgccgacggggcctccaccgccgtcgttgcggacacgtgtcgggcgatgcggcgcggtaggcaccctagctagccgccccctactacttcactttcagttggaatgcatggggtgccgtgctgctgatcgacctgggccggcggttactgcagttacgttactctctctatgaccacccctcgattccataaaaaaataaatctaagatagtactactccatttatcttaaaatataaatatttttattataaatctagacaactgtgtgtctaaatttatagccaaaaattattatattttgggacgaaggtattataagatatgacatatcctaatattattacttcctccattccaaaatataaagcacaactactattaatctaaagactaagaaaaaattattatcatcttgtagtttggatcgtcctagtaaatgtaatgtatgcatccaataaaattagataatatgaaagtggagtatttaaaaaagtagtaatttaatagagaacatgtcatagttaattacatgcttgtatgcatgtctatattatgaaacatctaacaaaaaaatagttgtgccttatattataaaatggagtgagtataagcttataatagtattaagatgtatcacattttattttttgtttgtttgttttttataatacgaagaaaaataaaaatggttgatatattttctacgagtactgcgaatctagaaatgcttcctatctatttatatactcctatgtcccataaaaagccaatcctaattatgaacctgtattcgttggtatgattagattttttatgggacggagtgtgtacgttcttactccctccatcccataaaaaaccaacctagtactggatgtgacacatcctagtactacgaatctggacatacctctgtccatatttattgtactagaatatgtcacatcgagttctagatttttttcaggacagagggagtatactccatccatcccattttaagtgcaaccatgagttttcgcgtccaactttagtcatccgtcttatttgaaaatttttcgtaattagtatttttgttgttatgagatgataaaacgaatagtactttatgcatgacttatgtttttttagttttttttaaaaaaattttaaataagacggacgattaaaattaggcgtggaaactcatcgctgcacttgaaatgggacggagggagttttttttttacgagacagggtacttcgtaccggtattttctttcaattttctgctgttcagttgagcctcggagaccgtgcagtcagtggagtttccggtatttcagttgtgggagaccggagtagcggacagagtggctgacgtcgcctggcggttgctgttctggaaatcaatgggggcactgtaccttgcgtttcagactcttcgggcgaccgtgactgaatgcgttcggcggctcacgaagaagatttttcttgtttgttacgcgcatgtttttcaaattatttaaatatatgtttctttaaaatattaaaaattatttttaaaagcatattaattcatttttatatttaaaacaattaatacttatttaatcatgcgctaatggtttttctcattttacaaatcttatcttttttctcctctcaaatactcccttaatcatttattactaataatttgttgtccagagaattattagttgtccagagaattgaaataattttaagagtaaattttacaaaacggcatgtaaagactgtttgttttttatcaatgtatcataaaactatatatttaagaaagtgcatcacaaaactacaaatttaagatcatatttttcataaaactacatttttaagatatcatatcaggaaactatagatttaacatcagttttatcacaaaactataacttttgtatccttgatagtgctatggatataaactctacaatctgtggttatttaataactttattactaaaactatagttttgtgatacaatgctttaaatttgtagttttgtgataaatttcgtgctaaatctatagttttgtgatacacattcttaaatctatgattttgtgatagtttgcttgacgtatatgtagttttgtgaaatttactctattttaatttaaattttaagggtttttctagtgtagtttattttccagcataaatttataaccaattttgtccattttttagtatatttttcacggtttatcaactataaatcaaataatcaatcaacatttctatttcttatgatgtaccataaaatactccttagatggtactccacgtggtatattaataatatcaaatcaataatgctccatattgtgtatgctctctaggtctgtatgtcctctctctatctctctgaatcacctcttgttccctcggctcatgcctcataagtcaatactacatgatatgacaaagctgcaaagctttaaatattttttcttctaaattgttattcgattacgatcagatggtgcaattaaacattttaagtattttttcttctaaattattatttgatctacgatccgatggtgcaattaaaccttataataagatcttatatgattatattataaaaaaataaatatgttttaatcgttaaatttgatgtttcatgtgcaagagcgaaatgtatcacacattttattgtgcttcgcatatctttcaactatttcaatgatttaaaatttttgtttcacaacatataacttaatgtttcaccaatggttaactaaaatattttgactgcattaatttgttgatcttatttggcgcccgacgtctagatgccaccatattaaaaacaacggataatactagttcacgaacgctcacttatatgtatacgtagtgtcttaattaagctcgatatataataattatgtattcaatcttgacaattttatactaattcaatcgtggatacccacttgtaggatatattttgtcatttgctctatccgtcctaaaacaattgttttttctaagatttaaaatttatcataaaatagtttgtactaattatcccatcaatcactttccatttaaatttctcccttttgtccccaactatccccatttaattagggacattgtagtcttttctaaaccttaatatatacttaaacactccagaatgacaactgttttacgatgaaagtagtacctactttttttttcgggagaatagctactgtagtccctaaagtttctatgtagaatcagcttagtccttaaccttttaaatagttcaaagaagtccttaaactttgtcataaggcctagaatgggtccaccaaaatcgtcgtatggatatgccatgtcatcattcatgcaaaatctatgatgaattgtccaatttacccttacgtatatcatagaaaaagaaatgtaagggtgaattagacataaccatagggaaaaaaaatacttttccttttttcacctttttgacgtatatttttgctcttatatataccatattttttaactttttcttttgttttttattttcctatgatatatataagggtaaattggacaaatcatatagattttgcataggagggtgatatggtatgtccatgtggcgattttggtgggaccaaggactatatcagcccatgtgacaaatttaaaggacttgtttggacaatatgaaagattaaggactaaaatgacccaggagcaaaattttagggaccatcttcacaattctccctttttttttcatacccctatgttaaaaaaacggaatagcataataagatatgcaaaaatgaagaaaaggaacctaattacattctcacctctcctgcctaacgggaacagacagagcccaagtggtcataagagatcactctcgaatgaaatggaacatccaatcggcattattgattgattttcagttggcacaagaattactcaaaatgagttctgaatgaagaacaaacatcatgaattgaagtagagacccagaattactcgtacaagctgcacgatcgagaccaagagaatctttgtgtcaaacctgtccattggtcagatcgccgtcgcatggactggcagacggacgccttatgatgctaggatttcgctcatcacaacaagaaccttcatttgttgccagatcagatcgaagtcttactctgccaaatgttctgtaaagagattgagatcatcttactttacacagtgaagtcagagaagcacagtgcggtgactttagggtaatctcagccgcccgatttacagcgagcgcacgggatcgatcgctacagcacattacattaacacatgaacaatacttttacacagggacggagctagagaaaagatgagggggttcctgactttctctgtgtaataccggtatgtataattctaaagtgatattgtactaaatagttgtgtacccaatacatataagcatcatatctctaattgatggcaatatataacaagaaaatacatagaaaaattaaaaatatgcgtaccataatgaagaaaccatcttataactagccacttgctgtcatcctactcccctccgttcaatgcaagcaacaaacactaacttaatcaataatcatgggttatggatggtctagcaaaattgaaagaggggaccaacgggacttgacttatcaattggattttgatgctgcggcctacggtggtgaagttggtggcgaacggtgaactgttggccaacgttgggcatggtaggagtaggcgataccggtggccagcggcaggcacggcaagggcactagggcgggccgcactgccgcaggcgtccagggctgatccaggtgataggggcagccgacgtcgccgcgtcgggcacaatcaggggtagatctagacggcgagagactgaaagatgagggacgagtcgcgcgttttgtggaagacggaacgatgccgccctgatttctgggccttctccaaaaacacgtgcgatgagactcctcatctcctctcatctgggccttctccaccaataaaaaatggaataagttcaccggaggtccctcaacttaacagcaagatttttcgaggtcccttaaccacaaaaccagaaatatctacctctaaactcactcaaaccattcaccggaggtccctcggcagtattttcgcccggttttgctgacgtgacatcctagtcagcaaaaaaaattaaaaaaatacgtggggctcacatgtcagctgcacattttttttcttctcttttcttctccttctctcctcttctccttcaggctgagggcggaggcggagcaaccgcgcgccgtggtcgccgtcatcgtcggctctccaccatcgtcgtcgccatgagcgaggctacgcggcgcggccgtccggcggcggagcggaggcagcggagcgcggcggcggagcggaggctgcgggcggagcagccgcgcgccgtggccgccctcgtcgtcggctctccaccgtcgtcgtcgccgtgggcgaggcctagagttacatgcatatatgcattcattcatgaatatatacatatatattcgatcgatcgatcttgtcacattcaacccgtgcagcctgcaaatcaatcacaagctgcttttgctttggtctttttctctctattgcatgcatgtatccctcacttgagaacccatagctagcatgcatgcgttcacgggcttttggcctttcttctctcgcgcgtggagggacgccattgccgccaacaagctcgcgagtgaacctcagccggctctctcgcctctccggcaagaagggcgccaaggccgccctgcccgacgacgacgattacgagccccccgcaccgccgctcccacccggggacggcgacgatgacgaggagcccatcaacctcgtcttcaagggcagagatgaggccggcgagagagggggtggcacgccgcatcggcgaagaggtcgccgccgaccgcctgccgccgctccacagccacacttgcccctccgccgctcgccgaccaagccccccgctccgtcgtaatcgcccgccgccctccgcccaccgttgcttcgcctaccgcgctcgtggaggtcaaccaacacgacgacgacaccggcggtgaagagctagagcatgacgagcgccgccgctccgctgccactctcgcccgctgccctgcccgccgctcccgccgtcccagccgcctctctccccctctcccgccaccgctggcgcgctcgctccacgccgcccaccgccgcgcccgcctcctctcccctctctcgcttcttccccacgcgccgtgcccgcaccgccgcctgtcgccacgccctcatctgcccggccgcctcactgaagaagacgagaaaagaaaatgtgcagctgacatgtgggccccatgtactttttaattttttttttgctgactaagatgccacgtcagtaaaaccgggcaaaaatactgccgagggacctccggtgaacggtttgagggagtttaggggtacacatttctgattttgtggttaagggaccacagaaaatctcgctgttaagttgagggacccctggtgaacttattccataaaaaatctatgggctggccgactgggccttgtcgagtggaagttttgggctagacaatggaggggggttccttggtttgggctagaggggtgcccatgtggtagagatataggggttacaagctatttcgaattttggaccgggttcctgggcaccccctggtcctattgggctccgcccctgcttttacatagtatggttcgttgtttaccactgccgctacagccaataactgcaaatcactgttttgtactgtagcacaagacacaaattactgtgctcctctgcctttagcaccgagaggcagagaagctggatcctctttaaagagcactatattcttacccaaatgtgctggtaatatacataaagtgctaatatttgctaagagaataatatttgttatagttatgctttgtgtattatttatacttttattgattttgtaggagtaaatttaaaaatactttgtacgttcctacttcctccctcatcgtatacgaaaggagggagtatttcactattgactagtgctgttttaagtttgatcgacaatatttttaaattatcaaattttaatgagtgaaattatttaactagttaggaacagatggagtatatgattaatcaaatataggtcaatgtcaatattggagaaaccattcaaatcctatatactccatccatcttataatataaggggttttggagagatgtgac

SEQ ID NO: 67742 - DNA, 16159 bp, Oryza sativa
agggtctcgccggtgccattgaccccttccaggatgccggtgaggcgggcggcggcatggtggggcggtggggcggtggcggtgggggatcgcgcgaggacggaggagtggtggcggcatgcgatctatatcggggggaggaggagaggagctagggttaaaagggtctgcacggatcttgaagcatatccaatggtccaaaattcgaatgataggaggtgggattttctgtcacaagacgtatagacagcaccctatattaagggaatttgtttcattttttgctccacaaaaaatattttacctagtgtactcacaatgtttcactatgtatatatctaatgttgcagtgaattgaaatattcttttgcaataaatcacccacatattttgaaaaccctctattaagggaatttgtttcattttttgttccaccaaaaatgtttcaccagtgttcttttaatgtttcactatgtatggaacaaatgttgtagtgaactgaaacattctttcgctatttgctaaaacattatttttatataaggtgaaacaacacctaatttaaatgattgaaacatttttgatctactgtaaaataattccgatatatttggtggaacatcgtgcaacattttaaaataattcaataataagctaaacaaatttccgtcggaatatatccatgtatggtcttattttgaagatttaattgcaacaaatttaatggtgcaatcggatcatgatttggataaataatttaagagaaaaaatagtttaaaatggttttgcacgtatgcgtcatgctgacgtcatcatccgattttgccccctccccgtcggccgaccaacacgtagtcgtctcccgttttcagcccaacaatcctttcctgtttttgtcttttttttaacaagttcatttgaggtcccttaactttacaccgagttcaattttcatccttgatgcaaaattagacacaacgggtccctcaacagtcaaaactggtataaaggaggtccctcagcggtttagatggcgttttagctgacgtggcatgacgcctacgtggctagtctgacttggtcctcgtcctacgtggtggtgacatggctctagaagcaaaatgaaaaatatgtgagacccacatgtcaatcataaaaaaaatatagtgggacccacatgttcctcctctctatctccgcccgcagtctacgaaacgctcaccagtggctacgctcgccgaccgcttgggtgaccacggcggcagggatgggtgggggaggaatggcgactgggggcagggggagggggctgtgtacaaaacaggatcttgcagcactgggacgaatcgatggcgtcaacgttggagaacccgctgaagcggcggcagcggcttcgagctcgagtctcgggccccgtcggcgccacgctgtccgtgtcccgcgactgcgaactcgccgttgccagcgccaactcatgaagatcaatgcggcgacgcaacaggaggaatcggcggcgcgggggggtgaggtcatgcagctccggccgccactcctcctctctcgtctctcgcctgctgccgcacgccgcttctctgccattgtccatcgtgcgccactccgcctgaggcccagagccgccccgctctgagcaacgaagagaggggagatggggagtaggacaagaagagggggcgtgaatgacatgtggggcccacgtgggccccagtatttttaaattattttttgtgtaactgatatgtgggaccatagtttttattattttgcaaattaaattgtcacataagcgtcatgtcaatgccacattagatgaagaccgagtcaaattagccacgtagacgtcacgtcagctaaaaccgccttaggacttattttgcaccggttttaagagttgagggatctattgtatctggttttccagttgaagaatgaaaatcgaattcgttgataagttaagagaactcaaatgaacttatattccaccgagcattcaccgtcaagagaggcgctctaaatttctttgtttgcgaggtgacatttgatagtgcattcctaggaagtacgaacatattgctttttttatggaccagtaatatactcgtgttgtgtaaggctcttagccatacaagctgcagctactgtggctgctatatcacaaattgactacaagtagttgcagcaattcttaactacggtagccgcagttgcaaaaatatcagccgagcacatcttaagtgtgtaacaggctagacgcatataattaagaattgattgggtatatgggaaggaaataagatggagaacagtagtagatataatgaacacaatgagtgtgtttagttcacgttaaaattgaaagtttgtttgaaattaaaatgatgtgatggaaaaattgaaaatttatgtgtgtaggaaagttttgatgcgataaaaaagttaaaagtttaaagaaaaaatttagaactaaacaaggcctttagtagatataatccgtacaacctattggagttaatttcgagacagtgtaatttggctttgcatagcagccacaggaaggcaaagccacacaaattttgacaatttgatattttgaaaaaaataattttacaaataaaccgtcactaaaacttattttaaaaataatcttttttttccagtaccaaatcatctggcgctgaccttagacacctcagcgccacgtcatctagcgctgaatgtcgtgccaccgcagatgggaggctaagtcagcgtgccaacgcatattcagcgtcacactatttggcgctgagatgtttaagttcagcgccacacgatgtaacgctgaacaaaagggttatttttaaaataagttttgatcggttcatttgtaaaaatattttttgcaaagagtcaaattgtcaaagtttgtggcaaagccaaacgggccagcacttgttcaccgcgcagcgcttgtcggccgccagctcgcgcggtcgcgcccatgtggtgatacccgtagaccggatatagagggtattggggtacgttgatgcaagggtctacgtagtatgacatcaagcaaacagaagacgaagattatactagttcaggcctcttgacaggtaatagccctaatccagttggtatggaattatatgatgggaatcacaggttacaaagggaacgatggaactcgatgaaaccggcgagatcataatcgaattgattcgactagatctcccagcgattcggctcctgcaggctccgacttcgtaggctgtggtggtggcgttggctgtgagattcgatcccgcaggtcctcccagggggtcccttttatatcgcaggtcaggcaatctccaagcaggactcagagacatcgaaccgcacacgatacgttgacaacacagtcttgcccgagtaggtctctttccatctgccaattccgtgaaggatttccttaacacgtatagagaatgtccctatatgcgcaggcatgccatattgatatgtgacatatatcgaagggtaaagggtatacctaacccgtaaccctgacagtagcccccgacttctgcttaaatgaactcgtgtgaccaacgcgacttctgatgtcgaagctgatgtcgttctcggtgtgggaaccgtagagacaggacatagtcgagaacaccatgtgaagtccaacggtcatgagtgaatttaaactgaagtctgaaagaccgccgcacgcaatagacccagaaatttccggcgggcatctatctcctttccttgaaattcgcgccgtgcgaagcgcgtctacttaagggaattttggggattcattctgaagtccgcctgttcgtgggaaaactttctagcctccaagcatccctcgtcttccccgctcccgcaaaaaccctcgcttgttaatctccgtccttcctccgacgatctctagttggcgatggatctcggcaaatctacttccaccaacgcgtcgctgaagaaactccaggaagagggcgcccttcccggtcgcggagtcatggagagagaagtaggaggtactgaaccccagcctgtcctaggtcgcatggttgcgatcgaggacaacattctttgtggttttctccctccaccttctgaatttcttctattggttctgcacttctacggcctttctttgctccacttgaaccccaattccattgccttcctcagtatttttgcgcacctttgtgaggcttacattggggtagagccttttctcgatctcttccgcttctactatgagttgcgttggatggaatccaacagggtgtccggatgcgtcggattccgacttcgggatggcttgaaatcgcgctacatcccgttccagtgcacttcttctcgaagcaaatggcgggcgaggtggttctatcttcagatagagaattcggatcctgtctttgtcgtccctgaggaacaaccagacaagatttcgtcttggaccgcaaagcccgccttgaccccttccctccaatccttcatcgatgccatcgacgacctccgagtacgaggtttgtcggggtatgaagtcgctaccgacttcgtcggtagacggatccaaccgctccaggcctgagcccacccagcctttgactattctgggccggaggacgcgacccgggtttctcctcggggtattttcctttttagttaaattgactccctcatgcgcgtgttctccctaacttatcaaattctgttctcgatcagcaggcttggatagcgccaccgtggagcgccgcgttggccaactgatgatcagcggcccgacaacggcagacgacgtccccgttcctctttgtgagaaggaggcgaccgagcgcgaagccgcaatcaacgtgagtgtagtcggcagccccttcatttttgctcctggattggataatgactttatgcaatgtaggctctccctctgactgacgccattggaccgctcgtggaccaccaggcggcggccttgttgaaggagggcatcgctcaggaggcgtccgatgtggccgttgccgctacgactagtggcagccgtgtcccaaggatagggagaaagttcacctccgtgctcggcagccgccggagagcgtcctccccatcggtgagtttcttgattcgttaactgcatagtcggaagatgccaccctcaattcgtacttggtttacttaggccgtggatgcgtctccgccaccttcgcgacggcggaagctggtgacgctgggcgagaagtaagtagacgaaaatcgagatttttcccttgtttgatttctggcgacttgttttgagggccagacatgatgatcttctgcaggtcggcataggcgaaggcggcgcaagacaggtctggagggaactccagcgcatctcctgcggtggcctcgaccgatgtcgtggtcgtgccgaggagccgtgaggcgacgccgagtgggccagccagtgacctcgggcctactcgcggcccgtctgccgacgtcctcacctggggggagtttcaagccgagatggggcgcatcctcgaggctggtgctcacggcataagtcgcgagattgcggaggcgagggcagcagcagcgtcgtcggcgaacgagcgtgccgacaagctggagcacgacctagcggaggttcgcgaggacctccagaaaatgagggagctggtggccggcaacgagtgacaacggcgggcactcgagggtcggatgtcagaactcgagaacaacttgtcggagatccgtggctcgttgcgggtcacctacaccggcctacaccagctcgccggggaatgtggtgttacgacaaccatcccggcgaaccccgacgagttctcgctgacgtcttcactcgcggaactagcaacgacgatggaggcgataccctccaagcatgcggccaggatcgtggaggaggcgtccaacgggatctataccggggcctgtcacgtccttgcatgtgtaaggttggcgcaccccgagctcgatcttcggcagatcttggatcggggggccgccaacgacgcgcgtaagggcgtgatggaggaaatcggcgagctgggagagtctgttctcccgctttttgaagagtaggacctttgttcctttgtaatcggttatgccttgtaaaaactttgttggcctcaactgcctttgcttgtgcagtcgtcaccttggtctccattagcactttggtcctgaatatttttggttgtcgtttgtaggtatgtcgatgtcgaggatgtccagcagcgtgggcagcccgagttaccggtggtcgtcccggcgattgcgctccaaccatatgtgtcccaggacgatgtaggtcaaagtttgcccgtgaatacgggtatggcgatgacttccctaagttggtgatctttgttttcatctcctttattcttctatccggagtgacttgattttctgtgttctcggaagagaagagcagcttgacttagttgtttccatgctgagcagatctcgagagtaggcttgctgaccaagatcgtcgcatccagtattggaagacgaagtgtgaggtcgcggaactcgagagagccatgttggaggtgagaaaggaccaggccgtagaggcactccgaggccgcgaggtgtggttcgactcgtatctgaagagttgctgcacgtccatgtcgagggtctgcagagagctccgagtacctcgtggggatcccgaagagtcggcggccggatacatctcgtggctgaacggagcctgcgctcagcttgagggcattggtcaacgcatcgacgaggccttgaagcaggagtgtcgtcgctcaagccggtatgccgggggacacgtgttggcctgtatacgagatcaccgtccgcagctgcacctcgaggtcctccgcgaaggtttttcacgttctcggaggactcctacggagatagatggcctggcgaagtcgatggtgccgctggcggagaaagttttccagtcgatggactggcgttggccttcctagtagcctttgtaccttgtgatagacatcttagggaaaagtgtaatatggttttggacctgtgtgaaattgtaagaagtatcttatgaaatagaaaagaaatctatcttaatgagtccttcttactctggatgtagtgtgtaagagtgcctcttcagttcccgactttggccagtcgtttgatttgtacactctccctagcccccagccttgtcgtcggaggattcttctcgaaggacaaggctcttggacctttgacctgcctcggttgaaccggttgaacaagcactgatcctagcccccagccgcgaagttggaaagttcatttccgattacgcggcttggttaatacgcaaggggagaactcttacacgaccaggtctgacatggtctttcgtctctacagaatccgacaaggccttatcggtctggagcgcttgtgcaggtagctttgtgtgcttgctatggaattgacaggcttcacaccgctggaccatgtcgcatgtgtctttgagggcggttggccagaaaaacccttgtcgaaaagctttcccgaccaatgtgcgaccggcggcatgtgacccatagattccttcatgtatatcgaggaggaggtgtctgccgtcgtcagacgagacgcatttgagaagtactctgtttggcgctttcttgtatagatcgttgccgatcatacagtaaatttttgctttacaggttattttctcggcctctgcgtcgtcctcaggcaactcttcgctgttgatgaatttgatcagtggggtgcgccagtcatctgtggtctcgatatcggcggtggcgcgttccgcctctgtgacctccgagctgatgtcgggggcggctatgttaatctcgctgatggcctctttcactgatggctttgtcaggatgtccagaaaggtgccaggctcaagaggttctcgcctggacgcatgtcgtgctaggtcgtctggctcgatgttgttcttgcggtatacgaggtacttggataactcggggttagagcatttataatctttgtgtacctggttggcgactagctcggagtcccatttcacgatcagtcgtttgaccccaagttcagctgctgctcttatcccagcgagtagtccttcgtactcggctgtgttgttggtcgccctgaagttgaggtggattgcgtgcttgaactgatctccagaaggagatgtcaagatgaatcctgtccctgctccttggctgttgagtgcaccatcgaacgccattatccacgtttcgttgtcgatctggttgcctgattggttatcaggcatagtccagtcggctacaaaatcggcgagtacctgggatttgatggttgttcgtggtacaaagtggacatcaaactgacttagctcgactacccattttgcaatgcggccgacaacgtctttatttctcacgacttcaccgagagggaaggaggagacaactgtgactctgtaggcttgaaagtagtggcatagcgttcttgatgtcatgattaccgcgtagagcagcttttggaactgtggatatctggtctttgcgtcatggagagcttcgctgacatagtagactagtcgttggactttctctctctcgacaacaatgacagtgctgacggagtatggcgtgacggcaatataaagaaataattcttcattaggttggggagcgacgagtacatggggatttgataggtagcgcttgagtgcaataaattcctcttcggcttcctatgtccatacaaatttatcttgcttctttagctgagcaaagaagggttgtcctcgttctcccatcctagctacgaacctgcttagtgctgccattcatccggttagctttgtacttccttgagtcttgcgggcgacttcatgttctcgattgccttaatcttctcgggattcgcttctattcctctgccagagacgaggaagccgagcaacttgcccgacggtactccgaaggtgcacttctgtgggttgagcatgaggcgatattgtcggaggttgtcgaacgtttcccgtagatcgtcaatcaatgagtcgcttttcttggtcttgacaacaatgtcgtcgacgtatgcctcgacgttgttgccaagctggttgctaagtgcgccctggaccgtgcgctggaaagtattcccagcggttatgagtccgaatggcatcttaacatagcaaaataccccgaacggcgtgatgaatgctgtcttctcttcgtcttctctcgccatgctgatttggtggtagccggagtaagcgtcgaggaaactcaacagctcacagccggctgttgagtccaccagttggtctattcgaggaagagggaagtgatccttgggacacgccttgttgaggtcagtgaagtcgacacacattctccatttcccgttggccttctgcaccattaccggattggctagccactctggatgaagtacttctctgataaagccagccttgagaagtttgtcgagttcttctcgtatggcttgtcttcggtctggtgcaaatctctgcagtctttgctttactggcttggcatcgggtcgcaccatgagtttgtgctcgatcacctccctggggacccccggcatgtcggacggctgccaagcgaacacgtcagcattgtcgcggaggaaggtgatgagcgcgagttcctatttctcgtttagtgatgccccgatcttgacggtcttgtcggggttggcactagagagtggaacggtcttgatcgcgccgttcggtttcggcgtcttgtttgtcttgctcattttcttgggtggctcagttgtggcgggtggacttggtgtttgctcgaccatgtcgaggctccgcttgtcgcattgtaccgccagctttgcgttcccttgaatagtgattgttccctttggtcccggcatcttgagcacttgatccgcgtagtgagatgcggccatgaacttcgcaagtgcagttctcccgatgatggcgttatatgctgtatcgaattcagcgacatcaaatgtgatctactctgttcggaagttgtttgcttggctgaaagtcacaggcaacgtaattttgcccattggtttggacgaagactggggagtaattccatggaagggttgatcggtgggcgtcaactcgcttcgtgggatgcccatggcgtccaaggtgctggcgaagagaaggttgattgagctgccaccgtcgatgagaacccgcgcgaccttgatgttccgaatagtgggttcgaccacgatcggatagcgtcctgggatgacagcagtcttgggatggtcttcttccgaaaattctatcttctgtttagaccacttcatcttgggtgcagccccctgccatgtcgagcagacttctcgctccacttttttatactctcgctttgaggagtacgctgtggaacctccaaaaatatgtgagacgtggaggtcagagtctagatatgctgagtccgattcctgagcagtcatctccgcatccttctcgaccacgcgtactcgcttgccttgttccaatgtcatgtgcttctcgagcgatttttttgaaaacaaggcagtcttccaaagaatgtctgttcgacttgtgtatgggacaccatgctttcctcgcgtcgctaccttgtgggtctgggcgtttgggagggttagcatattctgctgcgagaacttctgcttgagctttccttttcgcattcttgcgatttttctttttgcttgactcaggtgtctccgtggctggtttcttctcgcccccggtctttggcttgtcgttcttgcgtctaagcgcatcgtcaacgtgggcgcatcgctcaacaatctcgaatagtctccgagtagttgtgatgtgcctcgttgctaactcctgggtagtgtagcgatctctaacactagacttgaaggcgcgaattacagaagcgtcggtgatttcggggattgtatttctgcactcattaaagtgcccaacatattccctcaaggattcacccgagttctgtgtcaatgcgtgtaagtcgtcttcgatcgcgtggcgcttgtaagttccctggaagttggcgacgaactgctgccataggtctgcccacgaagaaatcgagtagggcggaaggtgcatcaaccatgaacgcgcagagccttttaacgcagttggcaaataattcgccaacgcgttgtcgtccgctccggcagcatagagtactgtggagtagacttaaagaaattcttctgggtcagtgctcccatcgtacttctctattgctcccggtcggaacctctcaggccatcggacatcgcgcaacgaatgactgaaagccctacacccagcactgggggcaatgggttgtcggcgatcgtatgtccttcgtggatgtctgtctgacgatgaggaggaggaagaagatgaggacgacgatgggtcgcttggtcccggtgaaggattacgagaacgccgaccgggttctcgagagccctgtcatcgtcctccattgttgtcccggcaccgatctctgtcatcttcgtcattatggcggtgtcctcgactggtatcgcccggcgtccttcgttcacgatcgtcgtgaatatggcggttgtggcggtgatcacggtctcggtcttcgttcgaacggcctcctcgttcttcattgtcgtgacgtcgtgaagagacgtgatgataggaacaattctcgttttcccgtgtgcgacgagcctctcggcggccgtttaggtgatcacggagatcgctggtgccgcgaggtggagggctagcttgatggggtgattcccgctgttcggggttttcaccgttgataccaccagttggttgttgttccgggtgggatgcagcaacggcctcttcgaacgcgttgctgaggttggtcactgattcccataatcgttctgtccattgtgcgagatcatcgtttagaacggggtcataaggggtttccctcagtattgcattgagggtcctgatgtgctgagccggtgtagtcgtttgattttccgcctcggtgttagcgcgtgctgatgtgtttgtcccgtcgatagccaatacctcgcgtggcgtacttgttgactaggagtcgtagtccttgagtagatgtaggactgacggttcgggagaaccgatgtcgataacaccgacgaaacgatttggggtcagcgtcgttcctcattctttgtcttcgcctctaagggtcttgcctggctactggaccttaggagatgacatatttgtgacgctgagaaaaactttacagcttgagaggtcatgattctttgtcttgtgaataggacaatagacaccacgagttggagaaacacgctgaattccacgctctttgcatgcgcgaatctcggcgcgggcgttgaggaaaacccagcaggcttgcaaagtatgtttcctggttttgtggatagggcaccaggaccctgtcgcttcggaagttattcttgtcggcttgtgtttcttgtcggaacgacaaggtttggccgcattagaatccttctcgagctcggatatcgtcgatgttctgttctccgcttcggcaggaggacctttcgacgtggagtcgtcttgggttatagccactgcgttctcgtttctggtcatcgatggctcagctgagatcggcattgtggtgtaaaccggaaagacaatttcgccgacttaagtccacgctagcatcgttgaggcaggaagcccgtagttgaggttggtgttgacgctgttgtcgacgaggctggatgacatagtagtagaaccttgagcaccaagtccccctacctggcgcgccactgtcgacgggtgatacccgtagaccggatatagagagtattggggtacgttgatgcaagggtctacgtagtacgacatcaagcaaacagaagacgaagattatactggtttaggccccttgacaggtaatagcgctaatccagttggtatggaattatatgatgggaatcacaggttacaaaggaaacaatggaactcgatgaaaccggcgagatcgtaatcgagttgattcgactagacctcccagcgattcggctcctgcaggctccgacttcgtaggctgtggtggtggcgttggctgtaagattcgatcccgcaggtcctcccagggggtcccttttatatcgtaggtcaggcggtctccaagcaggactcggagacatcgaaccgcacacgataccggaaatctctcgcactctcaaaagagaggtggggcgcttacgcttaagtcgatggaacttaaggttgaaataacactgggagtctgcagctcattctactgcaaaccaacacacccacgcctactctcccgggcctagaaggtttgcaacattctcatcaacccagtcttgcccgagtaggtctctttccatctgccaattccgtgaaggatttccttaacatgtatagagaatgtccctatatgcgcgggcatgccatatcgatatgtgacgtatatcgaagggtaaagggtatacctaacccgtaaccctgacaccatgtctctttaatcaaaggaaacagtgtagaaaagtttaaagcaactgcagatttttcttttaaaaaaaatcttcctctctacatttgtcgctacataataaaaatgtaaattagaaatcaaaatctcagaagcacatttccttttatttgtagaaactaaccatcaaccaaccaactgctacttaaagttgtactcatcataccccctccgtcctctaatataaaagattttaatattttacttacactgtttaaccatttgttttatttaaaaaattttagaattattatttattttatttatgacttactttattatccaaagtattttaagcacaactttcatatttttatatttgtgtaaattttttgaataagatgagtgaccgaacagtgcaagtaatatgttaaaattccttatattaagaaacggaggtagtataatagagccacaggtccatacaaaagcatgggatcaaccaaccgaatgcaatgcaaacggtcatagtagtagtgtagtagctagccacgttacgtaaagttacagcgcgcgtgcgcggcgccgcggcagcttcttttctccgcggcggccacgacaagcccgcgacgtgcgtgcagccggtgatgtcggcacagcgtggcgccgtggcgtgcgaacggtgaaccgttgctctagtctccgagattccacccagctaaccatggcccatctatcccgcgttagattttgtctatcgtctatctatggtcaatcgtcgtggtcgtcggccgctcgctgccgtacgtacgtttgtagtaagaaaatatgtagtgtccattgacgacgatgcatgcaattttcgtaattttgctgcgttcaaggcagccaaccacgatatcagatttataatattaaaatatataatattttatattagatttatttattttcgatacgaaagaagtagctaatataactggctatgttattgtgtgccaatttatggtgctagctagtaagactttgaaattttcttacgtcgtatgtgtatatagctttttttttcattttttacaaaaaactagcgcgcgcaaatagtcttatattagttgtagaaaagcaaaaaatataatatataagtggagaaagctttcatctcattagctatctttatctacaatacattgcagtagcacgagatagaaaatgaaaaagaaaatattatatgtgttgagtgtgtacttcctgaaatcaaccgtagtaaaaaaggctatgccctcttttaaaggcgcaacaaacaaatcgaacgcatccctgcaactctatgcaagttgtcaaattaatatgagccctaaatataggagtatatgctactccctccatttcaggttacaagatgttttgattttggtcaaagtcaaattattttaaatttaaccaagtttatagaaaaaataataataatattttcaacccaagataaatttattatgaaaatatatttaattattgatttaatgaaactaatttagtattataaatattactatatttatctataaatttagtcgaatttaaaatagtttgactttatccaaagtcaaaatatcttataacctgaaacgaaggaagtaccaatgatgttgctaaggttctttcgccctgatcttctgtcaaaaatggagggccctgagatagtgagatgtcgacgccgccggccagacggctactacattacttgttgccaacctgccaattaactgattgcacgatcgcctaagaacagttgaaaccccgcgtgttacagtggaatatattttatttgagattgatggttgcttttgataaattaaagtggtataaaaatccatcactattgaattgggccacgatcaaattagatagccctcccgtggtgaaaaatatatatgggcctcacgtggtgactgtatgcgagatggattgggctatattttttcatccaacggttcagagatgattaaatatattgatccaatggctgagcattaacgatgatgtggcacattgaggtttgagttttagatcttaattgtagttagtgggttataataactttatagtaagaagggattagagcccgtcggttagcctaacaagttaaagtaaaagctaaaatttaaatttttaacttggttttgaagttgatattttcaacataatttctttgaattattagtttttaagtcgctacgaacaaatatataaaagttttacctataaattattttttattctctaataagccgaaaggacttgttagggaatacagacaatcgatgagcctcttgttagaaaacgatagtcaaaacgataaaaaataatagatcaatcacataagacatgagatttaacgtgaaaaaccctccaaagcaggagagaaaaaactacgggcaccagctagcaaaataccttcactgaggttacaacgtcgtacggtgggttacaagaggtatatatatgatatatatgaggtgaaaccctaaaaggtattacgatccgtaccgcgggggctctgcccccacacccccgctccgctccggcccagcctcccgcagggcccccaattcgctccgacagatctttattaa

SEQ ID NO: 67743 - DNA, 1123 bp, Oryza sativa
tatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatggga

SEQ ID NO: 67744 - DNA, 23124 bp, Oryza sativa
  unsure (1)..(23124): unsure at all n locations
ggtgttactaacctggaataaaaatcaaaacacactatataatccatagtaccgatcctcttttcccgtccacacaacaaactcctccctctatctctttttttcctctctaacttcttatctctttccttatctctaactcccctcctctccttccttttttccttcaccacagtacaggcggtcggcgtggaggcggcgacgcgggggacggcgcggaggcggcctgcgcggcggtcggcgcggcagcgcggggggccgcgcggcggcggcggtgggcggctggcgcggcggcgcgggaggccgcgcggcggtgccgggggccgcgcggaggcggcggctgcggtgggcggccgctcggcggcgaccgacgcggcgctggccggccggcgcggatgggaggaggggaggcggcagtggccgccggccggattttttttcttttttttttttgaaatgtgaatctgtgatgtatttttgtgtgagatgtgaatctgtgatgaattttttagaaccctgtgatgtaatttttttaagagtttgtgatgtatttggagatgatttgtttgaggatttggagatgttctgtaatatgtgatgatttggatatgggaggggatggtgtgaaatcaatattcaatattaaaagcagaaaaaaaaagaaaaaatatctttagtcccggttggtgttatcaaccgggactaaagattctcccatctttagtcccggttggtaacatcaaccgggactaaagattgatttttagtcccggttatttgaaccgggactaaagatagcgatctttagtcccagattcgtagtcccggttggaaaaccgggactatagggggttatgaaccgggactaaaaagcatttctccaccagtggtaacgctacactaatacattaacaaaagcgtctcctaacacatgtttaaagaaacgaacaccagtagtatatctttgatgctcgcttatatgcgtatatatatgaacaccagaatttaaactctgatgaagttaggagactccaccgtttataccgctagtgctttttgtcttggttgactgatttttaccacgacgtttgaagcgatttgctcgtatggatggcggaatttcataatgaatcagttcatacttctgtgaagtttattttttttaaatcatgtgtttggtacagtgctatgcaaggtcaattggctgtgactctcagtctctctagatgcggaccatgcatgtttggtgtacgcgaatttgaaatatgtaaaaaaaatttgaggttttgattgagccatggatgagacgaacatgcacagacagtaccgtcacgtttcgagctgcgcgtgcccatctgtcgtggtcggtgtactgtggtacgtttcacggcaatcatggggcgaacgagttcaaaacatacagcgacataccaacgtctaatctacgagtgtttgctcgttacttctctgtctctccctttcagacttttgtatcgtttctcccaaagcacaaaagcaaaagatgaacagaaacactggaggtagaagatcgatgatgatgacggggatcaatggactgttgcacaggtcgatcgatcacctacgaaatgacgtgtccattttctaaaagaaaaaaaaaagagaaaatgacgtgtagatttttgtcattttggagtctctcgtatgctcgtttttgtacttcccttgctcagacgacgcatcaactttgcaaatgtgcaggacttcagccagaaccgatcgaaagcgttaattagtacttcctccgtttcataatgtaagttattctagcattttccacatttatattgatgttaataaatctagacaatatagaaaatgatagaatgacttacattgtgaaacggagggtttagtcaactagtcagttatcaccaacgtggagaggacgtagcggataaacatagccgctttagccagctaacatgaccacatcacgcattattttcttttggactaatcaattactcgctctgtctttagagattctgaaggaatgtgacatatagtagtactataaacaagatacttttctagattcgtattattagaatagatcacatcctccaagatcccttatattatgaaacgggaagagtgttagtgatcagtcaaatagtatagtacgtacaagatttaatattataagtcgtttgattttttcttaatcataattttttaatttaactaattttatataaaaaaataacatctatgagcaaaattagtttcgttaaatttaacattgaatatattttgatgcaatgtttgttttgaattgaaaatgttactatatttaactataaacttgaccgacttaaaaaaaaatatgtaccgattataatatgaaacggagtaaaccaattaagtcacgttttgaagtagcatgcacagatgtaggagttacgacataatatacgattaatctacgcaacatgcgaggcgtgttggatttgcaaggagtacaaagacgggcgagagccgtgatctgctggacgtccactacaaataggcactccagctagatttgggtcggagagtcggactcggaccagtccagatcacacgcaatctgagcactcagttatggcaaaacactttgcttatctcttccttagctagtatacgtacgtagtgcacatgaacaattgaaagagaaacgtactaaagaaaaagtcgacgctgtaataactacttactccgtctcaaatatatttacactatttatatccaacacttaaccattcattgtatttgagaaagttttatgattagtatttttattgttattagataataaaacatgaaaagtgttttatgtgtgactatttttaaaaataatttataaatttttaaataagacagatgatcaaacgttgaagatcaaatgttagacactaatatccacagttaagtttattttagacagaggtattaagaaaaagtcgacgcattgatatccacagttacctttattttggacggaggtggtaagaaaagtcggcgcagagagcgtgtacattttggagttaggtaccgatcgatcgggatcgtgacaacaacctatctgcagcgtacaaaatgagcgaaaacgacggccgaaagccactctcgtacgtgtgtttcttgcccacacgactacggcagcgagcgggactgcgttacagcgcgcgtggggcacgagtaggaggagccgaggagggagaagcacgtatatatttcgtttcaaaaaaagaagaagaagaagaagaagaagagaagcacgtatgtatagccagttggccacgtacagctagcgctatataaatttgcctgtgttgcgtagtatggtcttttgccaacaaaattcagttggcagagctcggtcatcgtgtagctagcttacctttgtcttaaaataaatttaatttccatccatatttatctacttttaatacaactagcatggtggcccgcgaagattgcgcggctagcaccgttatatttttctcatataatagcttaaatatattcacattttattaaatacattaaaatggcaacataatttaaattcttgatcaaactaacaactgtgtgatattcatattgtattgtatatacgtaatagttattaattattttaattttaaattttagttatttatagattgtatttctatatggactctagactcatctttcaatatttttaattttttaattccgaattttattattgataaattttattcctatatgaactctggacacttcttcacatattcaattttcttaattccgaattttagttatttgtaaattgtgtttctatatgtactctaaactcttctctcaacattccttattttataattctgaatttccgttattgttaaattggattcctatacggactctatatttgtttccaatatttcttattttttaaatttcagttatttataaattttattctatatggactctagactattttttcaatattccttatttgttaattccgaatttcagatatttataaattgcatttctatatggacgctagactcttcttctaatcttgcttattttttaaattttgtattttgttgttctatattgtatttctatatggaatcttaactctacttttaatttttcttattttttaattctgactttcagttagttctatattcctatatgtactatgtactatagactcttatttcaatatttctatttttctaattcccaatacattatttctaattgtatttatgtatggactctaacttcatttttcaatactttgtattttttaattttgaattttagttatttataaattgtattcctatatagactctagattttttttgtctaatatttcttattttttaattctgaattttagttatttataaattttattcctatatggactctatactcttctcccaatcttgcttttcttaatttgaattttagttattgtaaattatattttgatgtggactctgacttctatttttaattttcctaatttttaattccgaattttaattagttctaaactatatacttgtatggactctaatatcctctttcaatattccttactttaattctgaatttttgctatttttaaattgtatttctatatgaactctatttttattttttttcaattaatatgagaatttctaggccatgagagtagacttggtggcccgtacagattgcatggttagcattgctataatcttttcacgtaataacatatattctttcatattttgttgtagaaaaatattgaaattgtaaccatgctgaaccaaatcgaccaatctacgatattctaattaatatagtaattcctatgtctatagagcaaacgtgatataatggatcatctggtatatttgtttgtttcctccctccatctttatactcttttagactattagtgacatcttgtaattatctgtaatgtatttattagcatgcactattgtacaattagaaagggacaaataaattgcctcccacggccatgcatgatagcatgagtacggttactattagtatctcttacagtttccaaaattggtgtttcatcctgtttctaaataaaaccttgtccgtttgcatgtactcctaattttctttggttttttctttgtttttcttgtccgcttccacatattgtagtcctaatatgattctcttttctcttttttcttattttatttcgattaatgtgggattttctagaccatgagagcgaaaatactcctatcttaattttctagactaaattagtttcattaaatcaataattaaatatattttcataataaatttatcttgggttgaaaatattttttttctacaaacttggttaaatttaaaataatttgactttgaccaaaatcaaaacatcttctaacctgaaatggagggagtagcatatactcctatatttagggctcatattaatttgacaacttgcatagagttgcagtgatgcgttcaatttgtttgtcgcgcctttaaaagagggcatagccttttttactacggttgattccaggaagtacacactcaacacatataatattttctttttcattttctatctcgtgctacttcaatgtattgtagatactatactacacagacaaaatgtcgactacgtacgattgtaaaagatagctaatgagatgaaaggtttctccactaatatattatatttcttgcttttctacaaccaatataagactatttgtgtgcgctagtttttttttaaaaaaagaaaaaaaagctatatacacgtacgacgtaagaaaatttcaaagtcttactggctagcaccataaattggcacacaataacatagccagttatattagctacttctttcgtatcaaaaataaataaatctaacataaaatattatatattttaatatgatatcgtggttggctgccttaaacgcagcaaaattacgaaaattgcatgcatcgtcgtcaatggacactacatattttcttactacaaacgtacgtacggcagcgagcggccgacgaccacgacgattgaccatagatagacgatagacaaaatctaacgcgggatagatgggccatggttagctgggtggaatctcggagactagagcaacggttcaccgttcgcacgccacggcgccacgctgtgccgacatcaccggctgcacgcacgtcgcgggcttgtcgtggccgccgcggagaaaagaagctgccgcggcgccgcgcacgcgcgctgtaactttacgtaacgtggctagctactacactactactatgaccgtttgcattgcattcgatcggttgatcccatgcttttgtatggacctgtggctctattatactacctctgttttcttaatataaggaattttagcatattacttgcactgttcggtcactcatcttattcaaaaaatttacgcaaatataaaaatataaaagttgtgcttaaaatactttgaataataaagtaagtcataaataaaataaataataattctaaaatttttttaaaaaaaacaaatagttaaacagtgtaagtaaaatatcaaaatctcttatattagagcacggaggggtatgatgagtacaagactttaagtagcagttggttggttgatggttagtttctacaaataaaaggaaatgtgcttctgagattttgatttctaatttacatttttatgtagagaggaagatttttttttcaagaaaaatctgcagttgctttaaacttttctacactgtctcctttgattaaagagacatgggcgcgaccgcgcgagctggcggccgacgagcgctgcgtggtgagcaagtgctggcccgtttggctttgccacaaattttgacaatttgactctttgcaaaaactatttttataaatgaactgatcaaaacttattttaaaaataacccttttgttcagcgttacatcgtgtggcactgaatttaaacacctcagcgccaaatagtgtgacgctgaatgtgcgttggcacgctgacttagcctcccatctgcggtggcacgacattcagcgctagatgacgtggcgctgaggtgtctaaggtcagcgcatgatttggcgctggaaaaaaaagatcatttttgaaataagttttagcgacggttcatttgtaaaattagttttttcaaagtgtcaaattatcaaaatttgtgtggctttgccttcctgtggctgctatgcaaagccaaattacactgccacgaaattaactccaataggttgtacggattatatctactaaaggccttgtttagttctaaactttttctttaaacttttaactttttcatcacatcaaaacttttctacacacataaattttcaatttttctatcacatcgttttaatttcaaccaaactttcaaccaaacgttcattatatctgttgacaggtgatacccggatatagagggtattggggtacgttgatgtaagggtctatgtagtacgacatcaagcaaacagaagacgaagattatactggttcagaccccttgacaggtaatagccctaatccagttggtatggaattatatgatgggaatcacaggttacaaagggaacgatggaactcgatgaaaccggcgagatcataatcgagttgattcgactagacctcccagcgatttggctcatgtagggtccgacttcgtaggctgtggtggtggcgttggctgtgagattcgatcccgcaggtcctcccagcgggtcccttttatatcgcaggccaggcggtctccaagcaggactcggagacgtcgaaccgcacacgatacgttgacaacccaatcttgtctgagtaggtctctttccatttgccaattccgtgaaggatttccttaacacgtatagagaatgtccctacatgcgcgggcatgccatattgatatgtgacgtatatcgaagggtaaagggtatacctaacccgtaaccctgacagtagcccccgacttctgcttaaatgaactcgtgtgaccaatcgcgacttctcatgtcgaagctgatgtcgttctcggtgtagaaaccatagagacaggacatagtcgagaacaccatgtgaaacccaacggtcatgagtgaatttaaactgaagtctaaaagaccgccgcgcgtaacagacccagaaatttccggcgggcatctctctcctttccttgaaattcgcgccgtgcgaagtgcgtctacttaagggaattttggggattcattctgaagtctgcctgtttgtgagaaaactttccagcctccaagcgtccctcgtcttccccgctcccataaaaaccctcgcttgttaatctccgtccttcctccgacgatctctagttggcgatggatctcggcaagtctacttccaccaacgcgtcgctgaagaaactctaggaagaggacgcccttcccagtcgtggagtcatggagagagaagtaggagttactgaaccccagcctgtcctaggtcgcatggttgcgatcgaggactacattctttgtggttttctccctccaccttctgaatttcttctattggttctgcacttctacagcctttctttgctccacttgaactccaattccattgccttcctcagtatatttgcgcacctttgtgaggcttacattggggtagagccttttctcgatctcttccgcttttactatgagttgcgttggatggaatccaccagggtgtccggatgcgtcggattccgacttcgggatggcttgaaatcgtgctacatcccgttccagtgcccttcttctcgtagcaaatggcgggcgaggtggttctatcttcagatagagaattcggatcctgtctttgtcatccccgaggaacaaccagacaagatttcgtcttggaccgcaaagcccgccttgaccccttccctccagtccttcatcgatggcatcgacgacctccgagtacgaggtttgtcggggtatgaagtcgctaccaacttcgtcggtaggcggatacagccgctccaggcccgagcctacccagcctttgactattctgggccggaggacgcgacccgggtttctcctcggggtattttcctttttagttaaattgactccctcatgcgcatgttctccctaacttatcgaattctgttctcgatcagcaggcttggatagcgccaccgtggagcgccgcgttggccaattgatgatcagcggcccgacaacggcaaacgacgtccccgttcctctttttgagaaggaggcgaccgagcgcgaagccgcaatcaacgtgagtgtagtcggcaaccccttcatttttgctcctggatcggataatgactttatgcgatgcaggctctccctctgactgacgccattggactgctcgtggaccaccaggcggcggcctcgttgaaggagggcgtcgctcaggaggcgtccgatgtggccgttgctgctacgactagtggcagccgtgtcccaaggatagggagaaagttcacctccgtgctcggcagttgccggatagcgtcctccccatcagtgagtttcttgattcgttaactgcatagtcgaaagatgtcaccctcaattcgtacttggtttacttaggccgtggctgcgtctccgccaccttcgcgatggcggaagctggtgacgctgggcgagaagtaagtagacgaaaatcgagatttttaccttgtttgatttctggcgacttgtttcgagggccagacatgatgatcttctgcaggtcgacacaggcgaaggcggcgcaagacaggtccggagggaactccagcgcatctcctgcggtggcctcgaccgatgtcgtggtcgtgccgaggagccgtgaggcgacgccgagcaggccagccagtgacctcgggcctactcgcggcccgtctgccgacgtcctcacctggggggagtttcaagccgagatggggcgcatcctcgaggctggtgttcgcggcataagtcgcgagattgcggaggcgagggtagcaggagcgtcgtcagcgaacgagcgtgccgacaagctggagcacgacctggcggaggttcgcgaggacctccagaaaatgagggagctggtggccagcaacgagcgacaacggcggggactcgagggccagatgtcagaactcaagaacaacttgtcggagatccgtggctcgttgcgggtcacctacaccggcctacactagctcgccgaggaatgtggtgttacgacaaccatcccggcgaactccgacgagttctcgctgacgtcttcactcgcggaactggcaacggcgatggaggcgataccctccaagcatgcggccaggatcgcggaggaggtgtccaatgggatctataccggggcctgtcacgtccttgcgtgtgtaaggttggcacaccccgaactcgatcttcggcagatcttggattggggggccgccaacgacgcgcgtaagggcgtgatggaggaaatcggcgagctgggagagtctgttctcccgctttttgaagagtaggacctcagttcctttgtaatcggttatgccttgtaaaacctttgttggcctcaactgcctttgcttgtgcagccgtcaccttggtctccgttagcactttggtcctgaatatttttggttgtcgtttgtagggatgtcgatgttgaggatgtccagcagcgtgggcagcccgagttaccggtggtcgtcccggcgattgcgctccaaccatatgtgtcccaggacgatgtaggtcatagtttgcccgtgaatacgggtatggcgacgacttccctaagttggtgatctttgttttcatctcctttatacttctatccggagtgacttgattttctgtgttctcggaagagaagagcagcttgacttagttgtttccatgctgagcagatctcgagagtaggcttgctgaccaaaatcgttgcatccagtattggaagacgaagtgtgaggtcgcggaactcgagagagccatgttggaggtgagaaaggaccaggccgtagaggcactccgaggccgcgaggtgtggttcgactcgtatctgaagagttgttgcacgtccatgtcgagggtctgcagagagctctgagtacctcgtggggatcccgaagagtccgcagccggatatttctcgtggctgaacggagcctgcgctcagcttgagggtattggtcaacgcatcgacgaggccttgaagcaggagtgtcgtcgctcaagccggtatgccgaaggacacgtgttggcctgtatacgagatcaccgtccgcagctgcacctcgagttcctccgcgaaggtttttcacgttctcggaggactcctacggagatagatggcctggcgaagtcgatggcgccgctggcggagaaagttttccagtcaatggactggtgttggccttcctggtagcctttgtaccctgtgatagacgtcttagggaaaagtgtaatatggttttggacttgtgtgaaattgtaagaagtatcttatgaaatagaaaagaaatctatcttaatgagtccttattctggatgtagtgtgtaagagtgcctcctcagttcccgactttggccagtcgtttgagttgtacactctccctagaccctagccttgtcgtcggaggattcttctcggaggacatggctcttggacctttgacctgcctcggttgaacaagcactgatcctaacccccagccgcgaagttggaaagttcatttccgattatgcgacttggttaatacgcacggggagaactcttacacgaccaggtctgacatggtctttcgtctccacagaatccgacaaggccttatcggctctgggcgtccccagccgaagatcccttaggttccttggaggccttgtcagcatggcataaagggacatgaggataggtttcaacgctaagtgtcatctgggtgagggatcatcaggcaggaacactgtgattgtaatatgcgcctgaaaataggctttattgatactgtaaggtgtcttacaggtatgggtggtattgactcatacgtagaatttacgtagttggtaaaagttccatgagtttgccaactcgcggccatcaccgtctgcaattttgaatgcgcctggccgcaagacttgtgtgatcgtgtatggtccttcccatttaggtgagaacttgtttcgccttgcttggttttgaacccttcggaggacgtagtcgccgatcgaaagtatgcgtgctcggatgcgcttctcgtggtaacggcggagggcttgttggtagccggctgctcggacggcaactcgttcgcgatgttcctcgagtagattcacattgtcgtttcgctgctcctcctgatactcgtcggaatacttctgtgctcgtgtactctgatgtcatagctcgctgaggagcatggcctcggagccgtacacgagaaagaagggtgtttccttgttagacgttgtcggtgtggtgcgtatggcccatagtactaatgggagttcttcaacccatttcttgtcgtgtgacatgagcctgtcgtagacgcgggtcttaatcccttgtagtactatgccgtttgccctctcgacttgtccgttgctttgaggatgagaaaccgaagcaaagcatattttgactcccagcccgatgtagtaatcctggaaatcggtgctgatgaactgggagccattgtcggtgatgatgcgatgcagtagtccgtatctgcaaaatatccccttgatgaacatgatggcgttgtcggccttgatttctcccgtgggtaccgcttcgatccatttagtgaatttgtcgatcgccacgaataggaacctgtagccgccttgtcctcgtgggaatggctcgagtatatctagcccccagcacgagaacggccaagtaagagggatggtctggagcgcttgtgcaggtagctttgtgtgcttgctgtggaattgacaggcttcacaccgctggaccatgtcgcatgcgtctttgagggcggttggccagaaaaacccttgtcgaaaagctttcccgaccaatgtgtgaccggcggcatgtgacccacagattccttcatgtatatcgaggaggaggtgtctgccgtcatcggatgagacgcatttgagaagtactccgtttggcgctttcttgtatagatcgttgccgatcatgcagtagatttttgctttacgggttattttctcggcctctgcgtcgtcctcaggcaactcttcgctgttgatgaacttgatcagtggggtgcgccagtcatctgtggtctcgatatcgacgatggcgtgttccgcctctgtgacctccgagctgatgtcgggggcggctgtgttaatctcgccgatggcctctttcactgatggctttgtcaggatgtccaaaaaggtgccgggctcgagtggttcttgcctggatgcacgtcatgctaggtcgtctggctcgatgttgtccttgcggtatacgtgtcggacctcgatcccatcgaaccttttctccagcttcctgacctctgcgaggtacttggataactcggggttagagcatttataatctttgtatacctggttggcgactagctcggagtcccatttcacgatcagtcgtttgaccccaagttcagctgctgctcttatcccggcgagtagtccttcgtactcggctgtgttgttggttgccctgaatttgaggtggattgcgtgcttgaattgatctccggaaggagatgtcaagacgaatcctgcccctactccttggctgttgagtgcaccatcgaacgccattgtccacgtttcgttgtcgatctggttgtctgattggttatcaggcatagtccaatcggctacaaaatcggcgagtacctgggatttgatggctgttcgtggtacaaagtggacatcaaactgacttagctcgactaccctttttgcaatgcggccgacaacgtctttgtttctcacgacttcaccgagagggaaggaggagacaactgtgactctgtgggcttgaaagtagtggcgtagctttcttgatgtcatgattaccgcgtagagcagcttttggatctgtggatatctggtctttgcgtcatggagagcttcgctgacatagtagactggtcgttggactttctctctcgacaacaatgccagtgctgacggagtatggcgtggcggcaatataaaggaataattcttcattaggttggggagcgacgagtacagggggatttgataggtagcgtttgagtgcaataaatgcctcttcggcttcctgtgtccatacaaatttatcttgcttctttagcagagcgaagaagggttgtcctcgttctcccatcctagctacgaacctgcttagtgctgccatgcatccggttagcttttgtacttccttaagtcttgtgggtgacttcatgttctcgattgccttgatcttctcgggattcgcttctattcctctgctagagacgaggaagctaagcagcttgcctgacggtactccgaaggtgcacttctctgggttgagcatgaggcgatatcgtcgcaggttgtcgaacgtttcccgtagatcgtcaatcaatgagtcgcttttcttggtcaacgtctgcgccggcgttgttcaaggctgcatcagtacattcgacctcttggattgctctagtttggatgatatatttgcctacctatttatcatatgtctctgttaatctagtcttagcatatcaatttagctctatcggctgcttctcgttttagggtttatgccggtatcggctaaatcgccttgctagattagattagcttagacatctaccaccctgaaaactcagtcaacagcttgattgtctagatattatgtttcttttcatacttagtgttgcatcagttaagtttgatctactaagtcgtgcttagaaccataatatctagcctgcttcttgactgccaataagggtttcatcggggtttcagccgatgagttatctggacgttgcatcggcttataaggattgtatacatgttggatttagccgatgacaacaaaggtttcactgtttaatctaatctgtggattttatgacatcggacctccagccgatgtatgctttgaccttcggatcaatgcttattctatcatatcattgctagccgattggtttatattggattatgttattgttatattatattattatcagccgattgcatttatatcatcatctatattggacatatagccgatcgcttaaaccctattgctatcggctggtatcggcgtcggctattatcgatatcggctgagattgcagcatcggcttgtcagccgatcggctgttttgtttattatttgcatatcttgtcagttgcaagatcaaactgactggcacgcccgcatctcatcatatttggacctgcactggagttaagcagatctcccagaccggtgtgtttgatttttttcgtcaacacaaattggcacgcctagtgggaccacgaattttatatccacatgtctgaagaagaagtcaatgtcaagatcatggtcacaatgtagaatttaacagaggaacaaaggcaacagatgaagcagtttgtagctgattttcaaatgcgttgtcttcaatgtttcatcatgacaccagaagggccaactcagaagactcaatttcccaagccgatagttgaaatacttcaagatacagttgatgacgcagttcatcgcgcattgtttaatcaatctggagttttggcggatacattacaaaatttgatcaaagtaacagttgatgagttattcagaaaagccagctcagggagcagattgaagaacaacaacagcatcggctcggggggcagacacatcaatgtcagcatgatgagctatatcaacagtatcggccagaagaatctcaaagatatcagaatatagaagattgggccgatagaattgcaaaattagtagaggagcagtttggaattagacctaaggaacggatccatatgtatcggcagccatatcctgaatggttcgatagagttccacttccacactgatacaagattccagatttctccatgttttcagggcaagatgatacatctatacttgaacacatcagccgattcttactgcaatgtggtgaagcatcgactgaagaggctctgaaagttaggttttttccattgtctttgactggatcggctttcacttggttttcatcattaccatcaaattctatcagaggatgggccgatcttgagaagcaatttcatgactacttctttgctggattcagcgagttgaagctttcagacttaatatcagttgagcagcaaaaaggagaatcggctatggaatatattcagagatttcgtaatgtccgcagccgatgttatagtttgagcctaagcaatgaacagctagtagatcttgcattccaaggattgtcagcacctatcggagatagattcttttgccacgagtttgacagtctagctcatctaatgcaaacaatatcggctcatgaaagccgattgcacgaagcaaaggaagatcggttttggagttatcaagacaagaaattttgaagcatgagttctcatactccaaaactggggggcatgtgttaacagtgaaatttggtaagcccaaagttaccatcggcttagagtcagtatcagcttcaaagttctagaatcagccgatgggagtcaagtcgccacgatgtcgtgttcatggtggagtcggatcaatcaaaggaagcttatctagaagagtccgagttcaagaccgatgcgacatgacagtttatctattaattaggcatagtttgttagtttcattttatctttaggaaagtgtgtttagtgtccgataaggactttatattttcctttttagtttctttcttgtccgacaaagactggttcctttttagtttctttcttgtccgacaaggacttgtatctccctatgggtataaatatgtacacccggggtctatgtaatctatctctacgatcaatacaattcggtgcatcgccacccttttaccttttctactttattttatcgtccggcgggacttggcacctgacgcggggctgcatcggtgttcgatctccggcgaaggggtaagtccaatgttccgtcggcccaggcaattgtatcgtctgcgccggcgttgttcaaggctgcatcagtacattcgacctcttagattgctctggtttggatgatatatttgcctacctatttatcatgtctctgttaatctagtcttagcatatcaatttagctctatcggctgcttctcgttttagggtttatgccggtatcggctaaatcgccttgctagattagattagcttagacatctaccaccctgaaaactcagtcaacagcttgattgtctagatattatgtttcttttcatacttagtgctgcatcagttaagtttgatctactaagtcgtgcttagaaccataatatctagcctgcttcttgactgccaataagggtttcatcggggtttcagccgatgagttatctggacgttgcatcggcttataaggattgtatacatgttggatttagccgatgacaacaaaggtttcactgtttaatctaatctgtggattttatgacatcggacctccagccgatgtatgttttgaccttcggatcaatgcttattctatcatatcattgctagccgattggtttatattgtattatgttattgttatattatattattatcagctgattgaattacactgacgagccctagttaatttactgtggtaataataatatttccagagagcaactctaacctggtgtttggggatgtcgaccaggcatactacatctgcaagtctcttctgcagcagggcttcaggccgcagcaattcatcccatccaccgcaaaatgtaccacctccttggcaacatgtctgcgagccattccatcacctctagggccagaagcccaagcagaatacagtgactggatatcctcttccgacaacccgttccgactgagatcgagcaccttcagttgctttgcagaaatgatggcatcagcgagttcttggatggcatggcaaccagaagaggagtttctctggcatgaacttgcacagcttccatctgagccggtcgctgcacgggtatcctcgtagactgcctcttcgtcttcgctatccggcacctccatcttatcagggtctatgcgatcgttcgcttcagcattggtacgttggttttggtcagtacctggtgatacatcctgcgcgtcttcatcgtactgcaatgttctctgtagtgccaggtttgtgttctcagcaatgcgtagttcctccaatcggtcatttcctgaaagtagcacgagactttgaggttgaggcagaaacttttcatatttgttaatttttatgtagtggtcgttcctcacctgctagtgcttgaataatgcccacgatgccagcaagcccaagattgcatctatcaagggtgagagatctgagactgcattggggattcgaaagcaataccccaatagcttcacatccctgcaccgtacggcgtaagtcaaaccattggggttaccagaatttgtataagtatatcaaggcattcgagaataggaaggaaacctctagggtaaaagaatttcctccaaggttcaagtcaataatattaattttagaaagatttctagagttgtgagaaatcaggagttgtaagcccacagttggataaatccaatctcagcaattcttgtgatgcacaggagagtgcctcagtaagcttagttgcccctccctacaaaaaaaaaaaaaaaaaaaaaaaaaaaaaaaaaaaaaagcttcatagataagaagaatgttgtttgtacaatctgaaaatacttttttttttgtggggacaatctgaaaatacttaaccatgcgtgggaagcagactcactgatccaatgttagttccacctagcagaaatcctgataagcatgaggattgtgcaagtagacacagcttatcagccattaacttattcagttttataccagtcaggcttagttccgaaaacctgcagtgatgatggctatccattatttcactgcacatctattcccaataggtatcaacagtaattgaacaaatgttagcgaaccttttcagagaggcaagtttggagagaaggctaagcattgtatttccagaaattggattgttgtttcctgtcaaaaatatgaaagtttgaaacataagaatgtttatgaaacatatctgatagtttcaattatgcagagcaggagtaataaaagtacctaaggagagatgtgaaaggacagacccttcatgcagtgcatctgccatcttctgaactgttcttgatgtgatagaacattgctcgacattcaagctgtacagtgctgttacgatatgtaaacagaagacacattctataagaggtaattaaaagctggtgccatcaaagaaaaagaaggctggcgaaaacacagaaagtgccaaaaacagtacctacctttgcacttctgtaggactgtgaaaaggtaagaaccgcatgcatctgtgaggcgattcccagacagattaagtacttctaatcgattagtcataacagcacactcacatatctgtattagtaaataaggagcaaatgatttcagaattctgttcctaaaatgaacatgtgcctgaaagcaagacagcttattttggtctgataggcagtgaaagaatagtttgttctgataaaggggtcaaccctccagtttcatcagagtatggaattagaaccatccaaatggtttcagttggttttaacaggatcattgagatttgcgactaagagggacatccaatctcaatgcagaaaatcaaccagtacttgttatagcacattcccagttgagtctaaagtaagtaatggagtatagcttttagtgatctaaatttctcaaacagtaagactaaagagagatatcgcaaaagttaaattggttttcaacaggaattctcccaaagaattagtagacataaggactgcctgtagttcgggcctttctcggccttgttaaaagtcttatggaacatctctccccaagagtcaagttttccttttattgtagaagaggatccagtccattttaatgtgcaatttttttgagctttcaaaagcagaaataacctgtagtttcactttgataaacaagtttagggatagtaaaaagacctgaaataaagcagttggaccaaatcgattacaatgtaaatccagtgtcaagccaccatatgtttggcttgatgaagaaaatatttgttgaagcctctcaattgtttggtttcctgcagttcgtgaacataaactttagtcattgtaagagcatagaggaattaatatgatacacacacatttagcttgaactggctttctgtgatgtcgccaaatcattggtgcatagattacataagacaaactaggagaagaaacagatatactggaaaaagcatacctagcatattatgggaaagatccaacacagctattgttttatgtaattttagagcatcaagaaaaggtgtgatcgacaggtcttggagtccacaatcagacacaataacttcatcttcagagacctgtcaaaaaatagaaaggcatgaacactttgactcttcaaaaataataagccactttataacattgtcaatcaaatatgaatgatacaaatctaacaaacttacttcaagattatataatttctttaagagcttcttgtttggcgcttctgataactttgtgcagaaatcaacatacaatttcatcagccgctttggcacccaatcttcattataaacatggtatatcagatgaggtataactataggaaatatgtacattacatttcagtgcgacgcattggaatgcaatagaaagtttacccatgaaaccaaacacctatacatggagtttagtgccatatacagacctaaaatggatcaccatgtgacaaacatatgcacaccatcaacattntaaaacacatacataatgcanaaaaaaaaaagcgggtactccaatacttgattttgagcagagaagctgaaagcctcaattagtgagttcatatgagaagcttggtttggagaagatttgatgcaaaaattagatattaatattatactaatatttaataatgacagtaaaccagcatgatttatcccctttttactagtaataatcattttatgtaatgataggataggaaggattctgaagttaagataaacagtagtttgccagagatttctgctattcgtttattgggcaatctcttctgaatcccaatgtagtaacttttctccttaatgcaatgatacacaaatctttttgtgacttccttaaaaaaaatgaaacccactgtagtaggttagtagcatgaagaacaaaccacactgatattgtactgtactcagttcaatcaatgacttgatgtccttcaatgcataacagcatattacatgtcatcaataaagaaggaaaaatcacagtgattaccaatactagcattgatgcaacaatagcagttttatcaacacagatgactacaggcaaccataccatcaataacaacatcaatggacttctgttcagaggcaagttgatcaatataatctcgtgagtctgtgtcatctagtaccttcccacaacacttgagttccccaataataggcaacaaacctagcaaagcaagataaatgtaagttccaacagaaaagaaaaaggaagttgttcccgaataatatggaactgcaagtaacgtagaaactaagccagcacaactgtctcctgcatcacactaggcatgcatgatttatagacatagctgaagtaatcatggagtaaaacccataaacataactcataaaagttattgaaaaaaggcaatgacacatgattggcattctacattctttcaacaattaagactgtacagtaactacaatgacatggaaacagcttcaaataagttttacaaccctccacctaccacaatttaaattaaaatgaagaaactatgttctatttcactgatgagaacagcaacagcaaaatcaccgaattgcaaatttgatcccatttctaatgataaaaagtagttcacagttattaaatggacacaccatgtaatttactgaaactaaggagacaaacctttggacctcttatcatcaggaatctgaagatagtacacgcatgccacttcaactttaagagactcaatgctaaaggcaccctcacgtgtacatgcatttgcgtccaagtaaaccaaatgttcaccaattttgaacacccagaacttctgcacgttaggatcaatcatatttcaataactggaacagttgtcataatcaatgataatgtgactaaaaccctggataaatcatttgaaacataacttcaatattgagagaaaggaaacatttaggtgaacattaatcctaggttgactacttgactcaaatatgatatgagcattgtatgaagctaactccaaaagaacttgatagaggttttgacatgtggggtccatccaacatggtagaagtgatacacataaagggtggtagcagtatcttttgatggtaggtccacatgtcaacgatctaccagcggttgatttctttgccggtatttgttagtgagcttcagctacacatggtagcttatcctaaggtttatttggtccaaacctctggcccatgtcacaacaaaaaagaaatatgccttcccagaattaatgttagatatcagaacagaaaatgttcagttaacatattcatctcttctaatgtattttagcatcttcgtgaacatttaaagttaacagccaaggaattcataaaggattctctaaaggagtgttttagtaggaacaaaagcaatgggaaagaatagttgatgcctgcttttcatgagcatgg

SEQ ID NO: 67745 - DNA, 631 bp, Oryza sativa
tggtagacatgataccagcatatttaaacacagttttattagtatcatgtttaatcaaaatctcaccacttctagcaccaacacctaacacaacaggaggatgtctagaattatgagcataaggataaaaccaaaaccacggttatgtgtgctaacctttgattgatccaaaatcatgttgaggttctttttaccatcagaaaatcttagcaaagaatttttcaaataagaaatctctttttccaaattagcacaattttcacaatctaccatgacacctttgcctttacgacatttggggcaagaaagcacttcattgtttttcacaacatcttccatgtactcaacacgacctaaagcatcttttagtttcatcttattcaaattacatgttgagcaatccaaaatatcatgaggttgttttaattttttagcagaaatcatgttaaacatcaaactagcatgaaaagctatttgatatttttgcaacaactttttagttaaaaacaactcatccaaagtgcgtgtgtgcaaagcaaaactgcaagcaagagaagatctatttttcaaatcatgtgcagcattaacatctctaatttttgaaatctcattcattaaaacctcacaattt

SEQ ID NO: 67746 - DNA, 1718 bp, Oryza sativa
tgagtcttggcatgtcttgctcacgacagctttgctacgtaattgaccagctaataatcctaaacatggctgagacttttcatccaaacctgcttagaaatgctacgttacttgcccttcaggtcaatatgttaggttagtgagaaccagctcaagtattcggctatttatggtcttcaattttttccttttgatgatttgtagagtcgccaattaccattagcagacgaatggaaatgcagaattttggtggataaactcttcaaatgcaaccgcaaaagaataccttcgcaggataaagctgtaactcatctttgcgatatccaaataatcacagaatgcacagaaactaactaatagaaatgcctaacattgtgcttcagttggtgatcaacaaacatactagtaataattctttggaggaaattgttgatataatccctccaaaaagttctatcttcagaattagcccttgcacccattaatggtacgtgtgtcctaggtatttatattagtgatacatgcaggaataaattctaaagttgcaaccttagtgaggacaatgacgatgttgggtctcgtaagccaaacagatagaacaaaaatagatggtacggtgcagtacgtgcagcaaatccaggagattaagtactgagaaataagtaaatcaggatcgcacgactgattaggtacagtgcagtacacgcgacacattcgggagaaaagtaccgagagataagtagtaatcaggatgatgattagtgtcgagggctacaacacattaaagagagtaataacacatgagtcgagtacaggacaggataataatatcaaaggaggtacaatggtgaggagtggaaatgaattttgaaatcaatgaagaaaagtttatcaactatatatggagaacattgtcttaaaaagattgtcaaagcaaattattagagaatcctctttgccaggctacttatcccttagattgtcatgattagttcattacaacaccggcatcatgacgccaagtctacatggaataggatagtaagtgacaaaaagggaaggaagctcataccagctttgagcagaaaaaccgttgttcagctgtaatcccagtattaccagatgcttgtcttaagcagttaaacatgtactccctccgtccaaaaatataagcatttttagcatagtgataagtcaaacatttccaactttaactattaatagtaaaaaaaataaaaaagatcaatcatctaaaattgatgttattagatttataattaaacaaactatcataatatgtaactttttttatttaaaacatcttatttttataaatattgttgatcaaagtagcatttcggagaccgagttagaatccaaaaatgcttatatttttgggacggatggagtaggaaaatggtagtaaacattatcaggcattgtattaaccataaactgatgtgcgaagaatccatatgaatatattggaaagaatcaggcatcacaaaacaccaaggaaaaatggcaagaaacaagaaactacactggaaaactacaaactgtcacctacttgatgtttttgaaagctatggggacagtaaagaacggcacccatacgaaagaacagaaaagtatgttataatgtgtcccacttgatgcttcctcaaagaagcctctgctcagaagaagtgtactgtattgtgcttcaaagaatagct

SEQ ID NO: 67747 - DNA, 4394 bp, Oryza sativa
cattgatatcactgtgagtagaatcatctacctttttaatgtcaaaaatgttcttgtgaggtaacggttgatgatttgttgtaatattagggtgctgcaggaataaaaggtcatgagtttgacattgtatgcaaataaaaactgaacaattataatctacattctagaaattggatactccaccatgtgttcatccatattgctattggcatgtggggcaggtttggtttaaggcataaattaggcttaccaatatttgtcaattttaatagtgtttagtgtctatttggtttgaaaccaaattttggcatgcctaagaaaataggccatttcaatagtgaacttagactattttggcttcaatccaaatacaactttaccttaccaaaattagtcatgccaaaacttactaaaatttggcattgacaaaatttggtaaggcctatctagaccacaaaccaaaccaacctgtgatttgaaaccgtattcacgaggttttcaggttgactggagataaggggcatgctatctcccgttgtgccccttggagtgcaccacgccatgcagaattgctcgacaattgtgacactataccatgatcaaatattccttgtgtgaagtaaacaaaggttcctgatatacaagaataaattgtactactaatttatttaggatgcacaaaacagtgttttattgataactgcaagcaagcaaccctgatttacttgggtggacatgatgacctttcaagcaaaagggcactctgaaggttgcaggggtatgtggttaaagcatgacgtggtttcattcctagtataggaagtcaattgatccgcagacccacacggcccaacggaaagatgcatgagatgagtgggttgaataaaaaaaggtcagtgtgggacaggatatccataatctaaaattttacatacttgtatgtcctatttctcgagggggatgatgaggtatgacactatgaatttgactgcttagagcatccgcaatagtaaagtaaggtgttatctataaagcatgtacatttcagcaatagactagattaatagtaaaccacttcaatggtatgtctacatggatatctatagctctttaatccattgccttatttttctctatagactatctccaggttagtagatagctttgctctctctctttatttaatctcttcaaagtagaaaaatatgctgacatgaatctcttatagagagcctatagataaccattgcgggtgcccttatgaattgggtttctcttttcttctcaagagttccctttggcttcccacccctccttttctactcccttcaagaacattgtgctatacatcattaactacactgaaattctcagcatcattccctttgctgaatggagaagtccgtagaatctgctgatctgctctacatcatcaatttttcaagctcggttttcaaacatctgtaccgcaccgtccgaaatttcacttttggcagcaattgaatggccttttggcagatcctatcatactgcaaaacgagtagggcagaaacgactacgggccgggcctggccgccatctcactaatgggctgagatggaggccgtaggcttctgatgggctgggcctcagctgccgccacgtgcggcaggcttcaaccaggaggaggtgggggcgagtcgtcgtcaacgacgacgacgaggaccacgcagatggacccgtcgtgcccgccgttcccgcagccggaggcgccaccgctgccgctgcagctgcagctgcagccgggtctgcccaggctggagctgccgacgctggacctggagcgcgtcggcggcgaggaccgggcggcgctggtggcggcctgccgggatctgggcgcgttccgcgtggtgaaccacggcgtccccggcgagctccggcggcggctgctggagctggggaagcagctgctgggtcgcgacaccttcgagctgaagaaggcgcggccgggctacttctggggcacggctgcgctgaagtcgctccgcgtcaaggaggtcaactggctggagggactccatgtcgatctcgtccccggctcgtcgtcgtcgtcgtcgcaggtcggcgatggcgatgatgatgatgatgatggctggatgcggatcagggcgctgatggcggagtacggcgaccacatggcgcgcatcgcccgcaagctgttcaacgccctggccgccgagatgggcctggatcatcaccaggcggcgtcctacctcgccgagcgccagggcttcctccgcttgtaccgctacccgccctgcccttcctccgcctcctgcctcgggatggagccccacaccgacagctccgtgctctccatcatcctcggccaggaccacgtcggcggcctgcaggtgatccgcgacggcgcgtggcgcgacgtcgcccccgcgcccggcgagctcctcgtcaacctgggcgacatgatgacggccatcagcggcggctcgtaccagagcgtgcgccacagggtgctcgcgagccgcccctccacggagagggtgtcgtgctgctacttcgccttcccgcaggaggacgccgtcgtcgaggcccccagcggcatcggcggcggcgtctacaggcccttctcctacagggaattccgcgagcaggtgcaggccgacatcaaggccgtcggcaccaaggtcggcctcagccgcttctatgcgacggctaccaggtagtaacaaggtagaagatgtgctgctgcattgtgtaggatattgtagtacaaggtccatggtaccaattggtatttgcaatgattttctggctaattgcttgtctgaataaaaggagtatacatggcatgataataaattttctagccaacattacatgtaaagataaaagggagaaatgattgaaatcaatactcaatactatattttaagatcatcgcatcattttacattaatcgggaaagcatagcatgtagcattgatggtgagtagtatcatttagcatagtattaggagcctaaaatgtaatatacgattcataattgtttagaatgtatcgtcaaagtcgaatgactgttggtagatgattaaaaggtctccatgtgttgtgggggttaagtggatgtcaaacttaactgacaacatgaccaaacaatgtaacaaatggtaaagcttatatctgacaaagaaacaaactcagagatgtgaaacacaatctcccatggtatgaactgaaagaaaaggccaagcttcagactgcttaaggagagtcagatcaataatagaatgcatcagatgattattgtggggggctacatatattgagttcaccagctgattgtgcagtgcagtggggtgcttcttcagggctacctgactgtcggttcaggattgtatagtaaatcctatattgcactgctattctcaggagtcaaagtaaatttcaaagatcgaatgttaatggaaccacctgctagttacatgtcagaacctaccccagaactatatatggtggaaaccccaaatttggtggaaactagcgtaaaccacaataaaatgtcatctaaataaaaaaaaatctcctatgtagatgaggtgattgtggacagccgtgcaaaaagatctattcgaaatttgactttgcattgctgaaggtacatactcatttaacatccttgaacatgctgataacaccagtgaattcttttgggttgttgctcgtagatgctatcatcatgccttttctttgtggctcctaataacaacggattacggattagtagatcaagtagcagctcaatgcaatataaatcacgtaattggaatcgacttcagcgcctgtggcaaatcctgatcaatttcacacaactcaataaccaacagaaagactacccggacaatgtgacgtgttccaagttcagtttacaacctaatttaagagaaccaataaaatggagggacgaacctgaatcattcaagactaactaggcctaaaattgttggccccagttcccttcctatacatgttccagtcacgtttgatcagaatgggcattcaatgtgcacatggagtcagactcaactatgaacaacttaaactacttaacagttgtaataactcacgtcacccgtctctctctacttttctcattgtattagagtatcatactactgatcttgcatcttcaatacataccggctcgaatcatgatgcctgcagcaacataagtacatagcactgccagcacacgggttcagttccatcgaatggacgcctctggagtctggagagtggagagggagagaaaagccaagctagatccggaattcgggagcacaagtacgcatcggcagcgaagcagatggacaaagttgggcacgtacctagctaat

SEQ ID NO: 67748 - DNA, 5986 bp, Oryza sativa
cctgcagccctgctgatggcgatgtgcattagagcaggtacaatagcaagctaatagtctgcttacctaatattttaacatatatgatagagagagggaaagcagagagagcaaagcggacgacaatctagtcgccggctcaagactaggcgctctggccccctgcagctcgggacaaccaatcgaaaattagaacttgaacatgtagaagttaccaacacctgatagaatgccttggttaaagcatggatgtagccaattgctgtatctaccgttgtttagttatctcttaaataatgtggtgaattttggagccggtagttaactctactattgaacttgctcttaggagatagagagagaagacaccaaaccaaattatctagagagggagagacggggaagaaaggaaagaaggtaatgattcggtaatctcaggaggaaggtatctcttaattaggaagcttgacaggcaataggctggtgctcacaaggtaggtataaaaatctcacctttttctctattcctctccatctcatcacatcccagaacttcctgattcttcaaataatcaaatattattatctaaattcaaataattaattataatttctcttccccctctaacagaaccgtttctgtaaataaccctatttcttcaatgaaaatttacgctaggagcatctccactgtttcctataaaaaagatatgtagttgtaaaatttagaatataaactaaaagtgtaaaaccgattctcgcgaattagctactcctacagtgtacttaccggctacttctcagctctttaaattccttaaaagagagcctcagtatctcacctctcaactaagctttgcacttaacgctgtagtcacacctttatagtactatgcttatattccctactacacaatccaagatttaattctccatcaccagtggagcacaaattccattccgttggcgtctccaaagcggatggatggtgcttgcatcatgcctcctattatttttgtttttggttcccaatggcgaaaggaagaatgagagaggggggggggggggggggggaagccaactttgtctcctcctgtaactgccgaggcataaacgcacaagaggaaggaaaaaaaaacagcatctttcctttactgctttcctaaatgcacactgaaacttcccaaacgaaaacggccggcacctgtggcagcaaaaaagtagctggatgtgtgaagggcgcgatggaccgcccgtcaatgagtgaagggaaaaaattaagaaaaaaaacgcagtactagtagtactgtgcagtgaaggcattggatatttggattagaaagtgacatgtgaggatgcacattcagtgaccttgtataactgtaaggttaaatgcaagtctgtttcattacccaattttgttttggcacgactggtatatggactagagcacgtgtatatatagtagtaaaaataacactgcttcttgcccattttcgccgagaattgagttgttagactttactgaattaggaagcctaacagagtagaataactaattaggactttaggagtagtattagtagtacgatgtacggtcgcaaaacatgaaattataaacgtaaataagttacacttttatatttgtttgagcattaagcatctttttaaatatctaaagtttcataaagataaatttgtttgaaaagcattcaagtaatattctaactttaatttacctgatttttacaaacgtgtttaatgggatagaaattcacaaccgaagtttcagctgcattttttttcaaagattgtgtgccatccaaaaacaacatcttttcaaattgaagggggtgctatttcttttaaagaaaacatttactcggtacctaacattcttaaattctaaccccctgaaataacttttaaattacgaatagtgttcatgctatccattttaaatatcctccgaaaacgaagtagtacatctcatagtacgagttttgaacaagttcggtccccggtccggaagaacagaaaacttcccggattcccgctttctgaacatgttattgctaacttgctatgcctacggagtatggactacggtctcatgacgaagtcaggagcgtctgtgtggaccgtcgtacgcttccggtaccaaagtactccaccgagtagtaaaatcgcatgcactggacatagcccacggcccccaaaagcgaaaagtccaaactccccaaagcagccaaagcaaccgcaagccacggtcacacgtcggcacgccgccggtggccccccccctcctatcctatggaagcatcggatcggaggccgctcggcatacgcgccggtacggggccagtccaagtgtgttgccgccgccaccagcttccctcctcctcggcgtcgcgcatccggcgcattgcatgtgcgcggcttaagcccctttgaatcaaaggatttatatagaaattttataagatttaaatcctacagttaatttttagattgaagctttccaaatcctatgaaattcctatggaatagtacattgcatgtggattttgaagaaaatttagcaagagctctaacctcttgaaaaatttcctttgagtctatctctctcatccgattcctgcgtttttcttgcgctccagtcaaacgaccattcctatattttacctgtgttttgcaatcctctgttttatactttaattcctatcatttttttctattcctccgttttttctatcatatgatttaaaggggccctaaaccggcagttgtacgtacgctgtgcagcagcgcaggcctgcagatctcgttgcccccctcgaggcgcgcggcaattaaaaccggggcgcgcggcgctgttgcttgtggcgcagggaacagcgtgctccaatcaatatgcgcgccccgcgcggacgacgctgccacagtgcaaccacgccgagaccacaccccacccccgcgcggactccgcgcgcctctcaccaactttgcggcgcgcgattcggttgggttttttttttcctatcggaaacgtcgaaacgtgcagggcgcgtacctgcgataccaacacacgagtccctttcgttcggggcgcccacggaatgaaagaaattcggtggccgaacgccccaaacttcccctcccccgccggagcgtgcgcgcacgttgatcggtacggtgaggcaaggttgcccgcaacgcgccatcgttgctacctggtactagtagtaaacaaatacggctacgaaacggaccctttttattggcctacgcaggcttgcagcagcaagccaaaaccagcaacacgtacgcgcacacacaaccatgtgattggcccgtttggggctgggctgttagagcacgcaagatcgatgtgtaggtgcagcttattagcattgttgttggcttattgcacaaaggaaaaccaacaaaccaggttaagttaagcacagaatcagcatgtcgcacggcacgacatgcactgtatggaggagcttcctttctcgcttcgcgctgaccgatggatctgccataatcattgactagtgaacagcggtgacaaatctaatacttggtactcccagactcccagtaagtaggcctgctaatgggttggatgagaatgggtttaatggatcggttttcaatttggattgttttggtatgggtgtaaacggggtgagctacctaatggactggggcggtttggatgatgaatagaggtgggttggattggattggtttttggtttccagttttcggcctgaaatgggtggagtccatggattttcattggattggccccaatggactaccggcggcaagaaggacaggaagggcaaggagtacagaggtgatagccagccgccgccgtcgtcgtcaccggcggcggtgcctacgcctgtctgccaagaagaagcggtggtggagctttcgacggccagcggcggcgacgaccaacacgtcgtcgctctgcttctcaggcgtgcacgctgtcatgcagcagcatgaccagctcgtcgtcatggccgcttcgccggcggcaccggaggcggagaggttgactgccgctggcgtcgccaaggaggagttggttgcggcggtcaggattcaggcggcggaggtgatgcgcgtggcggcgccgcgacggggcgaggggcagcacgtgctgctcggcaccgccggcgaaacccgagctgcaccacaaggtctcgccgatgccgtcgacgttgacggactcaagcgcgcggacgatgagcggccgccggccggctcgatgactactccgccgcggcgtccgaggccagtgggcgccaacaccgcgttgcagcggctgcagttgccgccgccaatggcgaccacgaggcgacgagctgacgacgctgcagcagtggatttggaatggactcgaatggtttgaagaagtggattgaatccacaacggggaaatggtttggtttggtttggtttggattgagctgagaaatgggttgggttggtttggatcatgaaagaaggtaagtggattggggtggtttggactattgaatttcactgttgtggtttgaactggaggcggggcgggtcttgcaccattagcaggcctaccagtaagccgccgcattgctcccgtttttatataggaaaacaaataaatgtacgagtataaacttgcttgattggttcaacacttcaactagtggggcaagtacttatactaagcctgtcttattagctggagtactgaattgtcctttgctccggtttctccatttaagatcttattatatcactaatgatctcagcacctgacgcgccgcatgtgcttgccgatcaggattcaggaatcgttcagaaagagatgggaaaaaaaaacagaggatgatactctatttttgtaagaaagtactccaaagtacaagcagagatccaaaaatttattgaagaaccttcctatttacccagtgattggcagcatccaagcatttgatccaggaatactagttgttttatacctatgagcacaacaaccttgttcgtaattggtaaaccaacaacgtgttaagttagtcagattcccatatgattgtacggacagtgttttactggatttgagcacagaaaagaatacgagttttgtctttggcaacgaagaaaagacagtagtaacattgcgacaagttggatctgcccgattgagccgggaggtttgttcccttctcttgctgcaaaatggaagggtgagcaggcatgtgggccaggccgacctagcaaaactggtgtgacggcccatcgtctatggcccatacggtgcagctgccttttctcctcctcctcctcgtcgtccccaccgccggcgaggggagggtttggagctagaagagatataaatctgagcggcgctgttctgattttgggttgatctcgacatagttgtgttgtttgaatcttcttgttgtttgccatatactgtggtattttctttttttcactttggggcctagatgcggacgccgaaaggcggcgatgagccgatgggctcaaatccgaggcggattttgatattgagttagaactaatcaaacattttttcccccttgtaggtatgagtgatgatctggcctcgcccctctttcgcgacgccttgctcagatcgacggcgacgcataagcctacctcgctggttacacccggccgaaacctcatctggatttgggtaaaattaccttgatctgttcctttattttctcttgagcagtggcattacgttgttgcgtctggctgtctgcgtaatgtcttgacataaatactcttcctgttcttgcatgtctagattatcttcagagctggtatgtagtagtctcagagagagaacatggcatatttgcatgtccaaatctgcaatctgcagtatttttactaggtcttttctcagctttaacagcgacatgtgatctcttaaaatcgt

SEQ ID NO: 67749 - DNA, 14052 bp, Oryza sativa
acagtaagataaaaactgaagtaggccttgtaaaaatttctaatctaatgaggcggtgtttgcagtatgtgtacctaagactttgcaaagaattattgcaggagtagataaatcagatacttgttgcaagaaattgcaaggtttaacctatatacaatatatatgctaatatttatatctggttttcaacagttaactgcatgtactgggagaggaggtttccacgattactgagcattgaccagttacaacaactgatgaagaatggttgccctttggttggtatttctgatataacttgtgacattggaggttccatagaatttgtgaacaagagtacttcaattgagagacctttcttcaggtaatgttctaactttctgctgtgtataatttacagttccgtaacaagttctcacatcatcctaagctgtgttgacgatacctaaatttctgttacaattatgtttggatgttcattatggatgcataacttgtttgtcattctctgatcttttgccggcatcggggtaaataaggggggagaggtgttgtcatggtagaaaagagaaatgactataaggaattttagttcattagaactatgtataatgatgaatgctaaagtgccctaaagaaagatacttgatgggtctctttcttatagttgtaattatctgcttcttttcagtagttgtggcttttgacaaattactgatacacatgtctaggtatgatccttgtactaattcatgccatgatgatatggaaggaaatggtgtgatctgcttagccgttgacattctccctacagaattttccaaagaggtgggctcttttatagaataagtaagggtatctttgttttaagcacaaaccttttccattgactgttgtcctactgaacttctatgctgtaggcctcccaacattttggagacatattatccaaattcgttgctagattggcctcagctaaggaactgttggagcttccttcacacttgagaaaagcttgcattgcgcatgctggcagactcacttctctgtatgagtatattcctcggatgagaaagactataatgtaagtttcaaaatccaagtctatgctctcctccttattgtcaccattgtactgctcttggatattctgtatttgtgtcctgatagtttagaaggacagaatgagctaaatagctaatcttgttaagatgcacatatatttcacataaaaaaggagatatattcgattgctcatgtcttatgcttttacccgtaattagtaaataaagcactgcagatttagttattaagcagaaacttagtggcacggttttcttcttctgctttgttcaaacaaatatagatgtaccaaactgtttgaagtgaacaggcaggggaagctagtaaacagtgctatatgtcaatgaatgtttttatggattatggcagtgatggattaatgagtatctaatgctagagacaaacaatattagcccttattatttttgtgagctcatggtaggctggtagcatatgagttccatcgtttcctgtttttatcattctacctggtgttctgtgatatagcttatcgctaagactatgatgctttaccagcttcaggcatgttttactggtcctaatgttcttctatatgttcatgtgcagagagttgccaccagctccaacaaatctattacctgataagaagtacaacagcctggttagactctagttttctagtattacagtacatttatgatctgtctgactattattggatgtatgcaattagggactaaattgttttttttttctctaaaaacttgttggttcatgaaacaggtgtctctcagtggccacctctttgataagttccttattaatgaagctctggatattattgaaacagccggaggttcttttcacttgattagatgcgatgttgggcaaagcattgatgatatgtcatactcagagcttgaagtaagaacacatgtttctttttgatgcacagttatttagaattaaaatcaatattatatggcgtctatagtttgggaattaattattgctatttttggaacaatctgctactcattgatggcatgtcaaattcagagcttgaagtaagaaatcattttcttttctatgcacacttattcaggataaaaaacaaaattacatggtgtttctagcttgggaaattaattgttcctgttcctaaaattatcaatctcctgctaccactcattaaaaaaaacaaattttgttactgccaagaaagctaaatagtctgagaactgaaacgttatgtcttttcttatggaaccttcttagcagtaatactgtatggtagctcttgatgatcctatatatttggatttacgaatttaaaagttgatataaagaacaaaaggagcaaatgacagaggttggaattacgtgctgggctcctgttccattcccatggtcccacccatctctatctctgctgcaaaaggcagagggagtatgactagtgcaaaagcagtcagatattttttcgaacggtcaggccgttgccgacgttttatattaagaagaagatatcctattgtaaggagaaaacgggaccaaaccttacaatgctcaattaattagggaaaactgggtgaaaaccacaactacaacaccacaccaacagctaacctaacctaagctaccacgacggagcccaacacaaggcatcggtcaagcttgccatagagacgacacgacaacacacatgttatcgttgccgagcttgtcacccaagtgacacagcagcttcgacttcattgtgatactaccccaacgccaaaatgaacaaacaaaagcgacgcccacgaaggacatcagcccaaaataccaagggaccactcctcctcacagctagcatcaacaatcctataaagacattgcaaagtgccatcattgccaagcttcgtcgcaccccaacaacaaagcagctccgactctacctaacaataaccaaataagagtgatgaacacccgccgtggagcaaagagcgaaaccaagtctgtgaaggcctcgtcaaacaccctaggcttgtagagcttcggagacgttgcaggaatccaccaatgactaccattgcacgtaaagggttcttggtgctaggaggggtcaacgccaaaacaacacctccaaggaggggaacggcgcctaaagacgtcgtcgtcgtcatgccggcccatggcctggcaaggctttcgccagcgattcccgaacaaagccccacacaaccatcccgcacaacgaccatcgccggaccaccacgctatctcttcaacgcccaagcacagcccacccgcccccgtagctcaagctgccaagtgagaagacctcggtgaccgcgtgcaccggtctcctcgcgcagcatcgccgcccacagcttcacgccgctggccatggccgcgctccggccaaagcctcgccgaccgccacctcgcagaccaccggccgccgccttgccttggcccgcggcctcgtcctcctccttcccgcccatcccgcacgcgtcgcgaactcacagcctaccggcgacgacggccgacgggagcacgggcagagcaagccggcgccgtcgggctctcagcaaatcagcgcggcgacaacacccgtgctgccgccggttccaggctgcctcgccgtcctctctcgcaccgctagccgcctgctccgcctctaccgccacgtcgcccaccgcgccggccggatccgcgggtgggggggccagatccggccacagaggtgccggatccgctgccccaagccgacccgccgtctccgcctccggccgtgtcatcgtcggccttgccccgtcctcctcgcgcaagggcggttccgccaagctgtttggcctcgccgccgccttcccggctcaccgccggctttgccgccggcgagctctggcggcggcgaggtggaggaagggaagagggtgtggcggcgcgggcagctagggtttcgccccccgagccgcccgcgtgagaggcgacgcgggggatgactacaaacaaatctctgaacctttccatgtcattacactaaaagcagtcagatataaaccctcagatattcttcatgcaattattggagaggttcactagttcatctccgttcccctttctgagtacaccacgctctgcctgctttctactccgactgatcatcaacctggatggacatccatgagtttgtgccttttcctttcatgcttcttctgaactctgttcttttcttcaattttgtgtatgaccttttttcgctctcaaggaagtatgactgttttggaacttgagttttgcagctgtgatgcagtgaacaagttacataaaactcagaatcttgcagccctatatgatgaactttaacaatcctacaatcaatttcaaaaatctttcttcaatgtgtaaatattccagcgggtctctctctctctgttttttttttttggggggggggggcattaatcaatacaggacaaattacaattgttctggattagaccatgccaaaaagttagattcaaaaccacgctagaagccagataatccttaacttctatctctcgtggctaattcatgactaatcccaatttggtcatggcgagttcaaaagccatttaccaacttgttgtagtttgattcttctttatttagaaaaaaaatggaagtcacccacacattacatcattacattatgctatatcaaataatgatgtaaatttaatactaggctaaatctgaaactctataaacccagatcacacaagacaaactgattttgtattatagcattcctgaacttcttttgttgtttgggtacatatccagtaactcatgccactttttttttttgtatttaccatgatattattgttttattattttcttggtaaacatgttactggtcttatcctccttggattgcattaagccaaacattttagtacaactttttttctgagttatatggtgcatgtccttttacaggtaggagcagatgatacagctacattggataagattattgattccttgacttctctagctaatgcacatggagatcctaatgccagaagagaaattgaattatctctaaagataggaaaagtcaatgagtgtggaactgatgacagcatggctaaagaagggtcaaaggttttaattcttggagctggaagagtctgtcgaccagctgctgagtttctggcttcttattcaaacatcttcagcagcagtgcctacgatcatgacattgaccaaattcatgttattgtggcgtccctgtaccaaaaagatgcagaagaggttattctcacagcacagtgcattcctggactaagcctttttatatatatacatattttttagttgcttgcatgagttactatcaacatgttctgtgtacatcaataagcaatggaaatagcagaatgctatcattttggtcaagatttgtaaggtaattttagaaaaatactacattttcttatgtatttttgtctctatatgcagacaattgatggcataagaaatgcaacagctgctcaactcgatgttgcagatattaaaaatctttccaatcttgtttctcaggtaatttcaattctggtattataatgaacatagtggggctgccaaatcacatgggaattaattttgacctgacttcaatcctcttttccattttttttctttctataatgagattttaacttggagttgcttttcaaacaaattacatttgcaactagcaaaatacccgtgcgttgcaatggattttgaaaatatgtttttaaatgtactaacttgccagcgattagagaatttagtgattacctcctcttgcaggttgaagtagtagttagcttgctgcctgccagttttcatgctgccatagcaagagtatgcatagaggtagtcttctatacttccttgtgttcccctggtgtatggatctgtgatgatttatgggaggcctcaaaccaccatcgttgtgatattcagtgattcctgtatgacagatgaagaagcacttggtcactgcaagctatgttgatgagtccatgtcaaagttggaacaatctgcagaaggtgctggtgtaactattctctgtgaaatgggcctggatcctggcataggtactttccttaatatcatggtcaaccatgtacatttgttatggtacatacgttcatcaaattattaggggatgtgatatgactaaacattatcactgcaacgagaaagaatgtaattttatcatagagtaattttgctagtccaaacaagttataatattgcttatggcacgcagatcatatgatgtcaatgaagatgattgacgaagcacattcacggaaggggaaaataaagtcatttacatccttttgtggaggacttccatctccagcttctgcaaacaatccacttgcttataagttcaggtaaactatgatgttcccatattggaaataacaatgccatgttgcatgcaacagattttacaagaaacaatcatggttgctttttcctcttttgtagttggagtccagctggtgccatccgtgcagggagaaaccctgctgtctacaaatttcatggagaaatcatccatgtagatggtaatatttgttaatatttgctaaggaaaaacagatgcatagtttatagtatgttttactgacaaaaacatacttcaccaaaaattgatgtgtacttgatccatgttctttgtgcctaaaaagcgatgtatgacacaggctagcattcgtttttacagcatggaacctaattagcttttaaactgctaaaaaattggtttattcagtgtatctttgtataactatcttagtattttaaaattgcatataaaaataagaaaaggagaatccatattatggaaagaagatacaactgtcatatatcaattggtgaatttacctataacttcaacaggtgataaattgtatgaatccgcaaagaggctcagattaccagaacttccagcttttgcactggaacacttgccaaaccggaattccttgatgtatggagacctgtatgggatctccaaagaagcatctactgtgtacagggctactcttcgttatgaaggcaagtgttgatgtaccgtttcgttttaactgagacattcattttccctggaaatatcatttatacaaataattttgttgcacttgtacaggatttagtgagataatggcaaccttcgcgaaaattgggttttttgatgctgcaagtcatccactgttgcaacaaactactcgccctacatacagggattttcttgttgaactcttcaatgcttgtaacatctccacaaccgccagaaaggaatatagtgaagtctctggaggacaagatggtgaactgatttccagactcttgagttttgggcattgcaaagataaggaaatagctgctaagacagtcaaaacaatcaagttagtttctgaaccctgtgctttctaacattgctcaccacatttaacctcttctagaaactgccatgaagatcacagctgtgtttacatctaatattatgcaataaatctctttgtgcaagtagtattttaggaacatattagaaataagcagtattattgttgaaattctttgttataagtcttccagaaaaaaggaattatttgttatctatactactataaaagacactagtggtgccaccaccactacttttgtactttttgcaaactagtcccttatattttctaatattatataattgtctaatatttgtttcaatcaagtgaatatcatgtattcaaataagcaaacatctctatgacatattattatatattttcttttacccatagcaaagcatggatattttgctggtaatttagaagtgacaatacatcatctcttggctaggttcttgggattatatgaggagacacagattccagagaactgttcaagtgcatttgatgtgatttgccagcgaatggagcagagaatggcttatatccacaatgagcaggtgaggattgatcatatcagcagtcctccttcgatctcatgtattttatataacagtacagaaaatttcatgaaattatcaaagtatactcttttttccacaatacaaaagtgaacttgagagactgagagagctgattttttttttacattgaacgggcaaggtctcagaatatattcactcttttattgtggactttaactaaaagaaacttgaaagagagctgaactttacatacaagtgcatttgttcctttttttattgctcacatggagtattatctctagtagattgctagcccagtgatctatccgaatttctgtttcagattgtgctttaccaccataattcacaagcttcttttccatcaaacttctaaggataaccattactgacacgctaaatgcttttgctttggtgatgtaattcaggatatggtactgctgcaccatgaggtggaggtggaataccctgatggccgaccaaccgaaaagcaccaagcaaccctacttgagtttggaaaggttgaaaatggcaggcctaccactgccatggctctcacggtcggaataccagcagcaataggagctctggtaagtagctctcttgaaccacattacacttgtcatacgcatacctgatcaaagaggaaacttgtactcattatactcgttttcatgtttcagctgttgctccagaacaagatccaaaagaaaggagtgatcaggcctctggaacctgaaatttacattccaggtaagtgcaaatcaaatcagacaccacttgttgcttatggttatcgaacccagcaacggcggtgggttgctgatacgtgcgtttgattttgtgaagcgttggagatcttggagtcatcgggtatcaagctggcggagagagtggagacctgagaatcggacccaatatgtataatgtagcatggtggtagcttctctatatatatgcttcagtgaataattgatttgccgttgtgtggtaattaagcaatgcccgctaataaattgtaccgtagaagtccttctatgtacatccgtatcaaaaaataaaaaaagcatcgattagcttgaataaaaaggtgagctagctcgttggagattaatcaggccgtcgctgttggcagcagaaagtttttagaacttaattacataaagatgatacaattaaaccgagtcactctcggcctctgcataaaatacacacagccagaaaaagaagaaagaaacaactagaacatctcccaagtacaacatctcccaagcacaaaagtttgacagaaacatatatcttagtggctatcaattcatagactagaccgtcacccagtcagaaaaagaagaaagaaacaactagaacatctcctaagcacaacatctcccaggcacaaaagtttgacagaaacatatatcttagtggctatcaatccatagactagaccgccacccatgctcctgggtaaaaaaaacttctgtgccacctggtccaaacatcgagataccaccgtaatagtatcccgcagtcccgattggtggaggatagcccaggtatgtagccaccgggtaactaaggtaataacctgcaaaggagaagacaccatcttgttatcaaaaattactccattcctgctcaaccaaatggaccaacacagagttgttgtacccatcaaaagcagattcatcatttctttggagacacatgatagccaactcccaaacatatgaccaacattgcgaggaggtttcagattagaagccaaatgaattacagaccacaccaagcgagataagcggcactgaaagaataaatgttggatagtttcatccttgtgacagaaacaacatatcttgctgcctttccaatttctcttagcaaggttgtccttggtgagaattacgccccgacgtaaataccaaaggaagattttaacttttaggggtactttcaccttccaaatccgttcttaatattcggaccccggtatgtgttagagctagataatgagatttgactgagaagaccccattcggggtgaggttccattgaaactcatcttgctcctataccagaaccaaatcagctatgcgaggcaataagttatgccaagcagctagttttgcaccaattaaatcccgtcgccatgaaaagcacggaggattggtttggaaaatctgtgcgatagtcgactgtttatgcctaactatgttatagagacaaggatactgttctcttaacgaggcattacccaaccatttgtcttcccagaacctaacttgggagccgtccctaatcttgaaggatccaaaacggataaagtcctatttgacctttataagactagcccaaaaatgtgaatcccccgctttccaataggcttgagataaaggttgtgatcccaaatatttattgcgtggtagttgttgccatattccatcggtggtaagtagtttgtataaccacttactaattaacgctttattctttatctcgaggtcatgaattcctagccccccttgttctttgggacgacaaataatgtcccacttagcaagccggtatttcttcttatgtccatccccttgctaataaaacctagatcgaaggtagtcaagttttttaagtaccccactaggaattgcaaggaatgacatcatatacattaggaaactgctaagtactgagttaatcaaagtaagtcgtcttcccaacgaaagaagttttcctttccagctactcaatttctgctcagaacatgaagtcagtgcttctagctttcgaacagttgtcgggtcttaagatcaattttcataaaagtgaactgtattgttttggtgaagcacttgattatggtgatcaatacaaccagctctttggctgccaggtcggcaacttcccattccgttatctgggcattccgatccattattggcagcagaaagtacgcaattgtgttttgagtgtatgcatgtgacttagatagttgcataaatattttataaaattagataaaaatagattatgatgatataaaaaatacaaatctaaattcgatctacgaataaaactgataacatactggagactgactatcaatggcaggtgaggcaattgatttcattttttttaaccaaataagcaagggatgttggaacaacaagcccggccagatcaacttgcacctatggttgcgagaagacgatgttttcacttgtgttgcccaccaacgcgaggctctcctcaaacaaacccaaagtagagacttcgttattgctgtaatcgtgatattcgccgacggcttcgtcctccggcgagaagataatctccagggtcccgacgctagggtcgaagaccaacacatggcctgtacctgtggcaaacatgatctttttcttcttcttttcttcgttgttgccatcactaaacatatgaatcggggcgatccaataccaccttagacacgaatggtcaggcggcaacacgctcacccattcgatggaacacagcttctcccagcttccagctgcagcttctctcgtcacccatatttcgcacgtaggactctccggctcctcgtccacgagctgcaactttacgtctgtgaaagtatacacacacagacagccatccaactctgtcagctcaaagtcgtcgcgagattgcagctcaggaggaggcttcaacgacgacacgccgaaagattcgtcggtcacgttgaatgtgacgatgtcgccgtctcctcggaggaagtgcaggtcgccgccgttgcagagcgcggctcctcgtcgccaattctctcgcgggtaatgccaatgccgcggcggcggcgtcgtggacgcggcggcgggcggcctccagctgctcgacggcgacggctcgtcgccgtcgagagccaagacctcccagacgacggtcgccggcgagcagcagcggcaacccaccacgcgcaccaccttgtgccgccgcgtggccgagcagtagcccaagccgtaggtcgccggcggcggcgtgttgtccgtgcccgggagacgcaggatgtggcgggtggaagggttccagaggtagtgcgtgtggtggccggtgatcttgaggaggacgaggccatggcaggacttgctggcgagcggaaagatcgtgccatgtggcagatgtctagcggtcatgatctcctctaccgggggcctggggatcagatgctgccactgccattgccaggcgaagaaaggttgtcgaggaccgaacggcggcctgatgaacagccgtggtgggtgtttgttccgctgctttcgctggaggaaatgggcttcctggaacaggtgtgacgaggtgatggtggcgtggaaccgccgcgagacgcatcggaatcggaggagcgatttgacgggcaggtgggagaggatctcgtcgacgatgtcgtcgggcagtggacaagggcaagcccccgagaaacgcttcatcctcttggcgctcctcgtgccatccatgtcttcctccctccttgcctccttggttggttaatgattactcaactcactcctgtttgttttgtttgatcgattctggtgaagtgtacagcagatccaggagatcggtgccctccagttaaatgagtacccaaggagcaaggatgagtccgaatttgaatgggacacgcaacaaaactctagtccgagccggagtcagttcgcacgggcacggtattccttcgattaattggcaatcgccgatcagcgatcactatcagccagctttgccgtttttagggaatatcctccccgtcggttgctcgggagaggtatagatggtcatctgggccgcccggcacggcatggcccaagcctagccgtgcctaggctgaggtttgtcgggctggcacggcccgggccgtgccgtgccagctcacaggcagcatacacagcccaggcacggcccaatactactcgggccatgccaggctggcccgaagacacgaaggcctattgtgcttgctcgtagaaaaagtatatttttggttcctcaactctgcggctgtgtttgaatggctggaaaataagtctattttgtatgcctcttgtcttgggccttgccttatacgattatataagtctattttgcgtccctatatttttttatttgatcgggccgtgctaggccagcccaccatgccgagggtgtagcccagacatggcgtggctgtcaggccaggccggcacgagcacgaccccagtcgggccttgccatgcttgcatcgggccaaaattgcgagcttcgggccaggccgtgggccttgggccatatggccatctatagggggagggagaaaaaatcgagcgctccctccccccacgacgcacgcccccttggccccacccacgtgtccctgcctccacctgccaagtgtctccaccacatactccattgaaacaaatcacccacatattttggaacgggattgctatatgtcattcgaatgaaatttggggaagaaatcttacagattttgaaccattggatccatgccaaggttcgtgcatcggcttctctccttcaactccggcgggctccccttcttctccggcgccggcgacaccccaactctgacgggttagggtttggggttgggatgagggtaggaggggggttgggtgagggggaagagggggctttcctcggggtttagagggatggccgtgggcgacggaggaccgatggtgggcggtggactccggcgggcggcaaggcggcggcggcaccgccgaagccacggggatgaaggagggcggtcggccggcgtcagcggtgggggcaaagcaagcatgagattaggaggcggcggccggtggtggcggatccggcggcggggagccgccggagacggggaagacggcagggcgggggcacctccccgtcgccacctcgaggaaaggagggaaggaggagagggggttgggggaggggg

SEQ ID NO: 67750 - DNA, 29907 bp, Oryza sativa
tgctagaagctcctaaatctgggccatcattaccatgacaaacaggactaccagatttgaatgaacaaatactttcctcagcagggcagggagtgcagacactgtctacttctctggtctcaatgggatgagaggtatgctgcagatgaacactgattatcagtttccagtgttttgtaacagtaagttcttgtcaatatctaatggaacaaatgagaacaattgatgcaatgcaaataatgaatatcttaaattccttccaataacaaagttttaagggattatgtattgtataacctgatttctgtttctgtttgctgtatttgcaattcgctctgttggacacagaaaaaatgtatcgcacaattagaagaaaaatattttgtattccaacggcaactactgaaagtatggtgtactcataagtcaagaggcacacctgaggtagacagactatctgctcgaccagtaagtgttctttttgactgatcaatttcaggagcttcttcagcttcatcatctgatattacaactcgaacacgctttctaccataatggttgctaaatgatttacttacatcttcttcagggctctcatccatgccacatgacccatcaacattctttgtactactatgcatcttagatgctttggtcttagaagacctacttttatgaacaagtgaggcaagaacaacatcatcatcaaattcctcagaactattatttgcaatattcccatcattatcctctgtattgaggatattatcagatacattgccatcttcactttcagtttctgagcaatagtcactaactgtatcccttgcttcatgttgatcagacattctcttcaggttgtctatttcttgctgcagttttctgaagttatagaatatattttagaacaggttttaataagtatattccgtactttatttgtgcagtgtatgtgctcagtggcttacttcgcttcttcaatgttatcaaatctgaccatgtgactgtaatgcatgttttcaagggcatctagttgcacgtttgaaaggccacctttcacagcaattctgaataccattaaaaagcaagtatcagaatccaaaggtggcattaaaacgccccaatggagagatgtatacactcagtagaagtctggaactattatcagatagatcacacgaatgcaggcaaaggacaatattgatatggaattacaagagcaaggtatagagacattgcctgtatgcttcttcataagcttgcaacgcaccagcccagtcaccacaagaatcaagaacattcccaatgttcacttttgctaatgcttgaccctaaaattgcacatatccaaggtgagagagattcaaaaactggaagctccaagtaaatgagtgcaaggaggaaagtagtcttattactaggtagcaactagcaagcatgccacatggcagcatgtccatgaatttaaggacatgtaagctcacctccaagtttccgattgatcgatacatattccagcttttcatgcaccatttacgagctttgctgaagtttctaagcttttggtaagattctcctataaccaaaagagagtcgctctgtttttccttgtcatggagttcatttgctaccctcttttgtcctttcgaaaattccttgagctgtgggaaacaaatagattacatgagaatgagacatgtgttcttctttaatcacacctcagtgccttgtctacgttatcgggggtatgcatattcatattcgacctgatctttttttaattttgattttcatgtgttctataatctcaatcccagaactcaagaagtacatgaagtgaacaattcattttccaaaacctaacaccataaaatacaccaaacagaactctgcatcgtggagttttatctagctctgataatgatggccaatttcaaactgttggtgtgacaggaaagtaaagatcattcattgccaatactgtacaagtgtacataagtaataagttttgcaatgatcattcaatattggttcttgtcatcaacaactctgaccaaataagataatttactaaagcattttcctttcaacaacctggcattaaacatagctaaaaacactacaaaattgagctattgtttctttacatatttccttctcttccatagattctactaatcgtagctggactcacttaggatgctatagttaattaagtttatggttaatctcagttgtccaacaagacacatgggaatcaagatgactattgaaatatttgtaagacttgtaagcaattatgtagagaaaaactcaaccagacagtcatgtgtaattacaacactgtgttgtgttctacaatggaatataaataaataacaactgagcatttcatgttaatactaagtataatgcaaatgcaggcaaaagcctacatgtagtcagcacataatttcatatgggtaaaggagttagtgcaaaacaaattcagcagagttgaagcttcaataatgcaagcactgaatacacatagttattagttaatgcatattaagttctaactccaacaataagcttcagaaaacatcgatacttccatcaggcaaagcaacaagacactattccctgaaccacagaacaatcccccacaataaaagactgaggaagtcaactttacgcattaactaatggaataacgcaatcaggttctttttctaacaaaaacagtaataaaataagatcataaacagaaaatagatccaactttaaagttaatatttgtggctaaagatcacatagttagttacccctcacttacttttggccatgcagttatcatccttgccttctccataagattagccagccaagcatactgctcaaggaggagcttcctctctttagatgttccacgagcattagaagtgtctctggcaagctttttcagcttctgctcgtatatcttcatttcctcaagtactttggctgctttggtaacagtttcaatattctgatggatttggtccattagtgcatcctcatcttccaagcactttgttatttgaagagctttattgtaacaaagctttgcatcttcatacttttgaacacgggaatggacctcccccagatttataaatccctttgcctcgccttgagtatggcgtatttttctacatatctctatgtccttctcaatatggcccttggctctgttccagttgcgtagttcaatataaacattacctagattgtgatggagcctactgcgagcatcgtcatactggtgtacctcttcctcatcacatatcttcagaccctgaacaagtaatttctcagcttcttcataattatccagttccagttcaagcatgcccatattattgtacgcatcaataagctcctttaggaagagagacttctgagacgatggattctcctttagaacccttgctagcttcatggatgatttgaaatatttcttggcattccgaatggcactgtgatcattctcagatcttagaaggatctcatagtaagttctgccaagctgggtgctacctctctgctgctcaacaaggtcatcagcctccttggcaagttgtaagtgcttcttctgtgaagaatcaaaacatcaatgaaaaatagaaatatggattcatgtaatagaaagaacatacatctactttgggttaacaagagaattatgttgagtgttagaaaaatagccaacagacgacatgaaacaggagatcagcacttaataccatgagttgagtgaacaaaatactccaaatgatcagatttgaacaggggtactcgtaagtctataacaggcctgagtacacacaacacatgctaacaattaggcattccccctcacttcacataaaagggtatctgattcacatggttggcacctcaaaggtttacatgcaaatttgatccgactaaaccaaccatatgggtcaaaacccataggcgaacctgagccagattgaataagatcaccaactaaccaaacatgcagacagtgagtgcaagattcacattttttttctcattttggtaataccacacaaataaacagcagaaaaaatatacatctcaacactggccatacccgaatccataacaatataaaatgtatagtccagcaaatgatccaaccatttgtgtacatttctacaagcaaagtccaccttaagtttgacaaagtaaagcataatatcaaagtgttggaaatttggtcataattcggcatattttaatccaaaataacaagataataaacatgatatttacaatgggatttgatccagtgaaagtggtgaatgtaatcaacatgagcatgcttaatgtagaataagcatcaacaatcacataataacacaatgttgacattgcgatgaacattaacagtaaaacttctaattgaaataatgtaagaaggttataccccaagaatggtcctccgctggagtttgaggcagtattgcctccattggtgttgacgggagcctccttctccttgtatccagtgttgccgttgtctccagtgttcgacatattggtgaaggtgaagtagatgttgacgaacagtgagtagtcgcgccttgcgcttcccaaaaacatgatcgcccgcccgtccgtacaaacgtcgcagcagcacgtggtttcggaggcctactctcccaacgcgtgtgcacacactcgtcgggatgggattaccgtagcagcaacagcgttggaaaatggatgaaagtgtgtctcactattcttgcgggagatcaaatccattctcattttataagagaaatggaagatgaagagtaagagtcatggaataggaagaggaatagagcaactaattgtcatcaactagccatgaaccatcctccactacacaaccatcaaccaacaatcaattaggagtaattgatgtaagttaccaatggaataggaagaggaatagagcaactaattgtcatcaactagccatgaaccatcctccactacacaaccatcaaccatccatcaattaggactaattgatataagttaccaattccctaatcaaatggattaattctcaaaactcttcatcccattgatatcccataaaagaatgaatacacatgaattcctagcataatgagccttagaatttatttgatttaattgatttaaatggatcaattacccaattaaatctaacacaaagtatatgcagcttaatctgatattcagctaaacattcaaatacttgactaaaccatttatatacagatgcaacaccaaatggcccaaagcatagtgggcgttgagatgagcaaaattctctgatacagtggcttctacagcataccttagcactaactcacacagaaacaaactataattgcatatacactataaaatgggacaaaccataatgcagattggtactactactagcaaatatttgtttgccggcagaccaaacaactcaatgcggaaattctactacaacttaacctacacctgcctataacgactcaggcatcagaaaacgtgatctgatcatatgcgtgtgatgcgaaatggaaggatcgtcgtaacctggtaggtgagggcctcggaggagttgccgaggcggaggtggacctcgccgagcgactggcaggaggggaggaggtggcgctgggggaggtacttgacagagacctcgtagtcgatccgcagccaccggagcgcctccacgtactccccccgccgcttgtggatgtcgccgatgacgttcgcccaccgcgcctcctcctcccggttcccctccgccaccgcctcccggtacccccgcttcgccgccttcagctcctcctcctcctccttcttccaccgtcccccgccgccgcgccccatcgccgccgctagggctccagctccagctcgattttccccttccttttttctcgtgcggattttggggatttcgagtgggcgcaaaatggaagcgaattctcccgccaaaatattggggaaggcaaggcacaggcacggcaccgcgccgtgttgttgggctgcgtttctgtgtgggcctttggtgaaatgacaacgtgggctccaagctattttgggcatttgcaattttgggcccataagagaagccctctaaataattctatttttcatgaatccatgcgcttcaaccgagcatggaataattctatttttcctccctcatctctagcccttgattgaagcgcatccctcaactgtaaaaacgggtataacatctcccccaacttcaaaaaccagttcaaattaactccttcactggttttggaagcggttttcaccgacgtggcaggttgacttggtctaaatgtattgacgtgacagcctagtcatcaaaagagttaaaaataaaagtggtaccacatgtggggtctacctgtcatcccccttctccttgtattcttccttcaggtttgggggcgacgtagaagatctcttctatgcgtggtgaccggccggcgggggttcttggattcggtctgcacgtacgtgggtggatgactggatgctgccgtggacgtggaggaaggaggtggaagcggcgtgggcggtatgcagggagccgcgtccaatcttctcgacgccggagctcacgcattctaccctgctgtcggtgcaccgttctcattctttgcttctgcaccagctgtactgcccgcagtcgccgtaccaagtcgtgccggtgctgtcgccggtggccttgcctgtgccgccgccgccgcagccggggttactggtatccgcggccgtgatggtggtggacggtccggccagctgcgccgtcgtgctgagcctagttccgcagcacgcgccggaggatgagatcgcccgcgcacgtctacttcttcgatctccgctccgccgagcacgccattacagggtccgtgagcagcagtgccggcttggctagctctacgttgccgccaacatgggactggccccacgacgacaaccgcaggttcgtccttggccaggctgtccgggcccacttcgtcgccgcctccaccatccctgacgacgatggcgcgcgctagccggggatccgccacttgtgcttggggcaggacggggacacgctccaacggcggtaggaggaggagttggggcggccgagaccgatgggggagaagagtgagcgactggccgggcggcgactccccctgcgcgcgccggccgtccactttgcccctcgcgtgctgctgtaaggtgagagaggaggtagaggaaagagagagaggagatgtgaagaagatgataggatggaagaggttattgacaggtggggctgtaagctgattcaatagggatgaaactacctcccaaaccgtggaaggaggcgatttacacgcctcttctcgtgctagcacaactcaacgtctagctaactgcatctaccttatatagacagattgtaacttttttcttcaaacttttaacttttctgtcgcatcgaatttttttacacatgcaaactttcaacttttctgtcacatcgttccaatttcttcatacttctaattttgacgtggaactaaacacagctataggacatgttcggctagcctacctgcagcagttcaaaccggctgcagcgtgcagccaattataattgtcctagcgccttcgaacagccaccataccctgtgttttaaaataaacaatctaatatatgatgtgatatttctagcattatgaatatgcacaaatccttatctagtcctttacatcgtatactaggttggtttattcaatggtggagggagtataagcttagagcatgcccagcagatcatctatctggccatccattatgtgtttggtgtatggaggcgagaaaataatactccagcagagtctccatcagacacaccatttttagatgtcctccaaaccaagcactccacaagtcaattttagcggttttctctcatcacgctatcctccaactactcagctgtgtgggtctacggtaaagaggaggtgtataccggaactcgcggtgaagatcgcgggagtaaaggcgataggcgaaatatttggcagggtcgcagggagattgccaaagtgccgcaccgccctcaacccacaccacttgtggcttctccgttctcactgctggttttctttaggcaaatgatgaggcccgtaacaactagattcatcttgtttttttaaaaaaaataaatgttgtgaatcttaggttctttaaatcacaagattaagaaacaggggaatagaaaaatgataggattttcaaggaatacaagtgcaatacaaataattggaaaacatagaaaaagcacgaaaaattatccttttattagaccacgagaaaaacacataaactggatgagagagatcggtagatttaaaggaaattttccatgagcctggatcacatgttaaaacttctccgaaacttgtgcggatcgagacattccttagaattttttataggattcaataatatctaaacggtgaaaaaaatcctataaaattgtaatcctatttcctatgttttccaaaggaccgtatccaacgccaaaagatcacgtgatacgaaggagataaattacgcacgtctaatatataatgctggggatttggttccttagaaatttaatactgtgatgtcaattactagtggttttatttaaattggatcatttctttatacatgaaattcaagatttgtagggtgtattctaaaaagccacaatatacgcctggatccgctgtagcctgtagtacgatggcaacttaaacagtcacaacatgtctgtttgatatgattttaagtaacagggtcatctgaaacatttttggctaaaaaagttactgtgattttacctagacaagctactactgtagcggaagatctgaacgcttgatgtaaaaatagggccgagtttagttttaaactttttcttcaaactttcaatttttccatcacatcaaaaaatttcatacacacgtagagttctaactttttcatcgtatcgttttaattttatataagaaccagaaccaaataaatgtcctattcttaactgcagcacatctcaatccgtccggacccatccattccccgtcccgttgcctgccgcgcagcgagagacatcccgtcctcgtcggcgccgctcccctcccctcccaccgtctctcctcgcacgtccccctttcctcccgatcgcaccatctctccaccctcccccgctcccgtagtcccgtagctctcttccacggccccctcccgaccgtgccatctcccctaggtggcgctgttggtcgcggttcttgagagttgagacgcacgcgagctgttcgacgttctgcccagatggacgggaaccgtaagcgcaagaccgttgacagcgactagcatggtcctcctgtcaagaaggcctcgacgggcacgcccggtgactcctccttttcccagttcggcggaggtgagtgcccaagaacatccgttgatgacttctcgttgggtgttggtgattcgactttttcttggatttcagttgccgatggacggaacgtcacctggacggcaccgagcacgaccgctgtgccgatggagtctataggacggatggatcgttcggccacccccagtcgcctagacggcaaccgctccgcaggcgcgtccgggcccctgcgcatctgaggtagataacaaaggaaaatccagcgcgccttgttctttcttccaagatcgagtgcacccctgttctttctttcttcttcgtactcctgtgaagcagcttttgttctgagtgtcctactcgccatttacttgtcccggttgcatatgttacaattcaaaaggctatattatctatgtgaaaatggtttgattttgttcctagcaatgttgtattcaaattgtcatgcaaaacatttattactagtttgtagtactactatttgtgagactgccccctctgaatgctgagagtggattaaagtggactttttcctcaatttctatgctctccagtttataaagaatgcctgaggttgcagctaattacctcaggcatctctattgttgttactttatatttggttcattagcacagtgatacaagttgaaccttggatgaattttcatatttgctaactgtgtttttcatttcccatcttaacttgacaagttatccgtgacacacactttgctgcatctttggcttccacttaaaatggcatttagtgtattcttgttgtttgtgcccttttatatgtcctcaatggatgtaactacctatctacatttctactattttccttcaaaaatatttttgctattaatattgttgctctagaaggttttgtttgtgaattgctcctgattagcatgcattgtcagtaagactaattgtgctgtatttgttgtgggattctaaaacattctatatctgtttaatctgcttttgataacatcggcctagcaaatacactatgcattttctattttattttgattaatgaattaatttgtaccctgctttagtcacgcctcatatggacagcatgatagctgaaagccacaactttagaaatctgcttgacttttgccttgtttgcttgaacatgatcatgagcagtctctcaagtaacactcactcttgataatagaagcagatgcctacttaacaatttagaaggcccttttatttttgtatttgtgagactatgccccctctgtatactgcatttgttggtaaatactgtgtaatttgttgcgtccgtgtgcagtggcggagccaaggcccagctaccacgggcaatggcccaggctctgcctggcacatgcagctgtgcatccatagattaacacttaattagcttgctaattacattgcttagttcactgctaggccgtatgaagcaactccacatcaacacatatgcttaacacaaacttataaagcaaatgctcatgttaaaatgatctatgaattatatagacttgtatattcttggtttgtttgttaggtttacccgagctcttaaaattttttgaatctgccactgccatgtggatatttacgtttctgattacctaggtatcttgttctgtctgttctgatagtattttgtatatcttctacattacacctagtggctttgtcagcaatcagcataattgatagtcccatttttctgtgtatataatcgactaacttcagtaatccttctgtttctcactatcacttaagaaccaatgcccctgctgggaaacagcaagcgctctgtgggcgcatccaggcccctgcgcatccaaggtgagtacctaatcgagcgcgcctcttgccctcttcttttttccaagattgaactcccctcttcgtgccattgtgaagttgttcttcttggttctggttggttagcggagagcagcagtgaggaaggccgcgtcgggctggggacacctgcaccatcacaacatccgttgcctggtggcgcactcacccgtcgtgtggatacctccaatctccaggaaccactgcccaccgctgtgtctaagctaccttctcaggacaaaaatggtgagtgttctactcgccatttgcctgaccttggtgcatctgttacaattcagaaggtccttttatttttgtgaaaatgatttgattttgcagttagcaatgttgtattcaaaatgccatgcaaacttgttgctagtagtttgtatttgtgagactacgccccctccgtatgtttcatatgttggtaaatactgtttaatttgtggtgtctgtgtgactatttacgtttctggttacctagggcttttgctacattgaattgatcaatgctcatcactgtcacttgagaacagatggcccaactagttagattataaattattttcactcagttcattcttacctgaaattaacattttgctgcagcttctgttattgtgatagttcccggatggtcttctgatgataataacttctcggaggcagtgaagaaactgttgtttggccgaataggggcagaccactcagttgatcaaaaggtgccaccgccagcagtgagaacagtgattgtacatatctttggtagatatggaccatatctagctcgtcatatggagggattgactgcgcaagcccatcttaggcgtcaagaaatgacatttgaaccaaatatgtgccacagaggtaactgcccgtaacggaactctgtgaaaagactctttattacaaaattgaaggctaatactgtcgctactggtctttctcatttattttcttttggttcaaaatgtttttttttcaggtataatcaaggagagagtggatgaactcttggagccagcgaggccttcctctccgaagtgctgttcttgcgatcggcctgctgactggataacatcatgctgctcgttgatgctatgctcgtattgcatgccggacaagtttcatcagaagcacaagcgaggacatagccgggaactctgccgcgcgcaaggtgccattggcctgctcaatccccggagtccgttggaggaggaaacgaggtacctgatgaaaaatgacatgctctgcaagcgagaaattattctacaggttgaggacgaggagagcgggagaacacgggagtgcgacattttcgtgctcagaagcatgttacctctggctgacctgtggaacaggaagcgcttaaacaggctattcacgtgtggctatcacatgaggtggaatggggtgctcgacgagctcttcagaacggagaacaagctatctttcatgaagtagcgagtagtaatagaggcttacgtttgttctgtatgcgattactagaaccgttgttcagtaactcagatctgttttctggtaccctgccttttggattgctcttcttttattgtctatgcgatgttattcagcttgcgaatcttgttgagacatgtaaccgttgcttaccattgctcatgttttctggtagctgagccttttggattttaaggtccggaagtttgtcttactttgatcgtatcgtttatgtacaaagtttctcatataaaaaaccatatatccaagttttcaaactctaacttcgacaccaaacactgtcaaaccggacgaaattaaaatttgagagaagcatcaaagttccacaacaaaaaatatatgcatgccatgcatatatttttttcccttcttattacttaacactattgcgtttgttacaattaaatcttcacaaaaaaaaatcttacatgattatattacgataaaaatatttatgtttgtaaattacttttaatatatacgtaagttacttttatcatatatataaattacttttagatttgactaaattacttcttatactttcataatgctctaagttgattatttttattattgcttttagtcaattttataatttatggactttaaatttaatttttagatagatcatatttttttccctacaacgaatttacttctaatgttgtaacaacttacttccattttatgctaagttacttttatggtttatgtaaattacttttacaccttattaaactagttaatttgcccctgctaacactaaggtgtcataatcttttctgatggattacatgctagcaaaaataatttacctgttatccatccaattgagctttaattcgatctatgtcgcataataaggcaaagtacaataattatattgcctaaaaatattaattcaagatcgtcaattatctaatcacttcaataccaatatatgagacaatatgcatccacacaaaaaaggtgaggataaataaaatattccaagcaattccaccgcttctcaatcatggtaccgataatacacagtattaacacatattgatatagtatcatgtaactggcaaaatctaaataactaacacactgacaccactacagtacaatgaacacattgagttatggaaacaacagtcatcacttcttccttttttccatatctctcattcagtcaaccatgatcccttttaatttgtagatctttatagacttctattttgttatcctctcctagagtaagatgtgtgcatccttacaagatcagtaaagatcagtgctctcagggtcatttgctttcgtaagacgcaatttatctacacactcttagagtgattgtcaaaataaaacactttagtaaaaaacaattagttctgtaaagaaaaataattgcctagtgccgttcaatgaaaagtcactctagtgctgttttccgttaaaaaaaattagtaccaattctaaatctaatgggtacttaaaaaattttaggtaccacggtagaagatcggttctgctcatggcctgctgcctgcgaaatgtaaggtcttccttttgtggctcacggcgcaggcgctgtacgttgttggatcgtagatgtcctggtcagcgagtgtggagattatgggtacctcatatccacacggcatagctatccgactagtcatagaggatagcttatatctatggaatatgtaaccgatcatgacttgggtattacgtttccttttatattatggagcggcctaaagtcctgatttgataatattataaaatagatttaggaaaccgataccgtattggttaaggtttctatattgtaatcatgccccccatcctatataaggtggggcaggaggccctctagggggcatgacacaaactgatcgtcagatcaatatacacccggcggattcaaatccccaaacaggagtagggtattacctctcatcgagagggcctgaacctgtctaaatcctttgtctccgcatccatccactttcaggtctcgtgcgctacccccttttcatattgccgaaaatttgtttcgacagttggcgcgccaggtaggggttgcgtcgagttacctgtcgacaagtgcgatggaatcaacttcatgagtcaccggcttcatcttcgcttcgggagttttttcgccgaccacttcaacatgctcctgctcttcgactcggatccaatctagccgggaagatcagtctcgacatgttcgatggattcaatttccaccgccgtcaatacctccatggaagacctcagtttaagatcaaataccatatacacatgccctgccgccgtcggaatccgatcattgccaggacgagtcccacgccaattatccgttcggcctaatttcaactcagctgcgattagccagacgcacaactcagctgcgattagccagacgcagaacgacgaaaggcagtcatctatccaatcggaatagtaatcgtgtgcgatttcgccatgtatacaatatacatgcatgtagcggagtccactgacaacagattgatctggaatcataattagcagactttgcagcacgtgtctccaattactgaagcaccagcatatatactatcgttattcccaggcagatttgtttgttttgggagcttggactttgccgccatgcataggcaacgttgtctaatatggagtaattaagattcatgcaactactacttgatttaatcaccggatggtattgatcaatccacctctgtccgagctgtacacgagtgcctgatctaaatgcacagagacacgtcgccaggaggacgagtcggcagagtcaaaccaacgagctgggcagacgtcgcatgctaccacatggatagaccggcgggagtgcgaagctgtttctccgttccctgacctcatcgttgccggcttgcctccgtcatcatcaccgccggcctgcctccgtcgccgccgaccggtgtcctcgcctatacggttggttggtcacaccaccgttcatgggcgtccacgtcttcaccgatcggccgcctcgtccgctgccgactggtgtttccgcctgcacggctggcctattatgccgctgttgttgggcgtctacgtcttcaccgaccggccgcctcgtccgccgccgactggtgtttccgcctgcacggctggcctattatgctgccgctgttgagcatctacgacttcaccgccggcctgcctctgccgccactgactggtgttttcgcctatacggttagcggactccgccgccgttaatgggcttcatcatctacaccactggcttggttccactggcgccgactggtgtttttgtcaccattgatggactgcttcgttcccacatcggctacttttgctgtcaccgagggaatacgacaaagctaagtcgtcatttattttattctttatatgatattttgccttttcctttgcctcactacatcaactggttcgccgttgactagtgagtcgggggctacagatgtgtatcatattttttaaacaattttcataatatttatcttgattgcttgcgacatattctgagtacaaaagtgcctatcgagttatggagttccatcttcctatgcttttcgtttggtttgctaattgatagttgcctttgggctgattcctagcacccgggggcttgttggatggatcgaataacgcaaggtgctaagtattattcggaataaatcaaaagcatagagataagataatttattttctgctcttaataattgcaaaagtacccgagtagtaaactccgacccgtgaaactttgttccattaatgacgaactcatgtcactcatatgcatgtttgggaagtgcttaggctgactcccggtgcatggtggctatgactagtcgggcagagtgtttaaacgtaatgagtcatctgctcggggaaatcaaaattgacaagagaagaaatacatatttataaatattttaaaatacttgaatttttctcgagtattatatttatatcagatactactcatcctatatgtttgttctgcaggatccagatccagatatgcataaaagggattcatggctataagcttatctcttacgctccaggaatggatcagtcagcacatcaccatcggcttgctgtcatcgcctgggtggtcacaccgtttttgttgggcgtctacaccttcaccaaccggccgccttgtccaccgccgactggtgttctcgcttatacggtcaggtggtcacaccgccgttgttgggcatctacgtcttcaccgaccggcttaccttcgccgccgccaactggtgtctccgcttgcacggctggcctactatgccgctgttgttgggcgtctacaccttcaccaaccggccgccttatccgccgccgactggtgtctccgctgcacgactggcctattatgccaccgttgttggacgtctacatcttcaccgaccagccacttcgtatgacgccaattggcgctatcgtcttcacggctggccacgtcgccaccatcgctaataggcgtcatcatcttcaacacaagctgtctacatctgctgccgactggtttcttcacttccatggctgcatgattttgctagtgttgattggccttatcgtcttcaccgtcggtcatctcgtctgcagctgactagtgcactcgcctctacgtctggtttacaccgctaccactattgatggacgtcatcatcttccgtcgccgacttgttaagtcgccgccgactgatatttttatcttcacaactacgcgtcttcgcaaccggtttgcttccgttgccgccgactcgtgttcacttcatcacggctatgcaactttgttaccatggtggagctacttcatcttcattgtcttcggcaccggtttctactcggacatctttaacatgtatcttcactcaagtgatggccacttgacgacaagctacagttctcgactctatgttcagttgtttcccaactaaccaaagagtcgggggctacacaaatacaagactctcaaaattcgacaagctgaagcaatcaattaatcagccaacgagtcaattccaggagtcattatcttcgtctttgctttagagcagagttatcaaccaatcagctcagtttcgacgagttggacaacatcatctactttcctccaagtgaagcatctgcaacagctataacaccaatttgatggattattgtcactgacatcatcaccagcacctctgcttcatcggccctgacatcaactctgttgctaatggatgactatgtcttcgccgacttattatttcactttcacggttgctatcgactggatcaccgacatcgttatcttcatcaacatcctgtcaagcctattcaacatagcccactctactgctattgatgggcaacttcgtcattatatttgattatctatgattgctgcttatcatcattactgtcggttgcgtttgtcatcgctgactattttcttcatcttcatgattggtggatttcgtcatcgcctttgatgcgtgtctacatcttcaccgttggcttgctttcgtcaccaccgaccggtatcctcgccttcatggatggcttattatgtcgccactaatgggcatcttcatcttcttcaccagctgccttgtctgtcatcgactgattatttcactgccatggctacacaactttatcgctgggcgccttcatcttcattgctggctgccctgactgctgccgactggtttctttgccttcacggttgtgcaacttcatcacttttgattggtatcactatcttcactaccaccaatattttttccacctctggtgagcaatattctctctatattggtcatcttgtctctatgccaattgcgtcagctaccatcaatggacaattgtgactacgacagaaggacaagctatatgctcaggggcttactagctcaaacacaagtatcataccttcaatttggacttgtttcggatacattcaacatggatttatagtcatgagtttattttctatgctcaaagactggaccaattactattccccgtaaggactatcaactgaatacttgcgccagtcgggatttaattattatatctattttggagtatcccataagggataatcactcagatcagaagctattcatatgagctacacttggtctacattacctagaagacttattacttgggagcatgttacatgtgtcatcctttaaagggtgtcgaagtcatattttttggcctaggcctaatatgtctgcagcccatattttgaggtgtggccagtcacgttcttttagggacttaggcactttttgcttaggccaaagtgcgtgtgatctagtgcccaataccttaaagtccttttataccgcagttactcaactttttaggagttggtacaatgcatcttaaaaggtgtcaaacagtaaagctttatatagctgccccgctgacttttttatatagtcatggcactgtttgggtttatcaagcaattgattggatacaacataattgctttttgccacgtaagtgtgcatttttattgaccaatattatggcttaggctgattatatattttggtcattttccagatgattgataaatccttatgagtttatttactcggattttataccacatatgccatatatttccaggtgtggtgaaaccatgtgtcttttagggactcaagcacatctgttaaagcagtgtgcgcatggtgtatgcccaatactttggaaatttatttattcacaacatacaagcttctttatagctgttttgctatgtgtattcaatgatgtagtcagctttagattgcacgcatcatattttacaaagcagtcggtatatcactcggatcatgttattcaaggattcacaccgcatatgctatatattaatattaagtcacttggttgactacaattatcaaaaccactcagttggtgcctctattaggtacatctattcgatgcacctgactttatttttcagccctccacaatcttcatatttggtaaaagtactcgggggatcatggcaaagatgattgaagcactcggttttggagtaatctagttcgaaagaagattatctttccgactgtgaaggtctccggggctactgtggagattatgggtaccccatacccacacggcatggctatccgactagtcatagaggatagcttatatctatggaatatgtaaccgatcatgacttgggtattacgtttccttttatattatggagcggcctaaagtcttgatttgataatattgtaaaatagatttaggaaaccgataccgtattggttaaggtttctatcttgtaatcctgctcccatcctatataaggtggggcaggaggccctctagggggcatgacacaaactgatcgtcagatcaatatacacccggcggattcaaatccccaaacaggagtagggtattacctctcatcgagagggtctgaacctgtctaaatcctttgtctccgcatccatccactttcaggtctcgtacgctaccccttttcatattgccgaaaatttgtttcgacagcgaggaatcaagtcatcaactgccttacctcctgtcctttctatgcgcaagaattggagacggtaaaccatatcctcggtaagtttggtttcaattgctgtccatggcggggaggctggaaattgcaccccaaccatggctgcttgatccaagatggtgggcttaattgaggatgcggttgacgaaacgtcatcgtacgtcggaatctcgactcgcagatcttgcgtttcttcgactatgtcttcggtttcctccgtcatcatcctcatccgattggaagggcgccagtggttgctcgatagtgtggttcatttgggggagtagtagctttcggctgttgtttttgcattcattttggggagtagtagctttttaactaggatttgcaatctcttcctttcgacttactccctttgtcatataaaaaattaaattctaggtatgaatacagacatccctaggatttgagtttttttcacagagagagtagccagtaattcctagttcgtttttcttctatcctgttcaccctggttgcgatggctgcccggatgtcgtgtcgtgtaaaactttcatttgctccttgtaatatgatgtgtaattttttttgtgtaattttttgtgtatttctttgtgcattgtggaaaaacttaatccatcaatgaccgccatgcaactcctaagaatgtcatgattggagggagaatggattctagttccttgagaggatgttcgaacccataaccaggcggatggaggggataactattcttagttacagcagaggaaaaaaaccttgtgtagaatttttctcttaaattcaatgcaaatgactttcaaaaatctagaaaaaacgggaattgttttgatccctcactgagacattcccttgtttgtttaaaaatcaatcaaaatagttagaactcggccttagtcaccgacatgcaactatccttttgcagttgatttctctacatacacacagagaggggaattcattccgcggtgcggagctcaaggtcaagtcgcggagaccgttcaagtagctgaactagtaagagcaagttctattgtagaaatttatggtgcaaggccaagttatagatgtgtgataaaaaaaatagtactcactctttttcatattataagttgtgtttgatattttttccctagtcaaacatttttaggtttgactaaatttataaaaatatatattaatatttttaacacaaaacaaacatattatcaaaatatatttaatgttagatttaatgaaactaatttgatattttaaatgttgctaaatttttctataaacttggtcaaacttaacaaagttttattaaaaaaagtcaaacgacttatagtataaaacggagggattagaattttaatacttgtatagatcgaatttgagtctacataagtgttatatattgatctatcgtgatgaattctttcaaaaacattttaagtgacatgaaaaaaatgagggccgtcccataagggatgattattagacttttccctaatccaggggacaatcagcaacctgattatactggcgagagcaaggtgaaacaaaacaacacatcccagacactctcctatccaatcagcagagttcaagtgttcaactcactaaccaaaacaaagtgtcagggtactccacaatcctcaccaccattattattgatgctatggcaacagaacagaaacaaccttcagatgaaaagatgataaccagcagcctgcagactcatgcagacgagttcacaccctgaattcgctggaatcaattatctcaggaacgcagtcaagtcaacaaaaaatcagcgtgatttttgcaaggaagcatgaaaatcgtttaactcaggaacgcagtcatgccaacaaaaaatcaatcatctcaggaacgcagtcaagtcaacaaaaaatcaatgatcgatgcaagaaagcatgaaaatcgtttacccgcacaattgtagtatcacgggagtaaccaagtcggagaggagtgggcagacgatgcgcgctgctccgagaaacagcgatgaacgtgcccgtcgcaccacctcccgttgtcgctgcagggataacggcgatgtccctcatcgcggaagggcatgccctcatcggcgtaaacgtagtcatccaggaagtagacaccctccttgagtcccagcccaagctcaggataggcagatgattcatacgatctggagcagccacgcccgacgaagaatagacgcccatccagcgactccagttcggtccaggtgtcctcaattttctccacgccggtgtagtcctgcaccatctcctgaaccatctcgaacaccttgaataggcttgtgggagaacgtggccgagctgcaaatctcacaatcatcagaagcttggcccgggactccacgagatagcgcgcatggacatgttcgcgcaagcgctcccggtgccggatgcgctgaacagactctgtagtgccttggaggccaccatctgcgtagaacatggggatacaggtgacgaggaatcccctcctcgtcacgaaccggaaggcgccatcctgatagatgacatcctgtatctcatctctgagtctgactgttgagtcgggcgccattgttccttcgacggcaacacgatctcccatacgccagaaggcgagacggcacgagccggcgatgagatcccagcgcatgacgatgcccgcgccaatgcagctcgtgccgcctggggaagaggagagtgctgctgccagtataaccatgttctgtgcgcgctggtagtcgtcctcgtcctgatacgagcggagcaggtcggggaaaggaatcaagctgctcttggaatcctcgcgtgaccggaggttgatcatggcgtgaagtcgattgtgctcgaaggcgacgaacagccaccctccctcatgcgagccgaagcagcgcgccccgtgcgcggggctgaggcggtggtgaagactgcagcggtcgatcccgcagtagaagcagtagacgtggatgaaatcatcgccggcggatgggaggagtaaccaagggagagggcgcggcggcgagggaggcggcgtgggctcggcgagtgcgccgcgccatgtcctgcagacgtcggccgcagcatcgcggtccgcgacacatcgcaaatggcggaagatctcccgcagcaaatcagccggcaaatccgccatagtaggcgcaggcgagggctccatctccatgggagccgggaggggtaggggtggaggagagggtttggaggattcggcggttggtggatggaagggaagggaaggggaggggagctgtggccaagcgacgctgtactagtaggagtacttatgttcgttgcccctgcctggcgttcttctgcttctagaagcaaagtgaggctgggcctgggcctgggcctggaagggcagaggcgttcttctgcttttagaaagcgaaactgctgttcggcgaccggtcgcgcgcgcgcgcgactggacacgtgtcgcatgcggagaggggcgccggacggcgcgccgcgcgggaggagctccgtgttttccgtttttttttcttttcggtttctcttttttttctgtttttctttcgtattttttcggtttcgtttttctttttttctttttttctttccgtatttttttcgtttttaatacgtatgtatgcaaactttgtatacgtaaaaatataaactttgtatacgcatatataaagtttgtatacacgtatgcaaactttgtgtacgcatatataagggttgtatatgtgtatgcaaactttgtatacgtgtactttttgggtttttatatgtacgtatacaattttgtatatatgtatacaaagtttatatacacatatataaagtttgtgtacatatgtttttttaggtttttatacatacgtatacaaattttgtatacacgtatataaagtttgtatgcatatatataaagtttatatacacgtttttttaggttttttaatgtatatatatattttttatagtagtagtactaatagtagtaatagtagactagtagtagtaatatattaaatagtagtagtaaaaggtactagcatcagtcgcgcgtggccccaggcacgcgattagtcgtgcattaggcgccccctttagaaaggggatagtagtatctatagatttgtcctgctaaaagcagagctcagattttttttaaagatattatttgtgtacgacattttcggaaataatgctccgaatcatggtattacactacgagccctattctaaaatataagtatttttaagatggtcacatatattaaaaagtagatagagataatttgagaaatgttataattggttgagatgaaaaggtaggtaaaaaaaaggaaaaatggttgagaggaggagataggtagagaaatagttttattttaaaataagatgtattagaaataactaaattctgaaactcagcatttggttcccaacatttggtaccgaactcagcctaagcactgaatcagctccactaaaaaagaaaagcgaggaacaaaatgggctttcctgctctcaagaaactaacaaaatttctagtgagtccaagaatattgtaagtcatgcaggatttgctaggactaggatgcatgcatatgctactccatcaatcggaaccaggcaagggtgttcgtggagtcaccttcaattcttcatctccaccgttccacccgaccacaaccgtcgtggaaatctttgcacattgttgtcgttgacacattaaccgtcaaaaggaaccctacttataaaatttaatagaacttgtacaagatgacatggtcgccacaaagatgcacaattccgagaagaaacaacaacaatctttgcagacagccagagacaatctcatgggccatagtaaatgggagcaacaacggtttagttatacaccatgtattttggagtcgcgctgaacttctgataccctttgatgaccttgtttacagcatcaaggaagtccttctcagtcactgttttccgtcgggcgcgaatcgcatacatgccagcttctgtgcagacactccttatatcagctcctgtaacagcaaacaggagtttgtgagaacaaagcttagcattatccgcttttgaggtggagactataacaaacaaatctagaagaaaccacccagaacgaagtttcaaagttcttccagttaccagttgagttggggcagaggcgagccagcagctcgaaacggatatcgcgctcacagttcatggtgcgtgtatgtatcttgaatatttgggtacggccctccaggtcaggtaagccaaattctaccttcctgtccaaacgaccaggacgtagaagtgcaggatctaaggtatcaggcctgacaaaacaagaaaatgtggtcagcttctcagctctactcatgtggcgatagtcctgaacacatgcagatgtttaaagataaatagctacacagtatgatatgcaatacctgtttgtggccatcagaaccttgatgtttcccctcgcatcaaacccatcgagttggttcacaatttccaacatggtacgctgaacctcattatcacccccaaccccatcatcgaagcgagcacctccaatagcatcaacctcatcaaagaagacaatgcatgctttcttcgagcgggccatctaaaccaagtcaacattttttttttcagaaacatgcttgtcaaacagaagcactttaagtgcagaaaattgataagttcttgtgagttttcacaatgttgcacatacctgaaataattcccggaccatccgtgccccttcaccaacatatttttgaactaactcactgccaattacacggataaaacaagcatctgtacgattggccactgctctagcaagaagtgttttgccagttccaggagggccatagcaaaggaccccctttggaggatcaataccaagcttgacaaacttctctgggtgaagcatgggaagctcaacaacctatgaacaaacaataattagcaaacagtaaatagcaaaataagtccaaaactaactagcctgatgcacaaggatgagcaagtttgcacgacaagggatatgaactgaaaaaagattagtatacctcccgcattttttcaatctgttccttgcaaccacccacatcattatatgtcacatcaggtttttcctcaactgtcatcatggtaacacttgggtcaattttgggtggcaaaggaatttgaatctggtacttgttccgatcaacactgcattaaacgtgagatgaatttatacagtgagtacagtggttcaacagacctagaacaatgacatacaaactatatatgatatagaaggcatatgacttgtccagaaaaaagcatgcatgcatcagatgcttttttcttcttagcttaatcagctttgctatctctaaagcttacatgttacagttcatcttctgtcgcaggaatggacaaatggtgctactagtactattggtaaacgcaaaggaacagaaaattagtgaagtatatctaccaaactttgtatatgttataccctggattcaaataagcaatattctcttctatgtcaaacatgtaaggtttgttgaactataatctactcttgtttccatgacaccatatatgctgtcaatgaattaacaccattgcattgaggaagtgtgcatactattgggttaatatattagagcttgttttggtctaacgcaaaaatgcatcaaaaaaaggtggaaacagcagatcgaattgcatgagatagaattcagggagaataatatgatacatcaaagaccaaaaaaacagcagtgacctaccccactctcatcccttcctcaatgtcagttggagaaactttatcccctaggccaaccacaaactgaatgatacaaaatacagtatgagaaagggatcaacacattttttttcatgaaagatatggtttcaataaaattggataagcatggaatacctttgcaatttgttttacattaatcacatatttagcatcatcagtattaggacttataatcttggtacacctagccaccttcaaaaggaggaaaatatcttgtcagtaaaatcacagaagacataaaactaaagcaggaaatctaagtccttaggcatcatgcatgaagtatgctaggcacaaaactattaaaacaaggaagaaggtaggcggggaaataggttaagcgatatacttgcagcggttgctcttcttgcatcatctgcttatctgatactagatcccattggctgggtggtgccagcccagtgtcagactccttaatccctgggatttaatgaaagagtatatcagtcagatagaccaattaacatgtgctaaactcctagcatctaaacaagctgacaaactgaacaatgatgtgaaaggtaagagggtgtttgaacatgagacaaggttgctatacagtgcacattacgacgtcaaagttctagtacaagaacaaatttggaggtatatcgcacattatataagcccacatagagcaccagaattgtactcttgtcatcaatgaacaaagagtgatcaatatgatataaaacattcctacagtggggaatggccaaacccactaaacaatcaaaatgtgctatagcaaataggaaagcatcagtgtgttcgataaaatttatctcactatgctatcacatgaaagtacacagctgaactaaaagaaaattacttagcaaattgagctacatctccagttccaaccaagaattagacgaaaaattcttaactcaccacaaaggtcattgatcttcttagccatttcttttatttctttctccaccttcttaatgcttgtggagtatggcccaagcccctgcgcaacaacaaccagacagccagaatcagcaaacttcattaatagaaaccacgcagcaccaaacaaagtattaatcctctccactaaaaccgagcttttcacggcgaagaagaagaagaaaacgagagaaacaaacatttcgccttccgcgagaaacccaaaccatccgctgaacaacatcagcctcaaccgccgacaaaagaggcacacacacaaatcgaaaccctagaactacccccaaccacaagctaaccccagcccgaggcccgagcccaccatgggaccagatcaccagaaagcacccctagatgggaagagatcagggagatctagcggggggacactcacgtaggtcttgaggagagcgatgtcgtcctcgtcgagcgggcgggggttcttctcgttcatgatgtcgtcttccggctccggcgccatggctccccgccgcttccgccgctgctgccgctgcgcgtcttctccggcggcggcgagaggcgcttcaggtggagtcgtggagagaaggtgggggtgcgaatgcgagagaagagagaagctcgcgtggatgcggggagtttattttctcctccttttttttctttttatttggccttttttttctttcctcctccgcaaggatccctctccgccgcccgatgctgatcggacggtgtaaatctttctaggcctgtctagagttggtctgtgtccttggctcgttgcggcaatgggcttttttttttcgtcttggagggctgagcttaggatttatttagtttggttttcgtgttcgattccgaaacgaactgatcaaagcttaggtcttctttggaaccaagtcggaatttgaattaaacatgtggaaatacagtaaaattcgtgcgttttcgaaaaggcctctgcatgatttcggggaatactgctactgggtactcctgggaggagaatagaacttaggaaaagaatagtgtacgtaaacatgatattgcacaaaagctcccaggtttcaaattcttcaaatttgatacaatccagacaatgaaagcaacaaggattccaggacaagacgattatgggatcaaactaagctaatcttttcattgcattatagtgtcagacagctacaaagagaagcaatcttcgactcttcgtcaggttattgtccggaccatctgactggagccggtgcactgacgaaatggacctgcaagttctgggcatgccctgaaaagaaaatggcaggtgttgctcaacatgaacagaccacgataactatacagcagtggacataaggaagtaaggaaccttgtatgaggataatgctgaacatgatttgcttacatgggaaccataatcaggttgccgcaccacagcatcggagaagaaggcaaacgccaaacatcggagaagaattagccatgccgtttccgcgagatgagtcaactgataaatggagtactgaatctgactgtaacagaagaattttcaatgtcagttcactcaaacaattcaatacactcaaaaatcacaat

SEQ ID NO: 67751 - DNA, 1557 bp, Oryza sativa
cacagcttatgagctctgtgcatctgatatgaaaatatatgtcaacatagtaggataatgatattatctaataatcatgagcgtgttggtggatgttcttcaggttatgacagatccagacgtgccagggcctagtgatccgtacctgagggagcacctccactggtaaatatatatcattattttacaagtaattaatccccgctgaggccatagatggctcctattgttaaaacatgaataaacctcatgagtatcaaatatccatgaaaaaatataaaccagaagtgatctgcagatacatggctaaattagctaggtcattgatgctactccttccggtaaaaaaacattatgttttggacatttacacagccttgttaatttgtattacaaaacattgaaaaacaatatgaactcataattttatagaagtacctttttaggacaatctacacacaattaatataattttcatgcatccaatataaatattttaaaaattatatatggatgtccagactcaatttaaagtttgacatgaaacatatctaattaagacaacatattttcatgaccggaggaagtacagtgtagataataattaacttcttacctagcgaaacaccctccggtagacaaccactgcaagttcctacctgaaccaacacaaatggccatcactaatataatatatgctcagctactcataaaatagcgctcaatctgataaagtatgcgctttagtttaacataattaatatattgaccctggcaggatcgtcactgatattcctggcaccactgatgcttcctttggtaagtccttttcacagatatatatatatatacgtacaccttgctttagcttttacaagtttaataattaaaacgagagctctgatgagcccatggctgtgcacaatacacgcatgatgcatgctgattattggcttgtgatcatctttaatttctctgaacaaacttacacgaataacctatatatatatatacatgcatgtatgtatgcgcagggagggaggtggtgagctacgagagcccgaagcccaacattggcatccacaggttcgtcctcgtgctgttcaagcagaagcgccgtcaggcggtgaccccgccatcctccagggactacttcagcacccgccgcttcgccgccgacaacgacctcggcctccccgtcgccgccgtctacttcaacgcgcagcgagagacggccgctcgccgccgctaattaaccaaactgccaaaaaccaaattaagcccctcttgcaggcatgcaatatgcctcctgcaatattaattgcagatgcagctagccttccaaactatatattgcaactaattaagaatggactactacatatataatctagggatcgatcgagctagatcacctagtggcatatatatatcagccactattagcttagccatgtatgaaccaaataagaactcggtgcagcaagcgcgagccactgtttagttcgtcagtgtagttaattggtatatatgcctatatatccgtgtatgccagag

SEQ ID NO: 67752 - DNA, 8186 bp, Oryza sativa
agagagtatatttatgaagagtgccatttatagattgatttattcggttggtatggtttgtttgcacatatgtggattaatttagctttgaatatttgtaaagtagtatatttgatttcataatatatactaagatttttagaaatttctaaggttgtttggatagcatgcaaatgatatggatatttgaactattgagataagtgtaagtgcttattattttacatgtaagaatatatagttggatccataccactacaaatataacattttagataaataccactactattcacaatatcggctatgtaccactggaatttggggaaattggaccagtgccactctatcacgttttcctaaaaaaaatctctgttatccccaactgcatgtgggacctaactgtcagttccgtcttcacctccctcccctctgttctctctccccaccaccatcgttgacaaccaccgttgcagccgccatcatcgaccacctccgcggcaggagaggcctcgagagccactaccgttgctactgtcgtcttcaaccccatccgtggtgggaggactcgggacccgccaccaccatcctcgatgccaaccacggcaggaggctcgggagtcacaatcctcaacccaatctgtgcgggagggctcggaagctattgccgccgtcatcatcgtcgttgtcctcatagcagtagcggggatggagaaagagatgggggaagaaagaagagggaggatgggggaagatggacctcatatgtgggtcccaaatctaggggtctgacggaaaacgtgatggaatggcactgttcttgtttcttcaaattttaatggcacatagccaatatcgaaacagtagtggcatttatctaaaatggcatatttgtagtggcatgatccatttaaccctaataaatatatgggtttaaacattgatttaattgtaaagctagactacaaccattcaaactaagtatagccaaggaaaaatagggccaagtgccctagctagattactaattaaatattttctatcatcaatcagaccatcaactgatcaacctgcttagggcctctaaatataggcttaggcttactagtttcgatttttaagttatatttttagcttatacactagtggatttagagttataagtttaacggtagagtcatacatatttcttacatcagccaaaattttattttccaacctagttttttgatttaatagtataaagagtggcttatggctttaaaagagcaaaaaaaaattgcttgcttgtttaagagtggcttgtttttctcttctaattcgaagatcttttatggatttttggtgtgcatatgtatgcatatagatcatccacaactgtgtggctatctagctagcataaaaatctatgcatgattgcttggacagagttgggcacgtacgggaggcaggcatgcagcagtatgtacggactcatacatacaggggtgaatacgtacgggaggcagggtttaagggattttttttttaagattgctccgatggttgataataataggcccgccaatttaaatgaaaatcaatggttagatttttttaattgccacgtggcagcttgagagcgttttgaggagtgccatgtagcgtcttgagagcgtttctagaaagtttaatggacttttagtatataataatagataatagatagataaggtaataaagtaaacaagtcttaagcccttggaaacggtgacggtaaaagctagggctctcgtgctggcaacttggcaagaactccttatttgtagcatgaaaatgctgtccttagagtgacaagcagagaagtgcacacctataaagagtgacaagcagagaagatatggggtctatggggagagtagactccactctagcaccaattaagccatatatctacgcaacccaacaaacacccctagctgatggcaaggatgagggagaagaaccacattgtcatgcctagccgaccttgtggtaactccactatggtcccgacgtcagtagctcttgagcatcccctatgcccacagctacagttgacgatggcaaagggcagtgtaggggcaagctgttggtgagatcagtcgtgatcaacactaacgaccataaggatgatcaaagaacgaccaaacatgactcgagagctaattctaggaagagaagtataagcaatgatggaaggaagaagagaacagcaacattaatgaactaaagtggaacatacttcccttcggttatgaatatttgacacttaggacgggactcagttaaacttaatttataaattttgataatcaaagtaagtttataaaatccaatagatttttgatattttaagacagatctacattttttttattttataaactaagcatttaagaatttgtgtaaggctttaagaagggcagatgcataaaccactaatcatatttgatggccaaaaatatataagatttgaaggtggattttcattcgaatgttgaataattagcaatcctgattttctaatgtactaactttaaaagtggtatgtatcaaatatcaaatatttacccccggttcgtgtgtgaatagctttcatgcaaatttcctccccaattctatgctcaccatccatgccggcaccatagttaatgcacactgttacatggatctcattgtgtgatgccttgctatactccctataatagtatacttaagtgaaattcacttaatgcacattcatagtggtgtttccgtacatgctagtatttgattgatctaaccattacatgagatcatctcgattacaattaattattttttcactatgcatgagcaatcatttcattattgccagattgtgcggaaaagattttctaataaaggcgtattctaaacagctaatcctatctttctatatagttgcactactggagaatgcatctttgatgggttgagcaaaaacacaatagtcccggttccaataagaaccgagactaaaaatactctttagtcctggtttaaaagtgcaagggggactttatgatctttagtcccgattggtgttatcaactgggactaaagatcatttttagtctcggttcaaaaagttgtcaggcccccactacctttagtctcggttgtttataccaaccaggacaaaatacctatctttagtcccggttgtatataccaaccgggacaaaataccggagctgcacatctcgatcccatcgtccttatctcctccctcacacacgccgatactagtactcctccactccacctcctaactcctcctcctcccctcccctcctcccttcccctctcgatccgttcggctgaggcggcggcggtggcggcgggcagcgagtgctagcagcgcacaaagggggaggcggcgggcggcaggcggcagcgggcaggaggcggcgagcggcgataatgctctcccctcagccggatcctgcggaggagaggaggaaggtagcggcacacgaagggggaggcggcaggcggtgggcagcggcgggcgggaggcgaccgaagctggaggcggtgggcggtggcaggcggcagcgggtgggaggcggccgaagggaggcgggaagcggcggcggtgccctcccctccgccggatccggcggaggagaggaggcaggcggtagcacacaaagggagaggcggcgggcggcggcggcgccctcccctctgccggatccggtgggaggggcgacgacaggcggcgggcatcggcggcgggcggcggtccccagcagtgaagaatttttgtgaatttgtttagattttttttgtgaatttatggtgtcaataatctgtggatttgtgatgtatctgtgaatttgtgatgtcaattatacgtgaatttgtgatgtcaatgttcgatctttgtgatgttgatctttgttatgttggtgagtttggcgtgaaatcaatattcaaagaacaatgaaaaaaaagagaaaaatagggactataaagggtagtgccggccacgtgatgggcattcccgaattcgtggtcccggccggttgcataaccgggattacacggggttacgaactgtgggtgaagaccctttctccagcagtgttggtacccaccaaggggcatttactcttataaagcaagacatgcaagaaaccacatcatcaacaattttaagtcattagatcatattagtacaaagataataaccgttggatcaagaagctacttattcatccaattcaatcatttattaattatccattcacctctctttactccacctcacaatcacacatagcactgttacatattttgtgcataacaccatgttttccgaatacaactcaaattattgtttaatatgtgtcttttgttttattgtgcatgataagataacatataactatttggtatcgttacctgaatctattttcagaaaagaaattaaacttgagtgaaatagagagatgcaaattgtcttactataacaatacccatattgcgcatgaaaataatattcatatattataacaatacgcaattactcttggaaaaataaagcatgaattatatttcaataacataagacatatataaatctacattatcatatattttgtataaacatagagttgcacctaaccatttaaaactttgacaataaaactataaaacccatggcaaagacgtggggagccaactagtgggtgcatggattattcgtaccatgctttttgaagtgtaatattttctaagatatctttttctaatatatttgttagtttatgatattcaattcatccatatgagttatttttctctatcaatattatctattcaatcatgcagttagaaacacgtctttagtcatgtagctacctatatgcagccccttcgaatatgtcctgagattatttgtaccaaagtaatcaggtccggagaagtaaccgacaataaagtaaacattcctcgatcgtaaggagaaaaacttttcttcaagcacccaagttggtaatgtccccgtttgcatagttgccagggagatggagaccaaaggagctactacctctgtcttatagcaagtttagttttagttattatgcatctagatgcatatttaaaattttttattatatttgatgatggatggagtagtgatttccagcgggtgatcgatcgagaaattaaagtggtaaagggccggggcctcgctgcctaaattttacatcactaataactatcctgtcggttttcggcagatgatacagtagtacagtacagcactatgatgcttgttaagagtagctactagctaagcagctagccaccacactgtgctcacgacggtgcggcaccaagaaagccagtgacgtcccgacacactggagagtagcgtacgtagagtgcggcgagtgtgtggccgatctccgcgcgatcgacgcgaaccgcctcattcttcaatgccccaaccacattttgcgcctcagttactccactccctctgccctccccaccaccatataacgcctcgccaatgcttctccaaatctccaaccaacccacaaacgatccatccatcactcgatcgtaacaactttgtagtcacgcgccatgcagccgacgtggctcgccacgatgccggcagcgtcgtcgctggtcgtcggcgtcgcgttcacggccgccgtggccgtggccgtggccgccgccgtggcgaggcgcgcctggaggcacaggggcctccggttgccgcccgggccgccgggttggcccgtcgtcggcaacctcctgcaggtggtgttcgccgggaagccgttcatccactacatccgtgacctgcggcgggagtacgggcccatcgtgaagctgcagatgggggtgcgcacgctggtcgtcatcagcagcgccgagctcgtgcacgaggcgctcgtcgagaagggccgggagttcgcgaccaggccggcggagagccccatccggagcatcttctccagcggcaagttcaccgtcaactcggcggtgtacgggcccgagtggaggtcgctgcggcggaacatggtgtccgggatgctgagcgccgcgcggctcagggagttccgccccgcgaggctgcgcgccatggagcggttcgtggcgcgggtgcgcgccgaggccgcggcgtcgcgcgacggggcgtccgtgtgggtgctccgcaacgtgcggttcgccatgttctgcgtcctcctcgacatgacgttcggcctgctcgacctcgacgaggagctcgtcgtgcgcgtcgacgccgtcatgaagcgcgtggtgctcgccgtggcggcgcgcatcgacgactacctcccgttcctccgccccttcctgtggcggcagcaccgccaggcggtcgcgctccgccgcgagcagatcgacacggtgctcccgctcatcaaccggcgccgcgccatcgtccgcggcatgcgggccggctcgccgcccgaccccgccgtcgcggcgccgtactcgtacctcgactccctgctcgacctccgcgtcgagggccgcgacgccgtgcccaccgacgaggagctggtcacgctctgcgcggagatgatcaacggcgggaccgacaccacggccaccgccatcgagtgggccatggcgcgcgtcatggacaacccgtccatccaggccaggctccacggcgagatcatgcagcgcgtcggcgacgcccggccggtggacgacagggacaccgaaggcatgccgtacctgaaggccttcgtgaaggagctcctccgcaagcacccgccgacgtacttcgcgctgagccacgccgccgtggagcccgggagcaagctcgccggctacgacgtccccgtcgacgcgaacctggacatcttcctcccgaccatctccgaggaccccaagctgtgggagcggccgacggagttcgacccggacaggttcctcgccggcggcgagacggcggacatcaccgggtcggcgggcgtccggatgatcccgttcagcgccgggcggcggatctgccccggggtgggcatgggcacggcgcacatcgcgctcatggtggcgcggatggtgcaggcgttcgagtggcgcgcccacccgtcgcagccgccgctcgacttcgaggacaaggtggagttcaccgtggtgatgaagcggccgctgctcgccatggtcacacctcggaagctctccttctgacgcgtgcatgcatgcacgcacatacaacgtggcagagcacgtaagacactgagccgtggggcctagctcgctctcctgatggattgtctattaggtcagcacgtgagatataatactactactcgtagctacaaattattggaagtttgctatttcgagtcattgttttaagtgaggtatttcccggtggaaggcttatacttacgtacgcagttatactttccctaatagcgagtacttataatgtataagtaacacttctgctcaagattaatgcacatgttcttagtatatatgcatattattattagaaaaagtaggaattaccccttgaaccataaaaccggacatttttcacccctaaatatatataccggacaaattacccccctcgaaccaattcagagcggttttgtccaatgtggcacacacgtggcaatccagtcagcgtttttttaataaaaaattatgggacccacctgccatactcttctcccccctctctctattctctctctctctcgctcttttctctctcgccgctcacgtagcgcgcacgcgaggacggtcggcgagggctgttggcgacggaggaggcagtggcggcggcgaggcgaggcggcggcggaggcagcgagcgccgggaggcgagcggcgacagagtaggcgagcgccggcggggtgcggcggaggaggcagcggcggcagtgaggcaaggcggcggcggaggcagtgagcacggggaggcgagcggcggcgggagctcgcgctgctcgagacgaggcgaggcggcggcggaggaggaggcgagcggcggcggggtgcggcggaggaggcagcggcgaaggaggaggcgagcgccggcggggtgcggcggaggaggcagcggcggcggcgaggcgaggcggcggcggaggcagcgagcgcggagatgggaccaatcgcggggctgcagg

SEQ ID NO: 67753 - DNA, 1660 bp, Oryza sativa
ctcgcgccgcgcgccgtcgccatctcccctcgagccccgcccgcgctgcgcgccgtcgtccgtcgcccgtcgccgccgttgccttgagccccgtccacgcgccgtcaccccgcaccgcctcgcctcctccgccgccgcgctcgcctcctagtccccgcgccctgccacctagtccccgcgcgccgccggacaccgcgcgcccacgacgaggaggaggagcccgcggtggcggcggtgtcccaccacgcggaggaggagcccgccgcccgctgcgcgtccccccgcgcccggtcggcctccacctccgtcgccactctcctccgccgcaccccgccgccgctcgcctccccacgctcggtgcctccgctgccgcctcgcctcgccgccgctgcctcctccgtcgccgaccgccctcgccgaccgtcctcgtgtgcgcgctgcgtgagtggtgagagagaaaagagcaagagagagagacatagtagagagaggggggagaagagtatggcaggtgggtcccacaattttttattaaaaaaacgctgacgggattgccacgtgtgtgccacgttggacaaaaccgctctgaattggttcgaggggggtaatttgtctggtttacatagttgggggtaaagaatatccggttttgtggttcaggggggtaattcggacgatcgcgatagttcgggatgtaattcgtactttttccttattattatgtctatcacatgaatttttagtggaaagtattacattattgtattgtgcaaacatttttcatggcaaagatctagcggtttcgtttaagatacatgacaaattaaaatatttgtaattatgcgcggaccctgaaaggtactccatccgttcttcccaaagacccaaacactatttcaattgtgaccactaaaagaattttaaattgctagactataatgagcaacagcataatgctgatgtttaagatgcaacacacttcaaaataaagcatcttgatactctctccgttttttaatattatgttgttgacagaaaacattagaccgcttaaaatctaataagtcataggctcatagcccgcgaattcttaatgtcatttgacaaaatccatcccttcaaatcttgcgaattctaaaccattagatcgctttaggattcgtgcgctgaacctaaccctaatttcttcttccctctcccctcaatcatgtcgctaccaccacttcgctcccctcccttgggcacgcgctccaccccctcctgcgtcgccaccgccgcccggctcaccggctggcctgaaggcgtcaatggcgctggcgagagatccctggcctcctccccctccccccttccgccctctctccttcctcctcgagccatcgacggcgagatacccccaccaccaacgccggtgccaccactctccttcatcccccatggctccggcgcctcgccacttgcccgttccaccacccaacaccgtgccgccgcttcccatgactatctctctaagcccggcgacctcctccttcttgccccctccccttcccattcctcccaccctcaccccacctagagagacgctaattcgtcagtcctctggtggagtttgggttgttgcaggcaccggagaagaaaaaaaggtcattggagttggaga

SEQ ID NO: 67754 - DNA, 3691 bp, Oryza sativa
tgggatcatatcaaatatatgaaaacttatctcaatgagagagatagaggtatatatctatatatatgagaaagcaataagatgtgatgtcttttttgtcttcattggttatctactgctctctgcattttcatattttaagtcattttgattattttctagttaaactttttaagtttgatcaagtttatagaaaaacttttaagtcaaactgtggatggtgccctccgtgagatgaccctactgtagttttcagaaagaagaaaaagaaaagaccctaccgcatatatcgaccagtttctcgatcgatcccctcataatgaacctccaaatgcagcgttgctttaaaacttgtcggcatagaatacacccaaatataatgctatcgttgtcaacaaatgtagtattaattaggcaatgattgtacaagaagcacagcgcgctaaaaatattattttaacagtgaaatgttttcgaggattattttagagttttgacaatgacacggtcaccaaaatatattcttaactttatcttattataatatatacaataaataaataaataaatgcatgtttactttctttatattactttgaaagacagatgtagatatgctgttttgttcctttaaattaaattttgtatcacaaaggaaaaaagtataacaatcatctcataggtagtgtcatgtcttattttgtatcacagaggaaaaaagtataacaatcgtctcataagtagtgtcatgtctgtagaaacgtgatactccatttccatttccatttatgtaagccatttttctgaccattttatcatttagcctccaccagctagctcggagattcccttctaccttagcatatttcgttgcctcaccaaaaacagtgagccaaaataagcatgttcctcattagatttgcaactctggacccacaatcttgtgtcccatgcctctccaggtagggagggagaggaccggagagaggccagcgacggtgatggccacgtagtgaccaggctggcgccggcgacggggacgtagcgacgcgggggaggaggggaggggagaagcgccgccgtcgtttgggaggatgagaggccgccagcagtgaggaagataggagggggagagggaggcgactgagagggagaggagcacgaggtcgatgccgcaccgctgaggtcaatccggagccaaaaagctcgatccgtagcttggcggcaccgtcgttcgcggctttcggccccgacaaggtggagccccactcagcgccgcttgtgtcgtgcgctgctgttccgcctgtcgccatcgcttgggccgagccaccgctgctctgcttgtcgccgctcccaaccatgacctcaaccgctccactacgtcgagccgcttcaatccgctacatcaccccatccaccctattttgcaccggcggtggccggaggaggaggaggaggggaggcgtggcggatgaaggaagagggggaggcgtggcggaggagaagagaaggggatggcaggtggaggagaagagatggggatggagaggtagaggagctcgaggtcgaggccaatgttgatttggaaccggcgagctcaattcgcagccggcgccgatgccgctcgggccgcccagtgccatcgccgctcgggctaccctagcgcttcgctttttcttgcctcggcttcttttgccagtaaggactgggggaaggaagaaaggagagagaggggggtgatgaaaagtgaaagagattggtattggtgagacccactacaagcaagttgcattgtggagtatgtagcttaacatgttcttggtctgtggcatgtgaagaacgacaaatatcagggacggattgctattgccttaatggcctttacaatgtggtagctgtcatcagccgatctcttcatgtcagcgattcggtgtgaatctttaccatgttcgtaggtaggcccaccaaattaaagcccgcgtgatcttctttggtcacctgttcttggcgtgggtagagaaggctacggatgtgttgggaggatgtggtttcgttccgctttttctatatgcaccgtggatcttgtggcttccaggtcaatcttggtagcgtcttggaccaaggctacgcgtggcccgcattgtaaagtccctaattgcagaagcacttatgattatacaagcatcacaattatttgtttcaaacaaaccatacatattaaccttctcatttcagactaaatcttgtacagttaacttaccagcaacacctacaaattaagtactacaagtaatagtcacctagctaatactaatatatgtacggacgtaacagtagtctggcagcgcacgacgagccaaaaccggatctcgtctgaggcttgcctcttcaccagctagcagcgttggcacgtacacaaactattccacatagagcgtgtttgcgtgtatagttcacgtcaaaatttaaagtttggttaaaattagaacaatgtaacagaaaagttagaagtttatgtgtagaaaagttttcatgtaatggaaaagttgaaaatttaaataaaaagttcagaactaaactcgccaggacattcaaccgatatttaggttagcccttcttcactctaaggctaatctaagcccttatttagttcctaactttttcttagaacttttaactttttcatcacatcaaaatttttctacacgcataaacttttaactttttttaaactttcaattttagtcaaactatcaattttagcgtggaactaaacacaccctaacctgctgttttggtagtgtacggaagactaattctctgcaccgtactgtaattacgcaagtccgtaaagtgcatgatcgcacattaagtactgtggttacgcggttaagcaaagaagaacacgtagcagaatgcaatcagccgtcgccctgtttttctttgcttagtactgatgcataatttccgagttttcaaatagtgcgtatttttctgaaaattcggaaacaattctgtatactccggatccctctggtttttaatatatggtaccgttaacttttgctatatgctttggttattcgttctacttaaaaaattttatagaaatcttaaaaatataaatattgcttaaaagttccttgagtaataaatcaagctacaacaaaatgacatacttaaatttttaagagtaattttcacaaaactacattattttgcacaatttattacaaaactacagatttagtgtctctgtttatcacaaaattacagatttaagaacttgtttcataaaactatagattcagtgtattcgtttatcacagaactacacatttagtctttatttatcacaaaactacagatttagtgtctccattaattatcacaaaactacaggttttaacaatgctaaaacctatggttttatgataatgaaggcacttaacatgtacttatttatcattttgtgacaaatgaaaatattaaatctaaagttttgtgaaataagttcttaaatctgtagttttgtgatatattgtgtaaagtacatgtagttttgtgataaacgaagaaatatgtactttcatgaaacaagttcttaaatatttagttttgtgatatatcgtgcaaagtatctgtagtttttatgaaatttacttattttttaataagaaaagaaccaaac

SEQ ID NO: 67755 - DNA, 11146 bp, Oryza sativa
atttttccagatagggaacccagaacaagggggcgggtggctcatactttgtagctccttcatacacagatctcccaaaacacaggagtagggtattacgcttctcagcggcccgaacctgtatacatcgcccgtgtcttgtgtgtttcctgtctcgtgaaccttccacatacagagagcttagaatctcaccctgagtccccggccgaaccggcaaaggggggcctacgcggtctcccggtgaggagccccacgctccgtcatctggcgcgccaggtaggggactctgcgagggattttctgagctctcgcactctttcgtgtgcgccaagcttttcctgttcagcccaatggccgagccggcaaaggtgcacgacctctccccgagtatgagcggtgacgacggggagccaaacccacgtcgtcgagctcgtactccaccgccccctccacgccaaagtcctaggtgggagaaggcgctcgagagggccgaaggatccgcgacttcgacgcccacaggaggtggagaagggcggcgagatggggagcgtcgcctcctcgtctacggcgacggcagcacgccccagggcgcgctccaagctgcgggcgcgctcctacctcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcgtcgtcaagacggagggcgcggcgagcggcagccgctgttcgccattcggccgccactccttcgtcaacgcctccgacccgggaagatctgcgtggggaaccggatgcccgcatcagtatcgagcgccggcgtaatggccgacgtgctccccacgcaacggagggcgcctcctcgtccggagtgtcacctcaccaaggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgtagggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcgattctgtcaagtccgcaacaccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccgattccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccagtagggagcgcccaaccggcaagtggtgcatcgtccacaacacctcccttcacgacctcgcggactgccgcgcagtcaaaagtttggctgagcggacgaggaagtaggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggagcgtgtcctcattgatgggggagtggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcatggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcgtccaagcccgagggtggcgacgagaggcttggcgcctccgcccccgccaccccgaggcagcggatgatcacaggcgacgaggtcccggtcaaggaggttgccctgggcgacggcccgtccaagaccacacggatcggtggtcttttggacggcaaataggaagacgcgctcgtctccttcctacgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcttccatccggagtggctggcgaacccggtggtcgttcccaaggcaaacggcaagcttcggatgtgcatcgactacaccgaccttaacaaggcatgtcctaaggatccttaccccctgcctcgcatagatcagattgtcgactccactgcggggtgtgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaactttactctcagatctagcggaaacttttgagagtctccgctccgcccgcataaaactaaaccccgataagtgtgtgttcggtgtacctgcgggcaagcttctcgggttcttggtctctgcccgaggcattgaggccaatcccgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccaaaaatgccctcactcagttgaaggcatgtctaagctctcccccagttctggtcgccccggagccagacgagcccttgttactctacttagcggcgaccccgcaagtagttagtgcggcattggttgtggagcgcgatgaggacaattctcatttcacgcctccccaccctgtgccgacttggcccgggagagagcagggaggagaggctcccgagccgaacggtggcccagggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggcctaaggcccctgacgaccggagttggccctttgcccgcttgtccgacgacgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctaatggcctcgaggaaactgcgccattatttccaggcgcatcgggtcacagtagttacgtcttaccccctcggtcaaatcttgcataatcaagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggagatccgccgcctcctggtgttaggcgactcccagctggtcgttaaccaagtctgtaaggagtaccggtgctctgacccgcagatggacgcctacgtgcgccaagtacggcgtatggagcgccattttgacgggattaagcttcggcatgtgcccagacaggataacatgattgccgacgaactctcacggctcgcgtcctcgcgagcccagaccccaccgggcgcctttgaagaaaggcttgcccagccgtcggcgcgacccgaccccttaggggagacggatgcgcctgatcggcccccgaggcccgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccgtttgctgtctggggactcgatatcctgggaccgtttaggcgggccccaggtgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttggcagcagtgctctgggcaaaccgaactgcaccaagccgagcaaccggggaaacgcctttcttcctcgtctacggcgcggaagcggttctcccatccgagctcactctgaggtctcctcgggctaccatgtattgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgatgacctcgtcctacgccacgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaggtttcgggctcgggccaaccccgcaccccctcgggcgtgtagggttggccgggggctgccacacatgcacattgttatttcttttttttttcagtacttcaataaaagcagtttcaatttcctaaaggctgtatctgtgctgttttttccttttgaaaaatcttgacttgaaataggtcactcgtgctcaatcctgccctcggaggctcgggtcggctaaaatcgtcaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgtcgtcactgtcgtctgcaccaccggcattgccctcctcgtcggagttgggggcgaacgcgagccgaggggccgagccctcgaagctgtcgacgatatggtcggcggcatcccggacctgcgcgcgtgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcatactttacggtccgccctctccagaggcccacttgccgaccggcgcgatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcaagctcagcggcccgttggttcagtacggccctctcggcgcgggcaccttccagattgcggcgcgcctgctcctcctgcgctgcctcgcggagggacaggctgaccgccagctgttgcgccgcggcctcggccccctcgagagctcgctcccgctcagtgagcgcgtcctcgcggaggcggagcgtgaactcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcacgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgtcggcggtgagccttacggcccacctccaccatggcctccaccgagcgtcgcccctcttcgacacgcgcccatgcggcgtcgagctccgcccgctctgcctgcaggacctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgccgatggaagtgccggactcggggatgtcccccggacccgtttggtcctgagcgtcgcccgagggagtgggcccaagcgacgcgcccgcagcctcgtcgccagctgccccggaagttgtcgcctgagcgtcacccgagggagtgggcccaagcgacgcgcccgcggcctcgtcacgagctgcctcggaagtcgccatcgcctcgtcctggcgaaatccggcctcctcccgagcggcttccccggcctggcaggcccgggcggcctcctcccgagcggtttcctcggcctggcgagcccgggcggcctcttgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaaaccagaagacgaacaaggtgggtgagtgaaaactcgcgttgagagaatgaatacagccacgatgggtgagagatgaacctgcgaggaggtcggttaaacgaccactttggaggggaaatgaggtttccccgagatggttctgtctcccccatcttacggggccgcttcttcttgcgctccccctcgggctgcgatgttggcgcggccccctccgggcgcctgctgctggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcccgcgccgtcgtggccctttggagctcgctcctctgaggccccaaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtccttgtgaagtcttcggacccggtgtactcccaggcgtcccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatgcgggaaggcggcagcacgctaccatcaagcagagcggagccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtcaagattcgtgtgctactcaagtaatgtggcagtcttgaagagactgctcattgttgacagccgaattaccattgccgatgtgcgtggtttgtgaccgttgggtttctgcccaattgtggagaccggtcccacctgtcaccaggccttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggcacccccgagggacgtcgggcccgagggtgatgtgttcgccctcctcttagtccccccgagggggtcgggccacacccgcctcggccccgagggccgaggcaccccgacccctcgtgggtttttgctccgcgtgtatgggttagg

SEQ ID NO: 67756 - DNA, 12275 bp, Oryza sativa
cctgcagccccacgctggttccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgcttacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgtcagggcgatcgccctcctcgagggaagcggtcgggcgtgacgccactttctaaggcctggtgacaggtgggccggtctaaaaatcgggacaagccggttcgtttttcctggagatatgatgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcgaaatagtgggcgcgagaaacgaggagccgggcacagcgttggcaagggtataaagtcgccgaggaagagatttgcttccttcctctcgctattattccccttgtcttcgccgcttgcgccctaactccttgtttcctgtgccctaccttcgccacacgtgctcgctctcaaacatctcttcttccggcgtcatggcacggggctccgctccgcttgacggtagcgtgctgccgtcttcccgcatcgtgagcgagagacaggccgggctgccacgccgcttcatgccggaatctgccaccggccgggagatagtctcgctgggcgagggatgcccggcgccacgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtgattcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgctcggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcatgatggcggtcggggcctcagaggagcgagctcctaagggccatgacggtgcgagcgggagccgcaagggagatcaatctaccccaggagggggttgtgcttccgggccccgtgatgggggctcggggggcagccgccctgccgacgcctgagggaagaggaagcaagagggtacttcctccccatctcttccccgagggggcggggcggcgcgtgtcagcagcaggcgcccggagggggccgcgccgacgccgcagcccgagggggagcggaagaagaaacggctccgcaagatgggggggacagaaccatcccggggaaacctcatttcccctccaaggtggtcgtttaaccgaccccctcgcaggttcgtcccacgcccattgtggctgtattcattcttccaacacaagttttcattcacccaccttgtttgtcttctggcttttcttctgcttcagcgagatcccgtcgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcggcgacgacttccgaggcagctcgcgacgaggccgcgggcgcatcgcttgggcccactccctcgggcgacgctcaggacaagccaggtccgggggacatccctgagtccggcacgtccatcggcgggccgagccgcgcggcatcctcaccgaggcggctctcccccacgccttccgctgccccactgagcgcagagcctcttctgcaggccttggccgtcgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccgtcacgtctcagagctcgaagcccgtcggaagatgctgggggagatcgccagggaggtggaggaggagaggggggctgccctcatcgccactaccgtgatgaacgaggcgcaggacgacctccgccttcaatacgggagctgggaggcggagctagggaggaagctcgacgccgcccggggggtccttgacgctgccgctgcccgagaacggcgggcggcggagaccgaggtggtatcccggcggcgcgaagaagcccttgaggcccgtgccatggcgctggaagagcgtgcctgcgccgtggagagggacctggcggatcgcgaggccgccgttgccatccgggaggcaacgctgactgcgcacgaggccgcctgtgccgaagaggagtccgcgctccgcctccgcgaggacgcgctcaccgagcgggagcgagctctcgaggaggccgaggccgcggcgcaacggctggcggacggcctgtccctccgtgaggcagcgtgggaggagcaggcgcgccgtaatctggaaggtgcccgcgccgagagggccgcgctgaaccagcgggccgctgagctcgaggcgcgggagaaggagctggacgcgagggcgcgcagtggcggggcggccgcgggcgaaagcgacttaaccgcccgcctcacagctgccgaacacactatcgccgatctgcagggcgcgctagactcgtccgccggggaggtcgaggccctccgcttggcaggcgaggtagggcccggcatgcttcgggacgccgtctcccgtctagaccgcgccggccggcaggcgggcctctagggcgggcggactgcgaagtatgccgccaaccaggggggcctcgcccagcgcctctcagagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggacggtgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcactacgccccgaggcacggctcggttctgggccccgtttggcgattttagccgacccgagcccccgagggcaggattgaacacgagtgacctatttcaagtcaagatccttcaaaaggaaacaacagcacagatacagcctttaggaaatcaaaaatgcttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccatggccagccgaacggagcccggccgggggacgccgatcactcgatacggaccctcccacattggtgagagcttgctcaatccagcacgcgtttggacacggtgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggggaccttagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcatttgcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggatgtgatgcccttaatgaatttaagtgcggagtgcttatcgatcttgacgaccggataagcctcgggccacttagtgaacttgtcgatcgcaacatacagatactcaaacccgcccggggcccgcctaaacggtcctaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaagactttaccaaccaaggtgcgcgaggcggagtgggctccgcattcgccttcatggatatcagcaagaagctcgacgccttgttcccgaggaatgcacttcaggaggattccgttagtcgcgcgccgatagagggtcccttctatcagcacgtagcgtttggagatgcgctggacgcgttcacttccttcgtggtcctcgggtagagtcttatctgtgaggtatgcttggatctcaacgatccaagcaatcaatctaagggagctgggagcgctcccctcgggtcccgaggcctggactccgacgggcctcgggggccggtcaggcgcgtccgtctcccctaaggggtcaggtcgcgccgacggctaggtaagcctttcttcaaaggcgcccggtggggtctgggctcgcgaggaagcgagccgtgagagttcgtcggcaatcgtgttatcccgtctgggcacgtgccgaagctctatcccgtcgaaatggcgctctatacgccgtacttggcgtacgtaagcatcgggtcagagcaccggtattccttacagacctggttaacaactagctgggagtcgcctaacaccaggaggcggcggatccccagtccagctgccaccctgagtcccgcaaggagtccctcgtactctgccatattattggtcgcccgaaagtcaaggcgaaccaggtatctgaggacgtctccgctcggcgaggtcaatgtgacccccgcaccggcgccctgaagagacagggagccgtcgaactgcatcacccagtgggcggtgtgaggcagctgcgaggggcccgagctggcctcggggactgagacgggctcgggagccggggtccactctgccacaaaatcggcgagatcctggctcttgatagcgtgacgtggttcaaagtgcaaatcgaactcagaaagttcaattgcccatttcaccacccgtcctgtaccctctcgattatgcaagatttgggcgagggggtaagacgtaaccactgtgacccgatgcacctggaaataatggtgcagtttcctcgaagccatcagaatagcgtaaagcatcttctgggcctgagggtatcgggtcttggcgtcccggaggacctcactaacaaagtagacgggccgctgcacctttcggtggggccgatcctcttcgctaggggccacatccctggggcgctctttgtccaagcggcctcgcggggcgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggcccccgggccatcctgggggtcgggggcacctggcaccgtctgacaagcgggcagagggcctgctccgattgtcgggggccttgggccaccgttcggcttgggggcctctcctccctgctctctcccgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagtgtttgaggagcttaaataagggtagcgccttctctcccagcctcgatatgaaccgacttagggcggccatgcaaccggtgacgcattgcacatccctaagcttgctgggggggcgcatccgttctatagctcgtatcttctcggggttggcctcaatgcctcgggcagagaccaagaacccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcatataacaataagttcctatgggggtaatgaatgcagttttttcctcatcctccctagccatgcgaatctgatggtaaccagagtatgcatctagaaaacacaaaaggttgcaccccgctgtggagtcgacaatctgatctatgcgaggcagggggtaagggtccttaggacatgccttgttaaggtcggtgtagtcgatgcacatccgaagcttgccgttcgcgttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccgctgcctcggggcggcgggggcggaggtgccaagcctctcgtcgcctccctcgggcttggatgcggcggtgaggtggtccgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgtgttgtagggcagactgaggtccgccacatcaaagttcacccgctccgtgcggaagttggcggatccaccgaaggtgaccgggaggtcgatatgacctagcggccaagtgtgacccggcgtcacaccgataatcggctgggacggccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctccgcctcctctcctcctcctacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggcctcccctttcgggtggcccgcgaagcgccctcgacggcgaggaaatgaccctcgtcgtcggaatgggctgacctcttcttcctcctcctgtcacgccgccatgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccagacgaggaggcgccctccgttgcgtgggtagcacgtcggccattacgccggcgctcgatactgatgcgggcatccggccccccacgcagatcttcccgggtcggaggcgctgacgaaggagtggcggccgaatggcgaacagcggccgccgctcgccgcgccctccgtcttgacgacgtggagccggtggtagcagtaccagaggtcttggtggcggaggaccgcccaccagtatctaggcgctgccgcgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagaacttagaaaaacacacgcagacccccctacctggcgcgccagatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctccctttttttttctcgtgggatctcctctccagatcatccccccttccagccccctctcttaagtgggcaaggttctccttttatatctcaaggggataccacatgcaccacttctccttctctctctttttgggtgggggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacagctgctgcccgagtgacccttctgacgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgcttacctaccccatatacgcggcgtaaaacccacaaggggttggggcgcctcggccctcggggccgagacgggagcggtccgacccctcggggagacaaagagaagggcggccgtatcaccctcgggcccgaccccccgagggggttaggccacgtgggtgatcgtgtctgcctcaagtctctaagtcatgatactcccggtcccatgtcaccgacacaatactactaaataaatgaaaatgcctcaaaataaatactaaattttagtttccaaatttaatttaactaatacaactaataggctacagtaaaaaagcaagtgctgagggcacccg

SEQ ID NO: 67757 - DNA, 2077 bp, Oryza sativa
taagaatccaggtcctgtaaaaaatactaagcacctagcatgctgggactccttttctttttcctataggggaattcaacttttggacaaaacatatgaatgaatagaattggcgagtgcagggccatgcttctaatcattcattatataatttgtatcatatttgagggggaaactatattgtagcttcttaagtaatcttatttaattcatggcaggaaaatacatacttgacacttcttactgcaagatcagacgccttttatgatctgaaagattccaggtgagctatacaatcaagtgaccacgtctcttaaaaatatcatgatgcctgagcatgtcctgtcttaagtgtatatggaattaatttcctttcccttttatgaacattgtgtaggtcccgcattcagaatgttctcttgaaggcaaatgtccttgtggaagtccaaaggtctctgcgtgagagcgcactgcgcattgaagatctccctgctgatccatcttctcaatctgtatcaccacctccacagttctctcaagatctgcactttcagttattatcttctgaaatggcaattggtggaccagctggactttggcattttatatataaaagcatttaccttgatcaatatgtatcatctgagttccccttaatcataagcaatccaaagcaacagaaaaggtattgtattttgatttatttattaaatacaattcactgtttgtttttcatacgtatgatattttctataaaattaatattcaactgatatgcgcagattgtacaaagcttatcaaaaattgtatgcttccatgcatgataaagcaactggtccacataaaacccaattcagaagagatgaagattatggtgagttacccagcaatttaattacccttgtttgaagagatatcattgacagatacagcatttcagttaagtttgttaaccagacggtggtgtttgttgcacatttgtgagtagaatctgtatagttttataccacataaaagatgaaatgtgcaatccattattagtcaattctgatgctcaattatttttataatgcatacgagttataatagccactgataagatacctgtggggattcaggtttctgctcatcaaattgttttcatgaaaaagagaagtagacaatctacgaagaatgataaagatagatgttattatacggtgataagttgtcattggatccattttagttctatggtaattttgttgggttttccagcatgagccatttgtgttgatgcatgtgtcctgcaaacaaactgacctagaagttataagattttagcttgatttttgctttgcacgttgcattttgtgacgtagagggcccatttgtcagtcttccatgtagaattgcaatacaaaattatatttattaagttttgattccagttgctttgaatctgtgacccataaaggttctgtaaagtctcacgaacatgacctatagcccttgtataactggaatgtcagcttctgttagcattactaaacaaaacataggtgtgaaatccttcttgaaataattttaaatctggggagtatacaatgataagggatgtaattgcttttctcttctgtaagatttggttatgaacgtttgcaagcccatgcatatgtcatcatggtgttcttgggtttactagaattactgagtaatgatattctccgtgtgctttataggaagacagtttgttaaagttataatttttttttgttgcagttctgttctgctggataacccaggattttgagttgtacgccgcttttaatccactggctgacaaggtttgtacctgtcacaatcagtttatgtatgctcacttgtgttttgtttgttgtggtaaatgctgtggtagtctaggcaccaggggaatggattaaggtaccatattcttggttgtatagcaactcaataattttgagcatacttattttgcagagtcaagcaatcaaggtatgcaatagagtatgccaatggatcagggacctggaaaacgaaattttcgtatacggagaaagcaccctttcctggtgat

SEQ ID NO: 67758 - DNA, 5138 bp, Oryza sativa
gttgttatcactgttttgaatagcttatagtggctttgcttcttttgttttgcatgtgagtcaagtatacatttgaatccacaattgtttttcttcatatagttgtccaatgagaatgcacagatcttgacatgaaaagttttacagtgagcttgttgaaaaatgaaaatcatgtggagctcatgcctggatttgtttttttttccttccctcagaaaatgtggctttctggcttttcaagaggaattcaggagatgcacaggaaggcttctttggttcttgaggatgcagtcaggaatatctatactgttgtggcattttgtgctggtaacaaaataatggaactttacagactgcagcttgggaatattctttggaaaagcttggttcatggaatgggtattggttttgcctttggcttatctcagttccttcttttcgcctgcaatgcacttctgctgtggtatacagccgtagctgttaagaatgggcaccttagtctggtaacagcacttaaagagtacattgtcttctcttttgcgacttttgcactggtggagccatttggccttgcgccatatattctcaagcgtcgaaaatctctgacgtcggtatttgaaattattgatcgtgcacccaagattgatccagatgatgcaagtgggctaaaaccccccaatgtctatggtagcattgaattcaggaatgttgatttttgctatcctacacgccctgagacgatggttttgagtaatttcagccttagagtcaatggaggacaaactgttgctgtggtaggtgtatctggatcagggaagagcacgataatttctttgatagagagattctatgatccaaccgccgggcaagttttattggatggccgtgatctgaagctgttcaacttgagatggttgcggagccacatgggtttagttcctcaagacccagttatattctccacaaccataagggagaacataatctatgcaaggcacaatgcaacagagtctgagatgaaagaggcggctaggattgcgaacgctcaccatttcattagcagtttgccacatggctatgacacacatgtgggaatgaggggagtggatttaactcctgggcagaagcagcgaatcgccattgcccgtgtagtgctgaagaatgcacccattttgctgcttgacgaagccagttctgcaattgaatccgagtccagtagagtggtgcaggaggccctcgacacattgattatggggaataagacgacagttctcattgcacatagggcggcaatgatgaagcatgtggataacattgttgttctgaatggtggaaagatagttgagcagggaacgcatgattcactggtgcaaaagaatgggttgtatgtcaagttgatgcaacctcatttcaccaaaggattccgtcaacgtagactaatataagaacccctggtagcatttgtacattgctcactctgcttcactaactagtgactggaaacgtggaaggcagcttggagacagtatgagatggtacaagtatttgtgttgcgatctgacaggataggcataggcattggcacaggctctggagtctggacacatgatattttaatttgctttgctgtaataaagctttgagatgaagagtccggaatagcatatagcatgcggcataaaggaggtgaagctgagatgcgctgtcccattgaatccactccaacattgacttgagagtttgatgagtccggaatagcatatagcacatggaattggtcaacattccatgtgctgcgctgcctgcctattcattcatttttgtaactgatcgttattagatcggatttgttcattgtgatagtgtgatgtagttttggcattttatttttgacacttaaatggaattcttggtgggggggggggggtgtgttgtgtagtttggtactgcattgaagtgtaattagggaagggatattatatttgttttggtggaagtagtagaagtaattttgggcataggtgtgctggaagtgggagtgggtaggtattcttgtttgatcatgtttaagcaggcgcactggtaattaatttgttgatacactcagtttggtaatggagcaaagctctgggttgttgaatggaatgatggggcggcggaagagttggttatatttccggttgtgtgtgttttgcccctctcttgtgtggttaatatctatatctatcctggtgtagtacatccctgtagtgtagggggaaagagagatgggagttagaaacacatcatgtgctagcaaaatgcgatagccaaagacgaaatgcggtttttggtgggtgtcagtcgcgtgcgtgctgaaacgaaggcacgagggatttactaatagtaaggaattgctggtataacatgtatgtatatgtagatttgaacccaagtgaatgaatgaaggactgtatgtagaggagaagagatccagggaagggagagaaactgtgtgtagtgtagccaaagggagccaacaaccggtctcgttccatcgaatccgaccgacggaggcgacccaacccagcaaagacacgatcgaatcgaatagagtacattctctacaggggaggggagcgagcgagcaaggaagaagaagaagaggcatcggcatcgcgtcgggaaggccccccatggatatggatcctcccaccaataaccctagcccccctggtccccccgactccccgccgccggagaagaggctcgcctccctctccctccgcacctctcacctccctcccgacttcgagatccacgacgactactacgacgactacgacgagggctacctcactgccgtctccagggtagggagcatcagcacctccgcctccgcctggaaggacgacctcgaagacgccgacgtggctccacccagccccagcagcagcggctacgccgccgagaggggcaccagcctggcctgcagcgccgccgccaacgacgatccccaaccccaacccgacgacgacgattggccccgcgacaagaagcatctcacgaggttttccatatcatatgcctcctccctccaatctccatggatcaccactccgcactaactacatcctctaatctggactaactactactcctgtactgtaccattattcccttctttttccaggacgatacttctgcttcatggcgcaaacggaaaaagcacttcttcatcttgagcaattctggcaagccaatttattctaggtattttcttttcttttataaaaagaagaacaaccacttatgcacaaaacaaacgaccctttgccaccctcacttaatgcattctctttccccttcaatttttccaccacttgtgcaaaaaacaaaccaattcttaggtatggagatgagcataagcttgctgggttttccgccacgttgcaagcaatcatttctttcgttgagaacaggtgtgtaatgatacccaatgatcacatttcttctattcttttctcttctcttgtggcctaaccttatctgtttgtctgtctgtcttcttcaattggtgctttcttttcggcaatgacctattgttttcattcattccagtggtgaccatatcaaatttgtaagggctgccaaacatcaggtgatgtgggcttcctgtccaaaacttgtatacttttatgccgcattcgaagataaatccaagcataattaacatggacttcttatttccaaatctttctaactcctacctattctccatctttcagatagttttccttgtcaagggtccaatatacttagtttgtataagttgcactgaagagtcatatgaaggattgaggggacaactagagctcatgtatggtcaggtgcttcccctgctgcattcatcctaacacaattaatttctgtgggcttttggttgtgattacacaaacttactttctaaagttctcatccagatttctctatctgaaaatttaatttgtagatgctgctgattttgaccaagtctgtcaacagatgctttgagaagaaccctaaatttgatatggcaccattgctaggtggcacagatgcagttttcctatcacttatacatgcattcagctggtcagttttgttttttcctttgcctgaaatattttacactctagttgcccaactaaatctcaccaaaccattctgcaggaatcctgctacatttcttcatgcgtacacatgccttcccctcgcccaatccacaaggcaggcggctagtgcagttttacaagacattgctgattcaggagttttgtttgcactgttgatgtgtgagcacaaggtttgtccattttcacgccagggaaaacttttactgggatattaaattatgtgactttttgggcataaatgaagtatttaagtttagtgtgctgaatttctgagcacaatttaggtaccacatgtccacattcatctattagagatgcgtatatactatatacaatggtatctctcgtcatttttattggttaaccaaacctgacatgtcttcaccttatgtccttaactatgctgaatttacaattctgttaaggtctttatgaggcgtcattcgttttgtcgccgtcccacgcttcagccaacaattatctgtagttctttgccctataattttacaaaaggatctgtatgtctcgctctttgttctgtctatctaggtttgttatgtgctgctagcatcccatcctgaggcaggctaagatagggcctgtcctcgatctttctcttcaatcctacttgttcgtgtttctgggatttcattctttgttatttttcaggttattagtctagtgggagcacaaaaggcaactttgcatcctgatgatatttttctactttcaaatttcatattgtcctctgaatcttttaggtaatcatcacgacacacactctgaaatggtaatctttactttgagacgttcttactacattttctttaatgcaggacttcggagtctttttcacccatatgccttccaagatacaattctatggctttcttatatgcttatgttcatttttttgatgtgagtcaaatatatcatctgaatatgtatgctttttaatctgtgtcgaaataacttataagtaca

SEQ ID NO: 67759 - DNA, 18123 bp, Oryza sativa
tttgttagcttgggttataacatgaatagacgttggactaggagttgcttagccatgcttagttcaactagtatataatggggaaaatcctgttaatgtttagactgttggttctaatggtattgttggattagtgccaccgctttggtgttattaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagctgacgcatccaggcaagggtgggcgtgatggagtttggatgggccctgcgacggcctatgcggcttccagattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtataggtggatggttgggcctgttgcaacgtgggatagcgttggacagcggatgatcaatattaattaattattgcaactgtttaattctttcaacttctgtttataaatgctcgctttatgcaaatgaaccactctagctctcccttgataattccctgcatcatacccctattccggtatgacttgctgagtacagtgggtagtactcagtcttgctctattttcccccaaccccagagtgcgagtatgtgtccgatggaggtttctccgaggagtaggcttcgtccgtgccgtcgaggatgcctgtggagtggtgttcccgctgcagttctagtcaaggcttagctcctgttgtctttcgtttttccgctgcatttatgtaagacttttatgatgtttgtaagacgtggatctgaatgtcaacattgtcttttgtgtaccccggccggtcctggacggggattttaatgcacattctgcttggaattctattcgggaatttctgggcgtgacacgaccggcaacggagaagacgacccaccgctgccagctccctttacactaccatctgggcttgcgccgacgccagtgaagctattgctgctccggctccggcacaacccaccggcgcccccgtcacccagccgccgcgccccatctggccgcgccgcacagcccacccggccgaggagggcactgcggcggcaccctggctgcctggctgccgaggcctgcccgcgccatgggggctcgcggccgcactgccgagccgcgtgagcccgcaccggccgcacgccgagctgccgcctcccagccgccgcgcccgggcagccgcaccgggccggccgtgttgccgccgccgctcccagccaccaccgcctccaggctgccgccgtcacagccgtcgagccgccgccaccgcgcccaggctgccgcactgggccggccacgccgccgctgagccgccgccactgccccccagccgcctcgcgccgccgtcgcaccaaatccgggcgcgtggtggccggatccggccttggaggcgccggatctgctgcctcccctcatcgcaccgccgtcaccacctccgaccacggtggagggtcttcgccggcgtcgtcccgtccacgtcgtgccgggagggagtcgccaggaaggaagggcctcgccgccgccttccctgctcgctgccggctttgccgccggcgagctctggcggcggcaaggcggtggggagggagtggaggcgcgggcggctagggtttttcgccccccgagccgcccgcgcgagagcgacgcgagggattgttcccttcattttttgactatttcaaatgtctcattccagaaaatattgaattaatgcacacgagaaatacatttatgataaagtttctctagatacataagctagtgtttcaaagttcattcaagcttagcatatcactttgcaatctgtttttaacgggtccgcggtcatagttcaacacgaacagttgaactcatgacgacctcggtccaaggccctccaaccttcatgtagttaatgaagttagcctacctctactcaatttcaaggttcagcatgctgtcagagaaaaaatgtctacagcataaatatgtccagtatctctatactaatagagcagataaaatatagcaactgaagagtgaattgaactggtcataaagagctgaccaacaacatactttatgacaaaagaagtagcagagcttaaattgcacatatcttcaaatattgggagcctatgcttttgccatatgtcaagcttcttcttgtatagtggatcttggactggcatatctattcgaataagtgcctgaacagtgataaggagttactcgaacaccatgtgcaacaatacatacaaagggcagcgatttttgaaaaatcaatgtgcaattaatatgtaatatttcttggtcaatggaaaaggaagtttaattagaccttaagaactatatttttaatgacatctagtcctcaataataaaattactaatctttcaaagtgacaaagatgcgaaaaattggtatttgttttttattgttttattttacataatataagtgccctttcaatttatagtaagcattcgtgcctcctggaaatcaggacatttgaatttagagctaggctgctgttttacctggtcatatatgtttctggcgagtgtaaatccaaagttgagtgccagtgtagcatttgagtatttcccataccttatcatcacctaaaattgtagtgaacacttgagatttcagagctagcagaaacacataaaaagaaatgaagcacggttgcctccattcccagaaacatttttgtgataaggataaagatgcagctcatggatttggctactcacagtttatcaggttatttaagtgtatagaataaagcataataactagtagcaagaatcacctgttcaccaacagcataatttctgtcagcaatgatctgcaagttgtaagaaataagagcaaagaatgttactttggtatctctaggtggataagaaattatgtaaaagatcttcgtaaccatacaacataggcacaaaagtacacagatagatgtggaactaatgatggttacctcacaaacatctttctgctcatcatatatcaaaacagaaccaaaaacaccatcatggttgaggaaatctgcaaatggaatctaaatgacgctttcagtatcacgaaaatgttagggcattatgcatgcgatccatttaatctgcaaaaaagatgataggaaacaaatgagagaaactgtaccaacaatacacctctaggagtccgccaagctcgagatgaaactgcatgtgccatgtaaaaaatgccccaagtttacagtctctcctattatgctccttttggtcatttaaaactcaaatgaaataccactgtacattgcaagaaggtccaggtggaagtgcccttcttactaatttggtttaaccaacaatcagagggattcaatgtctgacatgtggaaataaacatgtatagtttcaaaacagtaagaatgttgccagcctggttccaacatgttgaaatgccaaaactagtttaatatattgattaattactaatttatattttcctccttaaatgaggagttgaagcggtggcacattctacatcaacccctcctctatcagaatctttagtgtctttgtaaatgattgcatcatatgccatcatccatttaagtgtatatgcatgtggctataaaacctgatgtgaattatgtattccctattcctgatttgattatatttatttacaaccctctgcagtgcatgggagccatatgatagcaatgttgcatggtgtgaccgatgtactcaacttgcatgcattaagcaacatcaaacacgaattcagcgaggaaatgttactacatacccaatgcagaagcatgcatgaaatcccccaatttaacttctccaaacaaatgtgggaaatggtcaagagccttgcatatgaaaaggataaaaatgagattggtggaaaaggaaggatagattggatgtgcatattgcgtgcatagatagagaaaaggagggtacaaactggcttcagtgccaaaaattcctttttagcttgttccttgtgttcaatggcttcatcataaattgagctgttttggaccgcatggagctcatttagatcccagagcacctagagcaaagtagagattttggtgcatcaaatctctgttggaaatgcatataaaactcaaaaactgggatatgcagatttgagaacagaaaaggtaaaacaatcaggccccaagttaagcatattgaaataccatgttatgcatctgatccttggtgggaagagatttaatatacggcgcccatcctgattcctacatcataaaaggaagcctctttcttgagaatgatatgtgaggaggggaggggaggggaaatagtagagagtagagagaaggaggtacatttcccaagtgttgctccatgatgaggagcgcagcaagcttagatgtatctccaacagcatggtcaagtaaggtgttaaacttttgaggaagtttatcaagggtaagctgctgcacatacatagagacaatatagatgtggtagaaaggatgagattggttgtagcagagctgatgagggggaaggaagtattgttattataggaacatacaacatggtaaggaacttgcattatacagtccccctcttgaatgggctccgatgcaaataatgacctgaatggacaaaaaaagctagcagctagtaacagattattatgtagtagtagaaattaagagaacaaattaagggagagaatgagaatgagaatgaccttccaaaggcagaggaggttccgagagataatacagaagaaatgtgggttccagacttgctgcgcagccaacgcaggaatacagagcagtcgcagtcgccgccgccgccgcccccctttgaattccaaaacattattattagtaatagtagtaggcagtagcagctgaaggtactccatatattatgaagcatatagaaataccttggaggcggaggcggcggcggcggcggcgcagcggcggggtgcgaagcggaatcgcatcgagcagagactggctagtcgagtcgtgggattgacctttgcgttagctaagctcaacaaggcccttcttgggccccaacaaaagagggcccccaccaaaaccaaaaaaaaaaggcccaaaaatttaaaaagaaaacgaccacagtgggagtcgaacccacgaccttctgatccgaagtcagacgcgctaatccactgcgctatgcggtcgcctctctttttctgctttatcctttttttatttgtacagaacaatcactgtaccttttttttttactgaacagaagacttgtgactgtatgggattagcctgtcttttaaacacaaatgtactgtaattgatagccagaaggcaaaaaaaacgcgctgattactctggggatgcatgcgagacatggaaggagtagtaatctctgtaagtactgtatctaggaagcatcgtatctaaccaaagcagagaatatgaaagtggctagcaggaacacgtactacgcgctcatccatccatccacccactgattacttcaattaattaatactaatagagatcctgaaaaaaaatgatacgtggtacaagctagcaccaggataagttccaacttgaacttatcttttctttttcttctccactcacctacctaagccgggcggacagaagaagaattcccctttcttttcgtttcaagttagatatgctagtagctactagtaggaatttgttcggttcacactaattcaacgtcatattaatttgtattgtactacagtactactgttccacatcatctaaaatatcgtcagactgtactttttacctacactcgtttcatcctattcaaaatcataggtctccaaccatggttcagttgtgttaggcgtaattagtgctaatagtaagttttttatatttaaaatgaaaattgttgaagtataatttgagagcatttacgaggtaagttgtatcgatgatatttctctcactagctattaagatgcatcgataactttctcgtagttcataatctgtgaattgataccccctcacatttcatgaaaaaaaatggcttttataaatttccgtatacagtagtacttacagatactagtgcacataataatctaaaattaagggtgaagcaagcagtaagcagggtggatgagaaatcagaaggaagcggaagcgcgtggaggcatgggcgatgaggaggaggagatgggccagaactgtgcgggcttgatcttggagacggcagtgagcacggacagcggcgtgacgtggccgacgacggtgaccttcttggtggcgatgtcgatgtccaaggaggtgacgccctccatcttggagatgtgcttcttcaccttccccgcgcatcccttgcagtgcagggacacccgcaggaccaccacctccacctgcgacgatgactctctcttttcctcttctcctcctcctccttccactgcagcagctacgatctcattctcctccgccgcagccgcgacagcaaccgggatgacgaagggcggcggcaactcatccgcgctgggttgcatccgggaggagttgagaaggaacctggacgagcttgcagggctaaccagctgctgcttgctcttgttcgccttcgtcttcttcttcttgctgctgttgctggtgcgagctgggtctcggaggtgcggcggcgagtggccggagaggacgatggaggtggaggcggcggaggagcaggagaggcccagcagccgcttgttcagatccttcaacaccacagacgccatgcctactgcctcctctgcttgttaattactgtactactactgtagtttgctgctgattttgctttgctctcgcatcgcgcgcgcgtgcctcttcttgcttgctgattgctgctgcttcttttaaactccccaccccagcagcagcgacttcagcataggcccaccaaacgaacctttgctttgcttctctgcccctgcccccactgtgctgtccatttcttattcgttttaattttagctaccacagtatactgcgctagtgttttactcctatataaacatcatcttttgtacttacctatatactgtactccatatactatgcaataattaagtacgtacagatcgagatcaacatcgggtcttttagttttgtcttattgtctgtttcatgaatacagtataagagatggcatccacactgcataaatacatacgtatacagattccttcacatgcgcaacaggacgtacatacatgctgctctaccacacttattttaatttttctctgctaattactacaactaatcaggccgccatacattcattaattagcaaacaattagtaaaagaaataatcagagagacatagaccaagtgctagctgcaagctagtcaaatgcagattgatagactgtgtaccacaactagaagatgagagatgagagatgagacaagaggcaactaggcaatgatgcaagcggattattaaaattctagtacaatttgctcactactacagtttactaattagactgcaggtacgtcgccgtcgaaatgtagaaattggattagtaaaggttgactcaactgaaggagaaccactctttcttcctccgcggaaatgaataaggcatctgcacgtaccttacctttcggcccatcagtttgaaactcatgcagtgcaggattacttgtttacgaattagtatgagtcagtggtttaagtatatataaataataaaaaaataggcacggatcagctgagcaatttgctttgttgacattggtacttattactgctcttttcttttctttagggaccctacatattgacgactttgggtttatctttcttacttaatttggtgagtcattaattggttcatcatgatcaaatgatgattgtctgcactgaactgaacaatcaatcggtcggtaagctcttcagtcggtgctccgttcctgtcacctatacttacttgttcatctttaattactcccagtcttactacgtgttctcccatctcaagtgcatatgctcaacatggagacactcctcctactgctgcatctgaatggagcaagtagttagacagtcagtcactccttttagcagaaaaaaggctgatgatggttgcttcttgttggtcaagagaaaaaagaatgaatcacaaaattttaacaagattaagaatgtaagcatatataggcacccactgcattagtatatactatatagtactagctagtaattgctccctgaatttcttcacctcgagcctaacccctgaaagaaaggaagaaaaaagaaaggcaaatggcaacgccaggagacggctagctaattaagctagaattaatacacgcactgattaagctagaattaatcaaaagctaagcaaattcagttgacgagtggactagtgtagacagtagcccccaaggcccaaacccccggccgcaaaagaaaagaaaagaaaaaaaatcacatgctatgcaccatcggcggcttctggtgaagctccgactctcgttaatttgtacaccttaggtccggaggaataatcgaaaataatttggcagtctcctctttttcctttttttttggggacaaatatatactctacctcctttcactttttagctaatcgtagtatgctctatctgcatatatacatcgtgcttgcttttctgatatagtatatgcaaatggctgctggaatgttgaggtttatatgaacaacccctgtagttagctccttttcttcatttggaatgttgagagttctgtacggttcaccagcagcaaattcggcgttcaagctaggctgtgtttacttcagcgtaaagtttgaattttggttgaaattggagatgatgtgactgaaaaagttgtgtgtgtatgacatgttgatgtgatgtaaaaggactgaagtttagattcaaactttggatctaaacatagccctagcttagtttttttttgtctttttattcatgttaaattattgatttcgatatgattctgatcaatcctgttaggtttttgttcatatcatatctggttcacactcagaaaaaggtttgcaatctatgggcaatggtgagaagcttctcatccacgactagaatagaatctgatgctgccaggcaggcaggcagccaatggactacggagcactctactccaatgatcaatccctttattttctttctttttttggatcatttcttttttcttttggaaaggcttcaatgatcaaggtagaatactaggtatggaaatgggaaagaaaagaaaaaaaaattggaagatacggtattgggccttgcaaagaaaggcataagggagagatggagtttctgggccaaagttaattcagtgagcccgtccggagtaagagtattaggataagttcacttaaggtccctaaggctgtgtttgagggaaaggtgattgagaagattggaagaaacgcaaaacgaggtgagccattagcgcatgattaattgattattaactattttaaacttcaaaaatagattaatatgattttttaaaacaactttcatatagaaaatttttacaaaaaacacaccatttagtagtttgggaagcgtgcgcgcggaaaacgaaacaaacaaactccctttgttctccaaacgaactcagcctaagttgtccctgaaacgaaattagatcccaaaacggtttaaactacggtttcaactgatgtaccgcctacgtggatggtttgacttgattcatgtcccatgtggcgttgatgtggcactataagcaatatttttttaaaaaataaaataaaatgtttgggtccatacgtgagataaacaaataaaaagtatagtggggaggcatatgtcggtgagtcccacttccttcaaacccccttcaccccccccccctctctctctctcttctctatgtcattccctttgctcccaagctattggcaaggaacacagcaaacaacaaagaggtaccgaggagggagtcgtggtgtcctgcggcagcggatgagaggacgaaggcaaggagagaggagctataggagccctcccacagctcctaatattcgtcactggagcagcttgccttctcgcggctctagtaaaactaatttacataatatttttttctaaagtctgatgtgtacctttttttaaaatttttaatgttatattttgttgttttgataatcaaaatagaacacatatgtgcctcttgtctaattcctatggaacacttcatttatttattttttcatttatgtagtatttttatttttttcttcaattaatatatggtaatttctagttatcgaaagtgaacatcggtgcttttcttttagtcccatatatctagcaattacacactttgtatttttaataaattttattatgaatttattccaaatttcttattttgaaggtttatttgaaattagtattgaaaatcaatttcgggatttattttattacttagttcggattttaattagtagtcttggtatgcagtatttatttatttaaatttttactcttgtttttgaattttagtgatattttaaagcttatttggaatctattttgttcttattcggaattttaattaatatattttgggttgatgatggagcggaagtgcggaggtggtgagatggggtccatgcacgcaaggtcgcgctggcgcgggcggcaggtaatcgatctgggccggccaggcctcagtactacgagtcaatacacgaacggaacggacgtctcggaagataagtgattcatcgcccgatccgatccaaccgggaacggatccaaggatcgcaggccatcagcttccttatccggctaactgacgataattatctttgaatgcaaccaactgaacttgctgcatgtacgcagtcactcccaccccacctggactggagcatcttctataaatagctacaatgatcagtctccctcccagttaatcacttcaccttcttcattcagttcatccaatccacgatcacttcctagcaattaagatcatggtgcagcgcacttcatccgattcggcggcgtcggctgaggccatggtcatggacctgagtcccaagcgtcccgccaagtcctacggcggcgaaggcggctcgtactttgattggtccccctccgagctgcccatgctccgcgccgcctccatcggcgccgccaaactctcgcttgccgccggaggcctcgccctccccttctactccgattcggctaaggtggcctacgtcctccagggcaagggcacctgcgccgttctcctccccgagaccccctccgagaagatcctacccatcaaagagggcgacgcgctcgcccttccattcggcgttgtcacctggtggcacaacctgcacgccgccaccaccgaactcgtcgtcctcttcctcggggacacatccaagggccacaccgccggccgcttcaccaacatgcagctcaccggctccaccggcatcttcaccggcttctccaccgagttcgtcgcccgcgcctgggacctcccgcaggacgccgctgcctccctcgtctccacccagcccggcgccggcatcgtgaagctcaaggatggcttcaggatgcccgagggttgcgacaaggacagggagggcatggtgctcaactgcttggaggcgccgctggacgtggacatcaagaacgggggccgcgtggtggtgctgaacacgcagaacctgccgctggtgaaggaggtggggctgggcgccgacctggtgaggatcgacggccactccatgtgctcgccggggttctcgtgcgactcggcgtaccaggtgacgtacatcgtgcggggcagcgggcgcgtgcaggtggtgggcatcgacgggacgcgcgtgctggagacccgcgccgagggtggctgcctcttcatcgtccccaggttcttcgtcgtctccaagatcgccgacgacaccggcatggagtggttctccatcatcaccactcccaaccccatcttctcccacctcgccgggaggacctccgtctggaaggccatctcccccgccgtgctccaggcctccttcaacaccaccccggagatggagaacctcttccgctccaagaggctcgactccgagatcttcttcgcccccaattcgaattcgatttgatggacaatatccatcctccatctccagcacctgcccacctagcagcatcagcagattcagcttccttccttttatttagatcatgtcagtcgttagatttaattcggttctttggttgttagcatcacctacctcttttatttgataataacaataagctcgagatggagtggaatttgatagtcctatcatgcatatgtcctctttatttttttaaaactctgttttaaagtcaacagccgttcgattcgatctgccatgcatgaacgaactggttttatcagattttgtttgttttacagtggagtggagttgttattctgagaggcgcgcgatatatatgaatctaacaaattggctgcatgaatgggcgccatatatccccgctgcccgcgctaacaaacaaaggcggcgagtgtgcgtgggatagatcataatagatggacgcatgatgattgcacaaaataacctgtttattgtgttttcttgtctcctacatctaggagatgaactgtagagggagatgagctgttaatcatgcatgcatgctgctttcattgttgttgaacaggggaaatgcacactgctatagctctgaatttagtgttctgatttttctttcgaaatcattaattcaaatcttaacttttgtggaattcctgaatctaagctatgaattcagcacttaatctaaactctgaaataattcccgtagtcctgaaatcaatactacttcgtgtgctcctaaatttcattttagtggtacatctgcaaaaatcgttatggtatcttgtcctctactgttcaacagaacttgtttcgcagctctagttgatgattcttttaaaataatgatttttcattaatccagtctcaatatccaacaaggatatacataaccaaattatccacatagggtatatataacgaaatgaatacctaaaacacttagactcgcatctcaacaagaagagaacatataaccataaaaaaaacaagaagagaacatacaaccataaaaaaaccatgacctcggtacacatttgctttaggtgagttgaattgatgccacgtgccgctggttagcccaccctcattagttgtcgtccagtcaaaactagccgactagacgggatccgcttccgcgccttcgccgcatatagagcagctgtcattgtcgagatcctcttccgcctcccggactcccaaccttccaccgcccctaggaccgcatatcttgctgaaatcccagttctcctccaccgacgtcgaggaaatcctcttccgcccgaactcctaggtctctgccgctctagttgatgatggaaatcattgacaagaactatagcacttggaatttagagtagagttctgcccattttgctaacagagtgtgaaattcattaagtgggctataaaaattcagtatggaaaacatgaagttgcgagaatctttaggcttagatcccaccccaaaatttttcaccatgtcacatcaaacgtttgaacacctgcataaagtattaaatatgggttaaaaaaataattaattgcacagattgcgattaatttgcgagatgtatcttttaagcgtaattgctccatgatttgacaatgtggtgctacattagacattttctaatgacggattaattaggcttaataaatttgtctcgtggtttactgacggattctataattagtttttttattagtgcgcggacacccaatacaacaccatatataatacccgatgtgacacaccaaaactttacaccctcttagatcagttagttgggcttgtgcttagaattttacatggttgtccaatattatctgagctatttatgacttttattattttttaataagagagtaaagaggaggagtaaagaggcaaagagtagagtagcaggaacccgaaaacgcaaaacagcagaagatggaggtgttgagcggtaaaaagagccaacctgtaaacctaaacctaaagaggaaagcaacagcagtagcagtagcagtagtaggctagtgtggcgagtagtagtggtattcccctcttggtcttggtgttgggctccgatccgggtcggccggcgatcgaggtccgccaccactgaccgattcacctcgccgcccgccgcccgcccatgaagcattcttcttcttcttcttcttcttgggtcttcttctagactggactaccttgtttgactagctagctactaaggtagtgtggatgccattcaaatctgcctccgccgccgacgagtactagccgctgctcatggtttcgcggggcctcttcggctggtccccgccgcacgtccagcctctcactcccgtctccgaggcctccgagccgccggaatccccctctccctacgccgctgacctcgccggggacgccgcgccgcctccggaggatgacgccgccgccgccctcgacgatggggacgacgagcccgatccgccccccgccgccgtccccttcaagcgcctcttcgcctgcgccgaccgcctcgactgggcgctcatgtccgccggcgcccttgccgccgccgcccacggggtggccctcgtcgtctacctccacctcttcggcaccgccatccactcgcttcatggccgccacaaccacgaccttttccaccacatcaaccaggtaaggttccttcattcccctttctcatacgtactaccagatctccatttttctcatatacatgccactccactcctacatatatggtatacgtacgccccgccccaccccgcaaatcaacattccttcttacttggcgcagtaatcatgcaaatttccttggttgttacagttacaattcttctgccagctttgcattagttatctccaatttcataagcaaactacctagttagtattagactgcagatttattcttaggcttgtttggtaagctgtcattatttatttctgcctctctctgatgttgatttagataagctgctgaccttttacgatatggtattgctaccggtgtttataggcgtatggttgaagcttatatcactccatgtctgaatgtgccgctttcgctagcttttctatgacctatgcatttatgcgtgttcagctggaaccaacctttcgctccaacacactgaatgaaacaattcgctctcacgcgatgaacctttgcaaattcatttactagtaaaattactttggcagcttgctggttttctaaaccttcacaattttctaacctccacactaatatctgtgcatttctacactcatttatgcatctcttgtccatctatctaattggttacactcacttttatgtgaatatcagcatttgcttgtccttctatctctgtataatcattttttctcagaattatgtatctttgtgttttggaagttagtaactaagtgttttacccgcagcatgctttacacttcctatatattgccattggcgttttctttgcgggatggataggtaagatgaggctacatcagctttttatgcactctctgttttcttttattctaacaaattcactgtctgttatatctatagaggtttcatgctggattcttactggggaaaggcagacagcagtgataagatcaaagtatgtacaagtgttgttaaatcaagacatgagtttctttgatacctatgggaacaatggtgatattgtcagtcaagtgctgagtgatgtcttactcatccagtctgcgctgagtgagaaagtgagtaattatgagccttcatgattattcacaacaaatcgcatgcttatctgactgacaagggttattctcccattctggctttgttcttttaggttgggaactacattcacaacatggctaccttttttggtggtcttatcatcggtttggtcaactgttggcaaatagctcttttgacattggctactggtccgttcattgttgctgcaggaggaatatcaaatatttttctccacaggcttgcagaaaacattcaggatgcgtatggtgaagcagcaagcgttgccgaacaggtattcaaattctttgactttcttttatcctgtaatgactgcccacatctcatccgtgaataaccttggtttgtcctactttctcgctacaaacgactatttctaaaaagatgagagtacaacatcatcgtctaaaaggataataaatttatggtcttgaaattggtaggcctctagtgatgtgcggaatggtggatttagctaggaatatacctcttgctaaaatacaaaacacactttcctttcgcaactgcatgtagcattattattaattgctaatgaaggtatgcatccatttgaatcattctcattattgcaggcaatcttatacattaggactttgtactcattcacaaatgagaccctcgcaaaatattcttatgctacttcacttcaagcaacactgcgctatggaatcctgataagtctggtgcaaggtcttggtcttggatttacatatggccttgccatatgttcttgtgccttacaactttgggttgggaggttccttatatctcatggaaaagctaatggtggtgaagttgtagtagccctgttttctattatcctgagtggcctgtaagcatccaattttaagagattgccttacttatagttttatattgatcagcacactcatggttcccaattgtttgtaggggacttaatcaagcagcaacaaacttctattcttttgaacaaggacgtatagctgcatacaggctctatgaaatgattagccgttcaacctctgttgtaaaccaggatggccgtaccttaccttcagtgcaaggcaacattgagttccgcaatgtctacttcagttatctatcccgcccagaaatccccattttaagtggtttctaccttactgtacctgctagaaagactgtcgctcttgttggcagaaatggttcagggaaaagcagcattattcctctcatggaacgtttctatgatccaactttaggtattatgctacaagctattctttgctattttctgtttactcaattatgaatttgaatcatctttgttatatgttgcaggtgaagtgcttttggatggagagaatataaagaacctgaagttagagtggttaagaagccagataggacttgtgacccaggaaccggctttattgagcttgagcatcagggaaaatattgcatatggaagatctgccacaactgaccagattgaggaggcagcaaagacagctcatgcacatactttcatcagttcacttgaaaaaggatatgatactcaggtgctgttcatgctttattctaacatatattgaaactgtgaaacttcttattctcttttaccggtgaacgtgcttatttagtgaacctaaatatgacataggttggtcgggctggcctttcactgacagaagaacaaaagataaagctctccattgctcgtgctgtgctttcaaatccatcaattcttttactggatgaggttactggtgctcttgattttgaggctgagaaagctgttcaggaagcactagatatcctgatgcttggtaggtctaccatcatcatagctaga

SEQ ID NO: 67760 - DNA, 11376 bp, Oryza sativa
atgcaacagtgtgcaatccctttctaaaagaatatttatacgcgaaaaaaaatctatacatagaaactttatacatagatattttatagatataaactttatgcatagaaaatttctgcatataaattttgtacctataaactttgcacatataaatttcaacgaattaaaaaacaatttgcaaaaaccttatattaagatcattaaggcccatatgcccatcagatgtgcttgtgttcacgatttcacgtgtaccagcgttttcgttttccacgtgagagcaggcaggccgtggggtgaacagaaaaggaaaatcatgcgtgaccctagaaatggaaatccggattcgttcgctgatctcgctacccgcgaacgttcacgcattaattagcttttctgatcatctgtgttaatgacatatgggctaagtgggacccacatgtcagtgactcaaggttctgcttacgtcctgtgtcctgtttagagagcccaaaattatcgaaagcaaaaacagctagtgagtagttaacctatataaccgattcatgcatcccttttactctttccgtcaaatcatcctcatcttcttcatatatatgatagtgttcctataagcactggcacagtagactagagtagtgtggaagccttcgtaggcacagtgtcacttctatctctatatcgccatctccgccaatgagttgtcgtcgttgcctccgaatactagcctcatggttagcagttaagaaaatccatccttgccctctacatttggtggttattacgtacttggcggttggccaacaaaatatattgtcttgatggttttgatgctatctttgaccctttttggctaccaagaaaattctggtttcttgtagtgagcctcgaaaaaacttaagtaacgatatcaacggcagactttaaaaacgaggctccaaatcaccgcctctataggcttgctatcggcccagatcgctgtctgcgctgacgtgttgtcgccgctacctttgcaagctagctgtcactagggtttaatatttcattttcggcatttgtatcgggggtgcgatataccaaaattttggtctgaaattatttgaatttttgaacaaaatttgatcaaatttaaacaaaatattgtcaaattcataaaataatgaaaaattttcaaaattttagccgaaatattatcgtatcggggggaggggggaatccgatagaatcgaaatttcattcaggaattttgaagccgtggcacgagattctacctccacggctttgtctttcgtttattggcgagatggatcggtcgaggaagactagaagagggcggctgttttgcagaagtcaagtactattgaaggtgggcggttgtttggaaaatgcaggcttggagatttattaaccgtaggattgatcggagggcttcatgaagtcgtgtcgtgtgtacatagaatgcgtagtacgttgctctactttaactgatcaatagatgcacctctcctcatctcaacctctcttctacagcacctgatcgatcgatcatatctcagccccactaaatctatcgtcctagctagcttgaccaccgctaggtcatagacgtgactagtacggtcagttttcccctggcttgtgcccaaaaattttggtcattgagctggttgttgagtttcatcaaaaattttccttgatgatcgaagagatgatacgtacttttctctctcctccacatcagcaacttatctttagctagctagcacttctacgggccaggacagcacattgttttattaattgtattaatttctaaatgctgtcaaattaaatgtgcactctgatattcaacttttatacagcttggccagtttaatttgcatgattaattttgacacgaggaggaatggctggccctcgagctagctagctaggtagagaaatatgtgtgtgttcaagcaattaacagcgctccactggcccttaattaattaaacctgttatatatctgtgtagtgtacgatcgctggcgatagataggtactagataaatctattatataattaaaggaatagaaaaaggagcctccacgttcgctctcatggtctagaaattctcacattaatcggagaaaaagaaaaaacagagtccatttagaaatacaacttagaaatagttgaaattcagaattaaaaaataaggaatattagaagaggagactagagtccatatagaaatacactttagaaatagttgaaattcagaattaaaaaataaggaatattagaagaggagtatagagtccatatagaaatataattaggaaataatataaattcagaattaaaaattaaaaataaggaatattagaagaggagtatagagtccatatagaaatacaattaggaaataatagaaatgaattaaaaataaggaatattagaagtagagtataaagtccatatagaaatacaattaagaaaaaaaatagaaattcggaattaaaaaataagaaatattagaaatagagtatagagtccatataggaatttaaaactaactaaaattcagaaaaaaaaaaaggagcctccacgttcgttctcatgacctagaaattctcacattaatcggagaaaaagaaaaggcagagtccatattaaaatacaatttagaaatagctaaaatttagaattaaaaaaataaggaatattaaaagaggagactatagtccatatagaaatacaatttagaaatagctaaaattcggaattataaaataaggaatattagaagagaagactagagtccatatagaaatacaatttagaaatagttgaaattcagaattaaaaaataaggaatattagaagaggagactagagtccatatagaaatacaatttagaaatagttgaaattcggaattaaaaaataaggaatactagaagaggagactagagtccatatagaaatacaattaggaaataaccgaaattcggaattaaaaataagaaatattagaagtagagtatagagtccatatagaaatacaattaagaaaaaaaatagaaatttggaattaaaaaataaggaatattagaagtagagtatagagttcatattggaatttaaaaccaactaaaattcggaataaaaaggagcctccacgttcgctctcatggcctagaaattatcacattaatcagagaaaaagaaaaagcagagtccatatagaaatacaatttagaaatagctgaaattcagaattaaaaaataaaaaatattagaagagcagactagagtagttattacacattagtagttttgaaaagttattgcaaaatttaaaattacgttgtcattgtaatatattttaataatataatgagaaaacatatatgctattatatgagagaaaatataatgatgctagccgcgcaatctgcgcgggccatcatgctagttagatataaataaaaataaccggtaatgcacgtcaatctggatgtgtatatatgtgcacagcaacgaacacctcgcgaagtactgagtgataactaaagtatacagcatgcatgtaccgagaaatgtatacgatcgatcgaccttagagcagacgtctagcaataatatttgtatacaagatcctaatatataaaaatacttactcaatatatatatgcgcagtcagcagaaaagaatggacatagctaggtagctagctgcaaaacaatatatatgtgtgtgtacataaacgtacaaaattggaagatgatgaatatattgatgcgcgactagctagcatgagagtaaatagctagctagtcgtaaaacccttcccaggatgcatgctcatacatatatagcgtgcattatttaccagcatgacagacattattgttaattaacccacaccccatattagcaagcttgcaaacactagtagcgagttaattctgtaataattttagagatatgcatcatatcatatccctcctccacacccaaattaaagctagtgacaactcacgcgatcgatatgatggagcctggaggctggagctgtatatatagacatatgaaccacagatcgatggagaggacacctgcgctatagctagtcgtagttgtgaagatcgaagttggttgtgtgattagatagatatggcgatgcaggtggcggcgccgtcgcggaggaggccgagcttggggcggcagaagatcgagatccggcgcatcgagagcgaggaggcacgtcaggtgtgcttctccaagcgccgtgccggcttcttcaagaaggccagcgagctgtccattctgtgcagcgccgacgtggccgccgtcgtcttctcccccgccggcaaggcctactccttcggccacccctccgtggagtgcctcctggagcgattcctgccggactcgtcgtcgggagcggcggcgcgggtgcggcgaggagcgaataataatggtggtggtgggatggtcggggagctcaacaggcagtacggcgagctgcgcgcgatggtggaggcgcacaaggcgcggcgggagagggcggacgagaagatagagatggagcgcgcggcggggaggtggctgcccatggacgccgatgtgcgccgcatgtcgccggaggagctcatggctttcgggacgggcctcatggctgtgcaggctgccgtctccgcgcgcgccgaccagatgctgcgcgacgcgctcctcattggccgcaggccgcccaccaccaccaccgccggcttcggcttcttccacatgccacactactgatctgaataatatctatctatctatctccattcatccatctccgcaatataatctgctagagctagcctcctcttcttctttgatcatttcatctcatctattattaattagttgctgcatgcatgcatatcatacccggcctcatcgttgtatcccggtcgatcgatcgctagctagctttttttgtttccatcacacattcattcgattccatggagattggagatttgtatccctgcatgttattatgtcttctgctgcagtatgtatcgtccttagcaagcacgcgcaaacttatatgcgccactgcaaatgacagattagtagttcacctccaatgtattagctgcagccacgcggatgtaatatcaccctttttattactaaaaatatatgcattagctacatgatacatgtcttcttgttgttattgttattgttattgttaatatatttttctctctgcgtgactctgggatatacgccctgctagcccacatatatatgttcagtacgtaggtatatataggcggtggaataaatgtatggcgtttgtgagttgtcgttcgtgcacctatccctagtagaagaatgagtgatccccctgcggatcatggccttaccactaggtctccgatggtttcttctcgtttttctcttcgtgaaatagaaagttgttccacgaaactagaacgaacattacgaaaaataagattagagtcctttttacaccctacgcgctatttctatatatggcaagactgtttctagctagctagaaaaggaagctattaatctaaaatggcaaagtaaattagctagagcccgacatctaggatacgtttggaacaacttgcatgtttgtcgaatgatttatcatatactaacctatcttgttaattttttttaatttttttataactatttggatgacatgcaaataacgaggggacatcccctcgagagtttagaatccactcatctctatagcccttgctcagctaggttagctcaccaagccatagcccaccaaagcaaagttgctagttcgatagcttgtcgacaaaggagaggggcaaggattttcaactaggccgggcgtgctagtttcccaagcaaagcaaggtttctaagcagttacccaaatgcacagcctagcatggcaaggagtggaagtagctagcctagcatccaaacgttcccctaatctcttatcaaattatgtcttccatctgtgtgctacctctcctatctccgtgctcccattgtgccagggttcaagaggatgaggcctttcttcccattgccatgtctctagctaatcctaactaaatacactgctaccctcctcgttatgcatgcatgatgatgtgtgccaggaggacgcagctttaaaatatagatggggcagagaacggaaatgttcactcgataagagtagttgaacacaacatatatcatatttatagttcaatcgtataactatctcgatcattgtttacagcgtgcgtgtgttgtgaagagacagactaatctgttggacgttcgcaccttgttatacctaattttgatggtacgataagagggtaggagggtttttttccgggggggggtgtctagggtgacacgggtcgtagctgggtccatcggcccaccctaactaatagatagatccgcctctggtgccggttgtgtgttagccccttgtccaacatttctaatggacctctataacaattattgatgcatatctctatgtagaaggccacacactctggattagcaatgaagtgatttgcaatacgtatggtgtcatgctgaaacaagattgtcaatacatgatagaaatttgatcgttgctaccacaaatatatcctaccagtgcatgactagggtcaagaagtaatccctgttatgatctttttttttgttcgatttcaaaccagtacataactaagaaaagtgggatccaccaattaaagtagcagcttctctatataactttaacataactctacgtaactagcaaataactaggtatcgttagctcgtctataccaaataaggaggcgattccctcggaaacagggccgaagagagagttagagataactcccaatatctttgcctctattatccacattcatgtgttcggttgattttgcatcctagcaccctctttctagaagtgaaaggcttctttctgatctctactctttctagtggagatgttaaagacagatgattcaaatcagcttgcctctatctccacccacgaatcaagttaacccaataattatccgtagttggcaacccagatggcagaactagtgatttttagataattgaattcatttcggcctttgcttcaaataagttacaaccattattgagaacatgatggttcattttctacgtacatcccttaataatatataaataatagatagatgggatttatttaggtcctcatttggaggaagcaaatggatcggagcgcataaactcgtttcaatcatgaagtgatggtgcaaacgcagcatgtatgtatatatctttccaccaactcaaacaaggacgtgaagaacgacagtgaagagagctttggattaggatgcatgggatgtgttgacattatattgcagatgagacaaccgatggatggacgacgttacagctgcaatgcatggttggcttggttgacagcacagcacagattttggaattaaaggagatttacgtaatttgtttgtacagaagaagagagtagtaattgattgggggtggaagacgacacaggtagcagctgcatggagtaattaatattctagctatatatggatcgagacgggggacgaattcgattattgagactgggagcagacgatatgatatgatatgatcagtagtcggcggtgggcagctggtcgtgcgggcgctggccgatgaagatgatgtcgtagatgagcgcggcgatggcggcgccgacgaaggggccgagccagtagacccagtggttgtcccagactccggtgacgacggcggggccgaaggagacggcggggttcatggaggcgccgtcgaaggcgccgccggcgaggatgttggcgccgacgatgaagccgatggcgatgggggcgatgacaccgaggtcgcccttcttgggatccaccgcggtggcgtacacggtgtagacgaggccgaaggtcatgacgatctcgaacaccaccgcgttccaggcgcccacgcccgccgacagcgagaaggcacccacggcggcgccgcccgtcgcgatcttgagcagcaggcacgccaccaccgaccccagcagctgcgccacccagtacaccaccgccttcaccaggctgatgttcccccccacgaacgcgccgaatgtcaccgccgggttcacgtgcccgccggagatgttggctcccaccgccaccgccacgaacagggccagcgcgtgcgccagggaggcggcgatcagccccgacggcgtcgtgccgccgccgtccgtcagcttgcctacgtaccattatcgatccatcatcatattaattactcataattaaacggatgaattacttggattcaatgcttgcttactgaaggccatgccggatcccgatccggcgaagacgaagatgagcatagagatgaactcggcgacggcggccttggccgtgtccgggtgggacagctcgccgggggcgcccaccgcgatccggctcaccggcattttcttcttcttcttctgctagtacgttcgtctagttacgctaagcgcggctattatattgctcccctccacactctctcccatctttgtactactatatatagggaaggagggagagtgagtgattcatatatgacctcttcaaaccaaaccaaaccaagccaaagccatgcataaggcatccatatttcattttattaattagtttcttcaccgccctttgcgcgcctatttttgtcatcaataacaaaagttgcagacagttccatggataaggacgtgttctatgattttttttatttgtatttcagagattttctgagactagatgcctatccagaaggaataaaaaaacgtccaaacaaaacttcttccagaacctggctgagagtatcgttatatataacattgcattttttttctcatccgttgggtcgtcttgagatttgtgccatgtgagaaaaaaaaaccactaagcaggtacctcttttttttttgaaaactcaatataatattatagattaaagacagagttcacatgaagtaaatccatgatacatcgtccgaaaataaaagatctcaaaagcaattttccttatgaaaaggaagggaaacttgactacgaaaaacaagcaggtacctgaagctaggatttaaaccctcatcgtcgtgagcggatgcattcgctcttagccaccaggccacactcgagttaattcaataacatacgaactacatataaattgctctatatgttgtaattggaatatagttatttttactatatttacatttaaaagttttctgtaaaatatatcaaataatgtataaccactcccttataatatactgtactaagcaaaagatgctcagaaattttagaaaagaaatgcattcatacggagctagagaaattgtttggactaatataggagagtaccaacctgtaaaataaataataactgaagtatttttttttcttttagaaaggaatcgtccattatagaaaacgatgagtgagaggaggggagggagtagaaacaaaggaagaaggcgatgtgtgccgcccagccgttgtccttgctgataggccgggcctcctggccagtagggacgcgccacgaggacaaacggttggccagggtcgcttctgaggcgccgaccgtgacgtggctgcatgctctctctggattcaataatttatctgaccgtctggctataataatgaaatggaggctcgtgttgtggttgtgagagctcatccatggaatttgcagggtcatgtagtactccctctatctatttttatagttatattttatattagcacacaaataaaagataagtaattctacttgtcatttatttaaacatactacgggttatttctcgtaaataagtgattcattaatatttacatttctcgatgtccatgtagccaatcttgtatggaagaatgaagtcacgcattaaatccgagaaagtaattaagatgataaattgttggattaaaatatgcctatcaaaaataaattttccagatttaaaaatatacctatcaaaaataaatggagggagtacatcttttgtttcaaaataagttcattttcagtttcttatgtttgtcccaaaatactatcccttcatcctaaaataagctaatactctcttcgtaccgaaatacttcctcatcacataatacaagaatcaggatcggatgaaacattttctagtaccacaaatctaaagaggctagaaaatatctcattcgattctaggttcttattatcgaagagatgtataaatttatttttaacccatcccgtttgtcctaaaataagttcatttagtttttgagtaatcattgcatcaagttagtgaaattagaaaatcaatgtattgagagtaggtaaagtagaaaatcattgtattgtgagttgataaagtgaggatattctagtcttcttagttttgtattgatttatatgggatttgggacagaggaagtatcaaatgtgacatatccaaaaatgggaagcaaaatactccctccgccctataatatataagggattttgagcggattcagagtaatatgatgcatcacatccatccaacatccatccaaaatcccttatattttgggacggaaagaagactcaccaaaccaatcaatcaagcatcaatcaatggtatactactccactccactccatagagtaggacatgaccatcatcgtcattcagaatcttgtgatgatcagatgaggttggaatacactactaccaggcagccagtatatgttgcacagcagtttggaatctttttagtagaatctgtcagctagcaaatgtgcattaatagacgcatttctctacacagataaaaataccagcaataaatcggaaaaatgtcaaagagaaacaagcgtattccaggacgtttacactttgtgtctgctagtacagacacttgcggtgcgtattccaggaccagatcgatccacacttggagttgtaaaataaaaaatccagcagagctagcggatgcttctggaatcgactccactcgactgctccagaaagatcctattacccgtctctctctcgcacattctcagcgtttaaaacatggcataaacttcgaaaaagtggttgacgcacaggtttcccaaaggccaggttaccgccgggcgccccggcggtaagcacggttactgcgcagtaaccataaaaaactgtacgaaaccgtacaaaatttatcaaaaatttaaattattttttaaatttatttaaatttaaggaggttaccgtggtttttctattaccgtacccccgtggtt

SEQ ID NO: 67761 - DNA, 36101 bp, Oryza sativa
  unsure (1)..(36101): unsure at all n locations
tgctcattctatgcaccagtaaacgcgaagcctattatgggcatatcaattaacaaggaagctcgtacttcttgatgcacacatgattcatccaaaatttccaaagcatgtcatattttgctcaatcagttattcatatcacatatatgagctgggaaaagaatatttatcggtcgggcgtactgccatcaaggctacaaattatctatagtaagaaagaatggtattatatacgtatataatgcaatgtgtccatgttttttcgtcaacatcttccagcagtgacaaggcacctcctatctgcgtaggccctcaaggatgtaagtagcatatagatccctgtagaacaaaaaccagctcaatatttggcgttgcatatcgcccaaggaacatatgtaggaattgaaactcacatggaatggcgtatggtctcataagcagaagtggcaggcatgaagtcgttgacagccacctccttattctcattcttcttgtctattttaccccattaaagaaaatactcaattcaagaagatagtagcactgtctaagtacatgtacatgcactaagtggccaagatgcagtaatcaacgaacttctgcgagagatacaattactaggcatccatccaaaaacacaaaccatatatgttccttgtcctttcaaacttgagaagctacaaataattcatactgcagtgataaataaggcaatgggaagctagctgagcttgtttcagtagagttccatgaatattttatgctctatgaatgcaaatagaacaagtacattaagagcaataaattaaaaggatacagtcctcgaagaaacgcctgatttcagctaagcggtgaggtgggaggtccttgatatcgttgtaatgcttgtactcaggatcatcagcacagactgcaataatcttatcatctgcctctccctggataaaaccttaccactttagaatctgttcattcattctgaagaaagcgcacttgttgagtagggaccaaacctgatcgatcattggcatgacaccgatggcctttgcccgtaggaagcatcctgggataactggctcctgtgtgcagtaaacattagttcaaaaccaccagatacgcaggaaaagggatcaattgttaaggattacaaaaatagacttgatagtggatttattctattgtgttgtgtaacaagtttcagtgaagggaccatgtatggatgggctatacctagatgaaagacttattgtattctgatttagcaacgtgcaaggaaatacacacctgcattatgaccagcacatccaaaggatcactatcgtcgcacagcgtgcgaggaatgaacccatagttgtgaggatagacgactgaagagtagagaactcggtctacctgagcatgttgcatggtacagaaaaggaaacataagcttaggaaaactgcaagtgcagaagaagatgagtgaaacatgtatctttacttttacgagcccggttttcttatcaagttcatacttgaccttgctgcctctcggtatttcgatgacctgaaaacaaaagtggctgagtattgctttgtcacataatgtggctttgtgagacagaacatgggtgggttgttgagtcagtgtcaagatggccatcatcagaagactgaatatacatagctagcaggttttgcatgccatccgcatgaactgtatggtgtagttaaacaagaacatttaagtgatgagagaatcggcaaaggcaagcagcagtgtcttacacagttgaagatggtgggtgcctcaggtcctgcaagcaaagcaaaggagggaaaatgatgaatttttgaacctaagaaatataatagaaatctgaagggtaagcgtgtaccccaagggaattatcactactagtaancgaaatactccaaagtgaggtggttgacagcagttagtagagtagagtagagaatagagttacgagtattttaccaatctcaaggtcatgccatgggtgtgctgcaacagatctcttgacatggatgagagtatcctctcattgagagctggtgccttcccctcgcgggtggaggagctcgcggtggtcgcgacttggagagggggagccatggaaatggaatattgaatcaaatcttaaatggagcttgctgttgctcgatgaaacaagcctgcatgacatagatgaaccaaatcaaacagagtactatgaatgaagtaaggaaggcaggaaatgacttactagtaagttgcaggctagcataggcatagcatggacaaaataaattaagaaaaagaaaacaaagccgagcagatcatactaggaactctaggagtagtattattacgtagagaggggatgggggcagagaaggttgcagacgcaccaagttgagacgttgtgtgttgtgttgctgcttggattggatgagcttgatctcctaattaggctgtgtcaggacagggaagaagaagatcagatggaagcaagcatgcaatggatggtttgtctactctggcggtttttatagagaggcagaggcagaggcaggcctaaaagtgttgagtaattgctgagtcagcatgggaagacggttggaagagagaatgatcgatcgatctatctatctatctatctatctatcttcctttccttccttacctacagggcagggcgagagagagagaccaagtctagtcagttgaatatgtatgtatcggaagttgggacagagctgtattgtatagaaactgaagttgtatgcatgtactgtatgcactgcacgtccgtccgtctgcgattaattgacctggaatcagtcgtccccgtggatctgtgctatgctatgccgcatactatcatactactagttgtatgaagtatgaaccgattaattgggttgggttggcttgttcaagcagtagctgtgtgcattgcagtttctacttagagagcgagcagtttacccgatcaacatgtcggccaccacggcatccaaatgaagaagatgtcaagatccattgttccaggccaggcccagtgttaaatgttactccaatgtttgcgcgttgaaccgtaccgtagtaggaggaaggaaggagaaggacatgaattaatcgatccaaaaccaaaatgtaaatctaatggaaggtgtgagcgagtgagtccatacaagacagtttaatactcctactaataagctgcctgaatccaacaaagcagcaaactacggagtaggagtatgtaagaagcaattcaattaggcaggcaggcgattcatcaaacacgtagtactcgttttcaacgatcattagctactacggagtactactacccatcaagtgatgaagaagaaagtaagtactactgtagaggggaggagctccactactggggtagtacagtaagccctagatgggatggaatggaaggagtagctgcctagctaggagtcggcgccggcgaggtcgtcgtcgtggttggagttggaggggaacttttgcttgaaggcgtcctggcgctgcatccacatcatgtgcccctgccattcaattcaatccatccatccacagatcgatctgagtgagtctgagagagagagagagcagccaccgcgcgccaccatggatgggatgggagtaggtgatactgatacctggagcgcggcagcccagacgaggaggaaggaggcgacccagaacctcttctccttcaccaccctcctcatcgtccccatcttcttcaattccaccccttccttccttcccccttgttcttcgatctcgatccgatctgatctattccaccccacccttcctgaagaaacaagacatttctctctctctggcaagtttggaattggaagtgtggggaatcaaagaattgggctgacgagccttgttcggcccatgcatacagattcattgttgttaaaaggaaggaaaaaggtacacccaaggtcccttaacttgtcatcgagataaaaaacatcctcgaaccgcaaaaccagatatgcggagtccctcagctgtacaaaactggtcacctgaggtccctcggtggttttcagcccggttttatctgacgtggtggctgaatcagcataggactcacgtgggccccacatgtcagacagtccacgtcatcacctttctctcccctcttttctcacctcctctctctctctctcttcttcttgggcagggcggccggcaagcggggaggaggccggcgggccggcgttgcgaggcaggagaggaggtgcggcaaccggcggaggcggcgggagcacagggggaggcgaagggggagcatggggagggccagctgcctgtctgccccgacaccgccgtggcggcgcgggccgtcgtggttgacgatgagcttggccctgatcgatggcagcgtcgatggaggcgaacaccgagaggaggaagacaagagaggggaggagacatgctccgttgccgctctcccctgctggccgccggccgcgccgttcacctctggtccccccccctgcccgctgcccgtcttcgccagcgagcgccaccgccgctcttctcccctatcggccgccagtcgcgttgcacgcctcccactcccccccggcctcttgcttcgccccaccctgccctgcccgctcctcgggcgcagcgccgcaccccgctcctccgacgagccgacctaaccgcgcctccccaactccaatgagaacgacatggatgccggcagcgaggaggcgaagcaggagcagcaccgggtgctagcccacaagctcttcctcctctcccaccccgacctcaacgacctcgccaaggttgccctccgctccgacgccctcgacgccgtcaagtccgatggcatggcgctgctatttgagtcgttggccgtcaacggcgtgctggagccggatgacgcgctgctcgtcgagatgcgcgtgcgaatcgatgaggaggtcccccaagccatcgtcgtccgcgcctagctcctcccccgccacccacgcccgccgcaccgaccggccgtgcccagctgcttccccggcggccaacgattcgatccaatccggcgagagagaaagggagaggatgttgctggggtcggcggcgcttcttttctttcttctatcctcttctcttctagtcgccggcagcagatggggagaggcagccgttgtcgcctccgcgcctctcggccttgtcggcagcggcggcgtcgtcctccaccgttgttgccctcctcacgaaggcctcggtggctgacgctgcggctggtgcccgccgccgctccgccggccaccgccctttttccgcgcggcctcgagcgcgtgtgtcgttgtcgggtgcagcgacgtaggtggaggcggaggctgacgctgcggctggtgcccactgtcccttctctgcccagcctcgcgcctgtgcgccatcgtcgtcatcggtgcggtggtggagcttggtcatcgacgtgccccgcctcgcccgcacagagaagacagagagaggaggaagggagagaggggaaaagagaggtgacgacgtgtcacctgacaagtgggtccacgcttactcagctgccacctagaccaaaaccggggtcaaaaccacagaaggacctcgggtgactggttttgtagagtcaaaggaccccgcatatctggttttgtggttcgatgatgttttttaatcccgatgacaagttaagggaccttcggtgtactttttcctaaaaggaaacctgcattactccagtatacgtaaagtaaagagtcgcttcccctggctccaagcctccaacaccaccatctttgtttcattaaaaaaaaaacagcaccatatatattctcaggcatcaataagatcatccacagttaaatcccccacaatccattccatgaagacctacatactcctttctcatgcctttcttttcttttaacaaaggaaaaggataatcaattggaatacatgttatcgccatgccatcaattcctcctaattcatcgacggaacaaaggcgaaaaataaccaaagtcttaattttgatgcattcgattgctggctggtacgttgtggttggtaagctgagtgctagtacgaagcatcatttgctatgcgtcggtactcaggcatgtgctgggtgacaatcatctgacattgattgattcccttaagttaataaaagacgagattacacagatgtttttatacgtgtgttccatcgttttcgttttcgttttcacaccaactgatcgaatcgcgcgctcaaacgaacaaactaacttgttgaaatgaaaaaaaaagggaaataaaataactaactagtgtagtactagtaacagaagaaacattttggtatcattcgatggatgagttgcctgacaagagcattagcttagcttagcttagcttgctgatcccctcctctatgatctgatctgatctgtctccgggctgtccatgcgcgccgccgtcgatttggcgtgcagctgttgcctcctcgggacgccatcctgatccaccacgccaagcctactactctgtcccctgcaattcaattcaataatataatcaagagggattaatttgttgatcaaattaattaactagtaatgtgttacgcagtatatgtaaataaaaaaaactggtacctgtgggcattgcaagaggatgatctcctgagggtgaggtcgatagggtgggtggttgtgttgttgtccagcaagcttccactgaagtagtcacggtggtccatgatgtccggcttgttgttatgccaagcagtagcacggcagcgttgtgattgtgcttggccctgcagctccttgatggaggaggcgccgcacgagatgagcttcatcagcatcgccgacgtccgcatccgccctgccggtgtcgtcgccgcttgttgctggggcgtgcagccatcctcctcctgttgcttctgcttcagggtaacaagctgggtggtggtgtcgtcggggctgcttgaagacggtggaggtgatatctcatcaatgccaattaaggactgctgcgccgccgccgggacagggacagggtcggtggtgcggtgatagtcggcgaggtcaaaggatgtcatgcacctcctgtgctgcgggggcgtattggagttatggtggagcagcggggagcccttgaggacatactcctcatggttggttgatggcgcggggatgaggtcgtcggcggtgaggtcttgccagacgtagccggcgttcctcctgtaggtggtcttggcggaccaggagtaggcggcgggcatggcggcgccgcggaggtcgctgaggcgggcgatgaagtcgcggaggtggaggcgcggccgcggatgatcggagtcggagtcggaggggacgtggacgtggacgaaatgggggtgatccagctgcccgtcttgccggcacaggtagtacaccacgcccaccacaacctgcttcatctgcttcttcttgagctccgtcctccacaccatcgtccgctcggggctagcccaaccattaccatcacctgacctgctatgacgactaggatttgccatcaaccaacactaccgtgtgctgcagaggcacaagatcgagtgtgtgtgtatgtgagtagaagaagaagatccaattcgaagaggaccgcccgagccgacggaggaacaagctagctagctaatccatcattctctctctctctctctctatatgcaactctctccgtcgctcaaacgcgttcgatagccggaatattttgggagtaaaaacaagtgtgaagaaggtagtcagcagttcacatgacgcatcacgaccacacaagccacatgcatcaatggccgtccgtctactatactagtactagtcaattccactccacgcgctcccatcactacacatgcatatgtacgggcggcacaaccggtcaaacatactacacttagtccacacctactactactccctagtactacagatactccatgcagaccagtgggtccagtcatcaatccgagtcaaacttgacaactggatggtcaactaacttcccatcatgtgtgtccctctcttttagcgggccgcggagcccatcaaccatgcatctgggctaatttatcctcaccacattaaccaaccgctacctagccctatcaggaattttttttattaaaagttttacaaaaataattttcaattttgaaaattgacataagtagtcgcccgccaccctctgggaaaaatcgccctcccagagggcggcaaatgtgacgtggcagacggccgttcgctctcgggcgacggccgtcaacgaaatttgcaagcggcccccttgccgccctccgctagggcgattttacactgtgcggggggccgcctgtaaatgggtggcgggggactggaattttgcacgcggcccccttgctgccctgggggagggcgattttatactatgctttatttgagaaatatatttttttattaatatcaatagttatcaaatctttttgtattgaaaattgcacgcggcccccttgccgccctgggggagggcgattttatactatgctttatttgagaaatatattttttttattaatatcaatagttatcaaatctttttgtattgaaaattgcacgcggcccccttgccaccctgggggagggcgattttatactatgctttatttgagaaatatatttttttttattaatatcaatagttatcaaatctttttgtattgaaaactatacaagattaaaatctccaagattggtaaaatacaattttattatttttttagggcctatttgaattgttaccctacaaattttttggtagtgccaaaatataggcaagttttggcactgccaaatctttggtaaggtaaaattgcatttgatcatatttggtttgctaccaaaatagagccaaaatgtaaaattgtagtgaagaatgttctacatgatcccaaatctagattaggtattaccaatgaataggcttcaatccaaatcaaacacaagtactattcaaattaccaaaatattagtagggcatgtttttggtagcaatccaaataggcccttagtcttacgcatacaaaaattcaccaccataattaaacattgtaatgataagatagataagaagtgccatcgatacacggtacaaatttgttgatcccgacgaatctagcctgcggtaacctatcggccccttctaggtcggtcagaatgcattgcattctcgtggtccttcaatcgttgatactctacttgtgtttctgactctgttatcttctggccatgatatgatggagtgacattgtcgatctatcgagtaaatccacacatccttggattgccctgaaaaaatagtaatgttattcagtttgggtagaaattttgtgcaaatcatagcggattttggaaacggttagacatacaacgaaatcgttgtctacattggggaagacaaaatatctccttccaaatgtttgttcagcaaaggatgtagccacctggcagcgatctctgcacccacactttggacgctcggaccatttaggtaaccctaatggattgttcctccaatctaagcttgcaatttccacccgatgttcgtactccatccaagcatgaatgaactatgtggtcggttcaggttgcgttatcggcccgccactggaagtaactcggactttgtcaatccattgtacgaattgacatttccttacatcctcttatgtacatccattttgggatagttaagttaatgatagtactgaggagtgatgaaaagaatagttgtaattaccacgaaatcatcgtcgacaatgtttggacacatgaaacacctttgtcctcgagttcggtgccttacggaccttatgacctgacaacggtcaccacaacgacactctggacgctcacgccacgtggggagtcctaggggatttacctgccattctaaagcctcagcagcaattcgacattcatgctcatccttccgccttaggtagtccgatcttgtttcactacgtgggtatgcacgtgttccgtcgttttgtgggttctccatgtctacccactcgatgaagttgcacattggacgatatgtctgcgtaagatgttacaattgtgtacgaagaagttagtttttttatccatttgaactttgaatagatgaatcatacctgatcaaagttcgcacattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattctcgttagttgtgtgctagttggaaagaagatatgaagaggttgccttcagattgtcaattatatagcatcgttttcagtgcaatatatgtgcactcaatgagatacattattcattagatgtgacaagacgagcacgcgcgggcgtgattcactttatgtcagcaggcagcgccgaaagttgatagtgactactcgagctgccgcttttcatgtgtgccgtgctggactgtgcgcgctactggatctgacactaccgtgaagcgccgaaagtgtgttgtcgtgagcataagttgttctagcaccatatgaatgaaaagaactatgtaggcgagagaaacacaagtagtactgcagtagtaatagcaaaagtagtattgctttacaagtttgtaagccaaaagaaacggtcacataaggactgaagaggtagaacactactgacgagacctcttacccctgtccctcctaccctgcgccctaacgtgcccctgggagtacgtgagtcggtccggtggtatggcacggccaacccgtcctgcctgtacaggtgtgacctctggctgctcctgagtgtgcacctctggagctcctccaagctgagaggagcctagtacgttgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagcatttcagtaattacccacatattaaattaatcattaaatggtctgtttttaatattgttaaatactttgggtgtccaagtatgttcaagatttttcttggaattatttgagcataggaagtatttttaaaaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcgacactgtttatcttctacctctagcagccgaactgagaccgatttggctcggtttttctcctccaaatctgacctttccccttgtgtttttctaaaatttagttgaggggaaatattcctcttatcctcctctatctttacccccaaaaatcggtgcaaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtcgccgtcatcgccgtaaggtgcgccgaggtgtgggcaagctcggccgctatctccccgaagccgccgaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcatgtcctccaaagtcgcagccgaccatccaatctccggcgaggtcgccatcttggtccggccattgatgaggtcatcatcatgacgtcatcattgtttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtctttttctttgttttgcgtgttagcttgtcgtttccgtcgttgcgaaggttcgtgagtgcgccggaagtattcaagaagattaattgaagatcgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgtgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtcacctctggagctcctccaagctgagaggagcctagtacgtcgtggtggtgcgcaccgtgcaagtcgtcgtcatagaaatggctagtaggaccagacctaccggcgtgagacgaagaggcaccagtacccaagatcccggctgcaaatcctgctggacaaggaccatcagtttcatacaggtatttaatagtattaataaaaattaaagtaccatgtgggcgagggatcgacgctccgtgagaggaagagctggcgaacgcgcccgaagaggtggcgaacgcgccggaagtgctggcgaatgcccctgcagagctcgcggaagcgccagtcgtgcctgcgaacgcgctcgaaggcagacgaggtcctgcgatgatgaaacgtgcagttaaaacgtggtgacgtattcgtgcaaaagctgaaacaaaaatgaactaacctctgggctgagctgtaccgtgcgaaaccggtgctgtaggtcgcactgctccgacgctaggggcgctcgaaggcaaacgaggtcctgcgaggatggaacatcaagttacgacggggtgatgttttcgtacaaaaacagaaacaaaacttaagaaacctctgggctgagcagtactgtacgaaaccggtgccataggtcgaggttctgctccgacggtaggtgcgcgaggccgtggttgtactggaccagctggaggtacaatgtccacggcgctgcgacaggagaagacgcgcatgaccgcacgcatcttctcctgcatccggtcgaaggtcatcctctgctcaacgtcagtcaagtgcaaacctctgttcaacctcacttggactgcggtgatatcggcactgatatctcgtgcggcatcggcctatgcaagatggaaataaaaaattcagtaattgtcctatattatgcaagataattgaaataattgtaagaactaatacaaattcgacgtacccccacgaagtagtctcggtcatggtgcatgggatacgcgtccgtgacagcggcaacgtgcggctctggggcgtctggagtgaaggtcacacacgcacgagtgcgaggaaggtaccggcgaaggtagtcacggtagttctcctctgtgtgtgggaagagctcgttgatcacctcctctgtagctaacacccagtcgtcaacgtactgttgtacacgtggagcccaaagtgcgcctgctagctgtccctgtcgagtcaacttgtgaagagaggtaaattatatggctcgatgaagtaattagcataaaaattttgaaatgaaccatccgaactcacgagtggtcggcagggaggacggtcggctgcacgttgcccggaaacacctgcctcagtccgaactgtctcatcacacactgcgggcagtgaggctcgacgaaaatgtcgaacaccatcggcaggatggggagccagtaagcctggtcgcatgtgcacaaggacgaaagtcctagcggtgctctcgcagcgacggcctcttctgtgtacggctcccagatgacgtcgctcggctggagacggtcaaactcaaacacaaagtccgggtaacctcgtctcacctggacgtgagcgtaacgacgctgcaataaacatgatcggaattagacatgttatgtgatgataaaaaaagaagacgattgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcaaccagcgaagatcgctcccgcgtcggtcttcgtgcacgcctcacagagggcacggtacatggctactagcacggcagaaccctagctccactgcggcacgtcctgtggctgagcatccgcgatggaccgtgcgtagtggaccagccggcagtccacagcgtgcccgtgggtgctagtgaacatcacccacccgaacaaccacaacaggtacgcctcaagggagcgtcggaccgagtaatcatcagcgtcagggtgcagaaggtccgtctacaattaagaatgaaatgttagtacaaaacaatctgttgatcgcaaaataagcatgtatgataataacaagttatttacttacagtgaactgaagcaaccaagccttgctaggcccgacggtagagttagggggaagggtgtcggccggtcctaggtgtggaaggcgcatcacgtgctcgaagcgcgcggtgatatcctccttccacccaaaaacaccgtccacgggaccaactggggctcctgccagtggtagcccgagcaggtacgacacgtcctgcagtgtcggagccatcttcccacagggaaggtggaacgtgtgcgtctcaggtctccagcggtctaccagagtggcaaggagtgaccggtctgcatcccaccgcttcgctgggtcacggtcgtccgccgccgcctcaacaagcctacaaagttggtagaaggcctgccgcacgcaacctgcatagagcaaactttaaacataagtacaagacaaagcaaagttgagttgaaatgtgaacatacgcgttccaaggaatgtgacgggggtcgacacgcaaccactcgcgcgacgtgcgtggacggaaggtgccgagctgtgcaccctcgactgatgacaggaacgagcagtggctcctgtcaatcccacggttgaacagcgccggtgtgtcgtacgccatacctacatccaatagatcgatcagaaacataaaaataattagttcaacataagtaataaatgttcataagtaaattactaacacatattaaacaagagtacaaacaaacaaaagtgtcacaatacggaatatttctgattacaataataactgcagttacacgatatgagtacttagtccgaacactcatcacgataacattatgatacaacaccgaataattcacaatactactagtacaacaatagtcagaggtactcattacaacaacattcaattgaaattacacgatagaagtatttagtccgaacactcatcacatcacaatagcattttatttcctaaatcgatagcattgttacaccatggaatcgcctgctgcaagacgacgccttggccttgcgcgcctgcttgttgttccttcaccaagtggtcgccttccatcacttgcctgtccagatggactagcatccgcgccgcttggaacttctgcattcttcgggcatttcttgtaagtatggccacgcagatcacacttgctgcagcgtaaagtcctcccacctgcttctgactcatccatatcatttctgatgcgtctagtttggcgtcaaccctttttcacccttaacttagatggatctggaatataaaaaactttgccactcagcgttgtgtaagatcctgagatcccgaacccatatatctcctcactccatgtatgaaagattgcttctttcctgaaataatttgagacgtacacattgggagatatgccacaatcaccggcagtagcaagaacgtgtgagcaaggaagttgatgaagctttggcttcatacaactgcaggtacatccaccatccgccttcaagacacattcctgcatggcttgcttgcgatagataccacgcctgctcctatcaacacaaattatttcataccgatgcacttgtgtgccttgagcaacaactctatgtctccgtgcctttttgattttatcttccatgtactttgtcactacgttgccaaacactatgttgtatcggccatggacggaccaattttcttgtatcgatccctaaagtaggcttgcgtgccgtgaaggatgaattcaacaatagcaaccaatggaagtacccgaactcctcgcattacccagttgtacacatctgccaaattggttgtcattatgccataccgagatcaatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcgtctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacattaggccacttagctggaagtcccttctcatcccaaccgttctgcaagtagtcaatagcccgcaacatacccgcatgacaatcatgtataaggcaaacgttgggcctcatacgcaccactgcaatgtgcactctctctaggaaccagtaccagctttcagtgttcccactctctacaaatgcaaaagccataggtagaacctggttgttcccatcacacccaattgctgtcaatatctgacctcggtatttacctgtcaaaaaagttccatctatgcatagaacaggtcgacaatgcacaaaagcattgatgcaagcacccaatgagaaaaaggctctttgcagcacactctttattcgatcatcaaccgatgtaaatgtatgtaggtcatagtaagtattattattcctctgggcaatggtggctaatagacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcattggtgctcggtcacaatgctaactttccaataatcattccatttacccttttatgcatggacacgccacggacaatcttccttcatgcacctcacttcatacacataatttgttgacttgaccaccctaaactctctctgcaaggaaactgcccaatgcttcaccgcctccttcatctcatccttatgagcatacctagcacccttaattacctcgttctccttatactcccagggtacatgatcaccctctgatataacaagtccagagaagtcctcatttgcccaatcagtggccattacatcaccttcctcattggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatatttctcttgtaccgacacaaatataacgaggggccatgaccgttcaaaagccatttccacataccgtctccaagcaacagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataattacgttaacctcgcatttctgtactacaccctaagttacattctctacaatattgttctccaaaattctaaaagtaggttacgttctccagatcaaactaaactacatcttacaattaacactactatctatgtctcaattcatactattatattctgtgctctggatctacacatgtgtgctgtgtgctatagatctgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgtcctcccctctctctctttcgttttttttggatttttagtgaatataatgaaatttgagagaggggggacggggctatataggggggaggcaaaaatcgccctcccccagggcggcaagggggccgcctacaaaattccaggccccccgccgcccatttgcaggcggccccccacacaatgcaaaattgccctcccccagggcggcaagggggccgcctgcaaatttcgttgatggccgtcgcccgagagcgaacggccgtctgccacgtcacattcgccgccctctgggagaaatcaccctcccagagggcggcaggcgactacttctgtcaattttcgaaatagaaaattatttttgtaaaacttttaataaaaaaaattaaaaataaaaaaaattcccttatctgcaggttacagcgagtaagcgacactactattctactataatgtatgcatgcttaattccaaacaagtgtactagtagtatttatttactaaacgagcataaacttcttttttcaaaataaatataattatgcttgacagttgttgtcgattgacaaacacttttaccaaagggtaagtttcacttgattatgtgtaaaaggtaaatggtaaatgtaataatctctccaaaattgtatcccctattacataacccttaagagtttatttatagcttgcatatctgggtttagaactctaagtagggatgaaaacggagcggatacggacggataatgctcataccatattcattttcatattttttaccggatacgaaaacgaatacggatagctcgaatacggaaacaaatacggattatctcgaatacgaataagaatcgaatatgatcggacacgaatacggaaacaaatttttctcggaacacgaaaaccaactcaacttctaatataaataaatatcaacatatataattagctcattttatataaaatgaggtataatttataaatattttttaaaatttaaataatattaatagtatggactagtgttaagagataaactactattaaaatctataaatgtatattgaaggttatagagttagaaagaaatggggtatgtctcatgggtcctgcggatatccgaatagcactgttcaccggatatccgaattattatccgtatccgacggaaaccctgatattatattcgtattcgtatccgggagaaaatatccgtattcgtatccgtatccgaaatatccgagaattatccgatccgaaaggtatccgtatccgtttttgtccggagcggacggaaactatccgctccgttttcatccctaactctaaggtactgttagtgagtttacacaaccgtctttgtgacatgtatgtttataagggtaatactagtcttttggcccaacctaccggcccactggccctaaaggtctcccctcctgggctgcttattgggcttccttgaacggacattttctcatactgtaaaattacatcaaattttagtatcctctagtaaaatttatctaaaagttttttttaagcataacttatattttgtgtttatagaaccttttgaataatgttaaaaattaatagcgtcatatattagaaaacggaggaagtaatcatcatcgatgattcatgtatactattcttttcatcattttaattaacggtgaatatcagaatatagacggtcctctaatccaaatcggccatcactgacgatgatggatggtgctaattaattaaatctttaaaatgtccacatatatatgacgtcgtagggcacgatagtgacatctatcgcagtgaatataattgtgacgacgctttgtcaaaaaaaaaaaaaggttgtgacgactccgatcaatgtaatggtggagtatatatgacagatgggcacgcatggagagacatatcatatgtttgtgtatcttgcgtcagcttccactgatatagtattatgtttaggagatggattttcattcatcgagagatatccctcgcttttttgtcataaaaacaatttttaaaaattgaactatatatttgtacgtagagtcatatatatatatgtctcgttaatttatcttgtccattcttttttttttgactgaaaacatatttccatcatgtcatctaaatagtcataaaaaatttaaaaaatttaaagttacatgtgtacggagtgatatgtctcatactaatctatcttctcaattctttttaaattattttgatggaaaagctaaaaaccatcgatagtttttatcgatttcacacatatttcacgcaccacacgcctggaccaactaaggaatgaacattttctgatttgaattgaaattacactttaattaccttgtaattatactataattacatgcaagttatattgtaattatgtttgacaatttttttttaaaaaaaactatgggtataattttagatgcacccttttttggactgtctatgtagtatttgacaaaaagaacccctaaaaaatctcacaatttttcaaccgtcatattgctttaatatttgtgtgcacctacctaatgaaacataacctaccattcctcatctcctctcccccttagcggccccacgacacgagcttgagtacttgatgccgctgccgccacctagcctcaatggcttgcgggaaggcgtcaacggcgcggcgagccccaccggctggcttctcccccttacctccctccctttcctccctctcctactcaagctggtgtctccccgtcatcggatccatcacaacagctgcccataaactagctttgcccttgccaccaacaccggcccatcaccctcctccatccccatggctccagtgccgccgccaccacctcatcatctgcccgtgtccaccgcccaccgtcggcccgcgtcatccctctaagctcagtgatctccctcctcttcccctagccccccctctcctcatccaaccctcaccctaacacgggaccctaaaccttaactcttctaccttcgttggggttgctgaagctggcggagctagggaagaaggtgttgtcagagcttgaggaggagaactgggatcgccggagcatgaatcataaagcaagtatcaaggttagtaatttgtaagattttggctccccaaatctatcgtcagctatttagctattttttattgattattttaaggtgacatgaggatatggtgagagggatgaaaatactttcccttaaatgtatcgatcgatggctaggaaatatgaagtattttctctatctcaaaataagttaatttagtatgggatgcgacatctgttagtactacttcctctgtcaaaactaacctcatattaggatgtaaacatttgtatgtccagatttgttgcactagtatgtatgacgttgactgtttttttaaggacggagggggtacgtactactagctagctagatgccgacggatgatgatggattggaaaggcaagtaagctggagtaggtggtactagctagctaggtgtgccacgcactcgcactgcacggagtagtactgctgctgcagagaggcgcacgacgactataaaaggagagtgcaggtatcttcctatagtagctagctaattgtattatactagcttgcttgttcaattcaatcgagcagtagctaattgcatagtgatcgatcgatctgtatagatggtggtggccggcaagaagcagggacggcattctttttctgcatcatcatcgtcgtcttcgtcttcttcttgttcagtagtgcagctgggtcatcatcagcgcccacagggtgaggaccctctcatcggcatcaaagcagcagcagcaggaggaggaggaataatgagaaagggcccgtggacggagcaggaggacgtgcagttggtttggttcgtgcggctgctgggcgaacggcggtgggatttcttagcaaaggtgtcaggtttgcgcggcggcgggtgatgagcatatgcgtgcgtgcatctaatctatcgattaattgttgatgatgtcgatcagatggatggatgcatgcatatgccgtacatagtagatttgatgatagtaactgacataaatataatgtatgcgtgcgatcaacgctggttgttggatcgtccgtcgtgtgtatgggtggtgtgtggctgatgcaggtttgcagcgcagcgggaagagctgccgtctccggtgggtgaactacctgcatccagggctgaagcgagggaggatgagccccgaggaggagaggatggtggtgcagctccacgccaagctcggcaacaggtggtctcgcatcgccaagagcattcctggccgcaccgacaacgagatcaagaactactggcgcacccacctgcgcaagctcaagctcaaacagcaaaagcagcagcagtccgacgaccaccacaacgacaacgacgacgacgacgaccgcaactcctcctcctcttcgtcctcctccaacagcaacagcaacctgcagcagcagccgcagccagaggatgagtcgtcggccagtggcagcctgcaggcccaacatcatgaggaccagcaccaactgttccttcatcctctctggaacgacgacatcatcgtcgacgtcgactgctggagcagcagcaccaacgtcgtcgctccgccgccgatgcccgcctcgccgctctgggatatcgatgacgccttcttctgctcggattattcgctacctctctggggatagtatatatcatccatcagccgccaagacgatgacgactacatcaactcgatcgatcgatgcctcctaatcatgtgggagtactcagctcatctcaattgttacatccttgctacagctgctaattactgtaattactagcttgcatatagggatcgacggaggaattaatatatacatgttagtaactcgttctatagcgcaacttgcagttgcatctcaatctctgatcagtactatataaatatatatatatgtaacagctgctagctatagctagctgcgtacacatccatatgaatgtgtgtgtgttcatgcttgtactgcctcttgtagtatatgcacatatacgtgcaagtgcaacagacggctgctggctgatatattttgatcagcgcgccacgtgcacgtgcatacgtttcttcatttctggcaaattcatatgtatcatgttatacactgaactgaatactgtattatgcttcacgtaccattttgtatatatacatatcagataataattttatggtggcttggtatggtaccgagtggaattaacagatgatcatcgttattcttttcgcacgcgcgcgaagcaagcatattagggcagtagagaatctgaatttcgcaaatagcttgcttacacagaatctgaataaatgcattcatgagatgcaaagccaggctgattgaattgatacccgcccgccgcgtgaatcttaataattgtgtctgtacatgcagatgcatgagcaacatgcatattgcctcctacctgaaaactgtggagcgattgcaactgatacgtactatatcaatccaagatgctgcgtactacgtgctatatacagaacaacaagattaggaggacagctatctaaatagctactgttgccacccggccggcgattagctatacaagcaagagaagatcagaggccggacaggtacgtgttccttttccaaattccatctcaactgtagtcggcctgaatgagcgagatagatagtagatggagggaattgggtgatgtgtattagctagctagctgaaggtcagccactgccactgcccctgcaagttggagaggaaaagagaggccccaattcaactgcttccaagctagatagcttctgataagccacctggtttttattcttttcttttcttttctttctttctttctctccggccggccggcctttaaaaaggagatcgatcatatcgatgacgatccaacaagatgaagagctagctagctagaaggtgccaagattaaagtggtagagcatatagatatcgccgtacgtgataaggagccagcagcagcttggtacctttgtgcaacttgcctaatttgctgtaattctctcatattacctagcattatcctgatgattagtttactccaactagctagatagtgcttcatcaccatgtagctagcttgcttgctttagtgctgttgtcttgtcttctagcgtgctgatagctaacctcacgcatgcccagcctcatctcatctgatattgatcctcactttcttcttttctgacccccacaatgctagctgctgcttgcaatctcttgcaattttttcttttcttctccttcctgccggcctccaattcgatagctacgtctagcttgacatgggatagggatatgatatatgcactgcacaagaatcttgcggccttcctgtttcttctttttatcacaacatccataaagtcgctttctgtggggaaagatggttgcaaaagtattactactaccctctgtccttcttagcttaagcttagggtcaaatcttctctcatcatatattccaaaaggaagaaagaaaaaacatatggatctagtgacacgcgcactgaaatcatacaggggatttaaggttccttgttttgttgttcacaatatgtgttagtagtttggatgtattttagatatagatagatgcttgttaattagtattccctccgtttcatattataagtcgttttaacttttacccacttgaacttatttagacttgatcgaatttataaaaaaaatagcaatatttacaacatcgaattagtttcatcaaatataatattggatatattttaataatatgtttgttttatattgaaatgttactatatttttctattagtcaaacttataaaagtttggcaaaataaatcaaagtaacctataatatagaacagagggagtagcaagaaagaaaagttcgatatagtgtataccgcaattctgaaactagtatattatgcatgcatgaggataaaagggaggaaatggttctaaacttcgaaggagcgtcccatcgttgtttgctgtgaaaaagctagttaactatttcatctgtttataactagtaatatgtccgtgcattgcaacggatgagatccatataatataggctaggaaggtggattaagatgactagaaaagtggactgaggataaagcactggaggcggtggttacatatacaaaaccgtagaaattaagatgtgtgcgggtggtgagaggaggagataaaaggatgacgactcccttttaaatagtagagatttctcattagtgaacaaaaagctgacgtcttgaggattcagtacatagctgacacttgtgtctctagatgtcttagtgaaagtagaagtgcacttggaacatactataagatgcatccatgataggcagcattgacacagctttcagtgcaaagtcaaacaacatactccatatagctaggctagccctgcatttgctttcttgttccatataatcttacaccttgatgcatcagtggcctatggtctgatcatggcaaaagaaaagtacagtatattccattcccaagcataattcaggttcacctttttctaggcagaaaattaagcgattaataatagttaataagtgtctgacagtaactagctagctagtagatagagactggactgaactaatcgtcaatatatataattgatttgtcagaattaaggagcaaaactggagctgcaggtacatatattacaggtagatgtgggcctatcctaaattctaatttcggtatgcctgtgagtgctgatcaaattaagcacttaaagattactttattgtggtgccatgcacgcagtaagtagctaatcaaaagtgagcagagctgaggaatcagccatcaggcatatcatgatggatggatggatgggttagccttgcatcgatcattcagttaacacttaacacccacaaaggattaattcaggcagacactgattcaacaagaagcaaggcatcagtagagacgacatgcactttagccactaatataattactgggtaagtagggtcttcattacaacgaccgtcccattgatcatggaggagggctacgcaagcaagcaatgcaagcgcatgattgtttttcgatcgatcacgtcactgacgaacgcatatccatcatcattcatatccatccaacttgcagagaaaagatcacgtcgatgttagctcaaggcaggcgcaatacactacagagtttaattaattccaagtggccttgccgattggttatataattagcgtgtataataacaaacgcaggcaggcattgccattgatgacgatatcgtactaactaactagctagacaattgattgaattggatgggcttatccacgttttcaaatcaccgctcgcaatttcgttaggatctatcatatcacacatgcatactggctgcgcatgtcgatcacactagctatctaatctagatcgatttgtccccaatggcagacaacatgccatatgaccttatcatcgtatatatatctcgttttcgctggaaggtggagcaccccctgcctacatgtgtttgtgaaaatcggcattttcacatgcagacgtcacaaccacacgcaaacacgattttcacatatggacgtcctaaggaagctgcttggaaaaaccgatttttacaaccgaccaagcaagaacaccggattgcaattttttttaaaaataaaaataaaaaatcaaatccaaaaccctagccaaggtccccgtaaggctaccgccatcatcgagcaccgccacaacagcctgctgccatcgcgtggtccaatgtcgatgttgttgttgcgtggttgaggtcctcgtcatgctgtcgaggtcgaggtcttcatcgcgcgctcattgacactgcccttgtgcccgatggtgccgtggatccgccgcctccggccaccaggagacggatccgccatggctggagccctctcgactgatcttcctctcccgccatcagaggggtagaggtgtcgccgctaccagatccacgaaatgccatcgtgggtttgccgccttcgggctagcaggagacagatccaccatggctagggccctcctcgatggttcttcccctcccgtcatcgaagagggagatgtgccaccacctatctctgttgtcgtcgtcaccgctgtcggcctccacagtcgccgccaacctctatagcgatcgctcccatagttagccgctcctggcaccaatgctcctgtcattgctcgatggggaagagaggagaagagaaggagaagtgaagggggagagagaagaagtgaaatggattgataaggagaaaagaaagaaaataaataatggggaatggagccggccagtcgtgcctcaattttcacatacaaacctcttaagatgctcgtctgggaaaataatttattattgtagacggatctgttaagagacctacttgtgaaaatttaaaatgtgggccttgatcaaacacctctcgcacatttttataagcgggtattttttttcctccttagtaaaagtaaaagggacctacacatgaaaatcctttttaatagtgcttgccactgcttacgatttttaagatggaggttgttactacttcattgcagggccaggggatccaaaactaattttcttgtttgggaggggcaaaaatgcactatgctgaattaaagagcatgcggttagctatatactagtggacgacatagaaaaaaatttcacgcggttgcaatctccaagtgatatttatcctttactatagttcgaaatgttagtgcacacatgcaatgcactaacaaagctttccttgtcatactagtgttgatccgcttgcgattcttcttgaaaaaaaatgtagcaaaactcatatatatataatgtaaaaatctgaaaactatatccatgtcatctagctagagaaaacttttactctcaatttttttacgcatgattaaatttaagggtaaaattttactcttgataacaagaatatatatagaatgatttacactgtatattttacttccttctagtccatatataactctctgccgtttcgtttcgattggggaggggggggattcccacatagacccatctgaaaatgatcagtgatcgatgcctagttaattatcctattgcaatactgctttcttttcttttgaagatgaagataaagattaaatttttttttgcacaaaacgaggtggtattaacgtatgattgattggattttaattataacaaactagaaaaaagattaattaatatgatattttagagcaactttcatatagaaagttttcgcacaaaacacattatttagcaatttgaaaagcatgccacgaaaatcttaatctttatccaactcttgttggagaaaagaacgggacctaaagtagataattcaaaattaatacatgaattattcattctttaatatgctcgaagatcgaagaaataccactagtttccgtctatttaaacgtacattacgggatgcatttaagaatgtgtgggtgcgctccgttctttttaaaaaaaaatcaaactaagaggagatatgacccctcctagtataacgaatctaaacaaagggctatccacattagttgtaccagaagaggtcacatttcctactaggttagcttttttagggtggagtgagtagtgatgtgtgtgtgggtgcgtcatataataaaaaaatcgttagatactccagaaaagagtagcaactaactagggagcaccaaggcatatttagtacttgcactagtagagtagtagtagggagtggatttttatctctcgaggggacattctctcgttttatgcatggtgtttaaaaagttatcaaaaaatttagaaaaaaatattaagatagatcaatatatgatatatcttttcgcaaacttgcaaattaaaattcgacttatacaattcaaaacaaaaataacaaatttgaccatgaattacgcgttctattaattgtcaaattcgttatttttattcctacttgtataagttgaattttaatatgcatgtttgtgaagtgatatatcacatattgatctatcctattattttttaaaaaaaaatttgatggctttttaagtgacatgtaaaaataaggggatatcccataatggatgaattgagttttcggtagtactagtagtgtagcctgtagttcttttttcccccttgaaaaggagaagtaacaaggtgaacaggcctcctaacacaggttgagagtaaaccaacattatcccaccaaagttttacggaataagttcatacgaggtcccttaactttacaccgaatccgattttcgtccttcaactcaaaaaccagatacaaccggtccctgctctatcaaaatcggtgcaaacgaggtccctcggtggtttgaaatgcggttttggctaacgtggcgccaacgtggccggtttgacttggtctttgtcccacgtggcatttgacgtggaacttacgtggcaattcgattccggaaaaataataaaaatagtggccccacatgtcagctacacaaaaaatataaaaatggtggggcccacgtgggccccacctgtcaacctcgcctcccttctttcctctccccctctcttcaccagccgcacgccgccgcagaggcgctccacctccggcgccgacgactccctcagtctgggcacgtcggcgaccgccaccgccaccgagaacgcctcccaccacagcacgtcggcgaatagcggcgtgtacctatcggcgaccagcaatgtcacgcacaggcgacacgtcgtcaccgtcaggcaccttcgtggtcttggattgcgaacaggacgaggaagcgcttcgggaggtggagcgcaaccggaaccacaagcggcagtgggctgcccaggggctggcggggcggcgctgggcgctaaagatgaccgagatgaggccgctcacgaggacgacagcccgcgtcattattcttgattctggccaattaattcttgattctttctggatgcgatgattttagcttgagcaagcagtagatcttgatactgtaatggttactcggtcgctgccgtcttgcttggcactgctcgtcgctgccctggtagcagcagcagcaaacaatatgcgagattcttcagggaaataccaagttctggtgctgataggcggcgccatggccgtaacggcagcagtggttgcgtcggtgatgagaagctgcaggggtcgagcatagggatctcgatcttgtccgcctcctcctccttgcttgtgttgctctgcgccccggctgagttgccgttggagcagttggccgtcgcgcggtggaggacgacaacggcgagggggacgggacgagcacgtcggtccaggtcgtcttcttcttgctcttgcccccacccttcttctgctccggcaacacccgcttcttgaggtgcgtgctccacctcgccgttggcgtcctctcggcctcatcccgtcgccatctcccaggagctcgccgccactctccactgctccgcccgccgcccctctctccgcccgtcacccctcggcgccgcggtgccgtcgccccttgcccctcgcctgtcccggcctgctccagccaccgccgcttagctccgctggcctgctccagccaccgctgacatgtgtgtagctgatacgtgggtcccatgatttttattttttaagattgaattgccacgtaagcgccacgtcaataccacgtgagatgaatacctagttaatggagccacatagacgccacgtcagccaaaaccgggcataagagcaagttcaatagtatagccaactactagctccaaattatctatagccaatttatataatatttgcttactatactataatatctggtcccacctatcatacacacattatgtcttggagtccgtgctgcagctggctacagatctgtagcccactgctcttctctctctttatttatctctttaaaatatgtttataactggcttattgcccgctattgtacctgctctaatactgccaagggaccttgtttacacggttttgtaagttgaaggatgcgttgtatccgttttgcactcgagggacgaatttcgaactcagcgacaaattgagttttactcatcagctccaaatttccagtaagtggacaaaggaatatgggcctatgggccgccgaagttctggcccatccgtccaatgagatagatgggtgaccagttaattgggcctcccgtacgttgaaggcctgaaatatttaggccacggaaagtgctagcatgacatgcgtgggtcctccctatgaactaattcacatttaacaccgtctattcgtgagtatgttttacatgaaagggatcatctgagggggcgtctagtatgcggatattcgcggtcagcgaacgttccaacagcctctcgttccaacatccgcacctggtttctgacgcgcgtgcaacactgcaagctagccaagccagcccatgggctttaacctgccttttctctttgtaccatgccttagcccaagaatgtcttgatcaacccaaaacatatttaggaaaaagtacaccgaaggtccctcagcttgtcatcgagttacaaaatcgtcccctaactgcaaaatcggatacaacgcatcctccaacttacaaaaccactacaaactaggtccctcggcggttttgaccccagttttgtatgacgtggaggctgagtcagcgtgggacccacgtgggccccacatgtcagaatgccacatcagcaaggtctctctcccctgccacgtcagcaaggtctgtcttccctctcccttcctctctctaatctctatctcactcttctctctgggcaggccgtccggtggtggagaggaggtccgacggccggccggcgatgctggagaaggagcgacgcggcgccggcaggccgggagcaagcaggcgccgcggcggtaggcgcggaggcgggcgccgtggcggcggttggcgcaggggcgacggaggatggaggaggacggtcggagcgaagctcaacgatgcgagtcctgtgacgagtggccacttgcgataggggcgacgacgctcgggcattcccggattggcccggcgtgactgccgctctgattgagaccagtggaggcggttgcgctccgatgtgatttggtggcgagtaaagacggagcgagctttgcctctatgtggcggggctagggtcttctagcgacgaggcggcttagggtgagcagcccgcgggcggcatcatggttgggacttgggggcgcggctaggcgagggaggaggttgttgtcgagcttgtatgctgttagagaaaggagagagaaaatgaaatcgtgtagctcgaatttgtatgctgttatttgatagtatctgcaggtatgagtctcgaagctgatgagcattcgatgattaaattttagttgcattgcatcttcaaacagtcccctcagttcgtgcttatatgatttatttacagaaatgatattgtagtgtttgaatggattcaggttctgaagagttctggagcttattaagagtgcgcttctggcagcactagaaggttactgttttgaacgcttgaaacttactgaattattggttgcttgaactgcgaattgtgagcgagtataatttatgttgctcctcagttgtctttttctctgtgcaacagctccgattccaggctccctgtttagacagtatgatgtacaaggtccaattccagttataaaagatgtttttatccctccagacacagaagaagatgggctgcctgctgcccttgaagatgccatgcctctaatttcttttttggcccctctatgtaagaagtgttacagtttgtttagtcaatttgaacatgtaataatgacaagataaatttacgagcagatcgacacatgcaaagatcgaattgctgctgcccttgataaattgcgatttacgacatacatcttcgtgggagcgaggtgctgcttctgggcaggaacctgatactgttttacttggtggccgaggttttggagcagccatgtctgctctaactgacgccctcccccgacgtcctgcttctctccgccggccgcctcctgctctgctcccgccgtcgcctcacccgtgtgaagccgctacacgccgctggcgtcgctgccgctggagccgggtccacgtcccgccgccgtcgaggtcgcccacaagccacatccggcggagaggaggcgcccctcctctgcccttttgctgcctgacccaggcgtggtggcctcctcccgtcgcagctgccgccgccgccgccggttctcctcctctcccgcctcgtcccgggtgacctcctccccaccccacccgtcggccggcttgcccaaaggagaaaagcgagaaagggagagagagggttgatgacgtggcatcctgacatgtgggtcccacgctgagttagccgccacgttggataaaaccgggttcaaaaccactcaaggacctaaagcgaacggttttgtaagttgaggtatgtaatatatctggttttatggttgagggacgattgtgtaactcgatgacaagttgagggaccttgggtgtactttttccaacatatttatacctagactatatacttcacatatgtaaactatatacaaagaaagtttgtacatgtaaatttttttcatgtaaattttgtacatacaaatttaaacaatgcaacagtgtgcaatccctttctaaaagaatatttatacgcgaaaaaaaatctatacatagaaactttatacatagatattttatagatataaactttatgcatagaaaatttctgcatataaattttgagcctataaactt

SEQ ID NO: 67762 - DNA, 10059 bp, Oryza sativa
gtggatctgtatgtcaacaattgtcgtttgtgtaccctggctggtcctggacagggatttaatgcacattcagcttagaaattctggttcgagaatttctgggcgtgacaaccgccttgagagaagatgtcgacaagaggtgaaatgttcctagaacttcttttgctagatggttcaaattacatatctttgagtactcgtgtgcttaatgtgtttagggccatgggtcctcatatagagcgagttgtagatgtgagtatttctcctcctaatgataaagagctatcatttgatgaggaagagaaatgcacatatctcaatgctcaagctactaatgttttgtttagtgctttgagtgaagatgtgttcaaaaccattattcttagcacattagtttttgttggaaacatagtaaaaatacaggcacccaaaacctacccctatgagcatgttcgaaaaactaggccggtatattttaagagtgacgaagtcatcacgggcttctcgttatcgatgggtatgtcgcctaacactgagcaccagtgtcaaatctaggatttgagttgaatgggctgattacaccacaagaaacctaatcagttgagttacgctaacctcgctcagcacattaatttcattgtacaagaatccaagcatttttagcaagaacgggtataatagcagacaataagccatctataaaaacatatcgaggagataaaagaggagagagaagagcagcgggctacagatttgtaaccagctgtagtacggacttgcaagacgcaatgtgtgtatggtaggtggtgggaccaggtatcaattgtgtagtatatgtttataagtaactattgtatgtattaactattaaattgactatagataatttagagctaatagatggctatactattaaacttgctctaagtcagatgcataggagagaaatataaacaatttaatatttacagtagtgctaatccgcgcgttgcgcgtggaatattagttcgagcaccgcacaacgctccctccttccggttttcccttttttaccaccccacctttcctcagttcgttttttaccaacccacctcccgtgtttcttttttctcttttccattttgtcgtgcttcatcaaagggcctggtaaaatattaaccatccagacttttttgtttttgttcattctatccagtttttctgttttcgcatttttagtaaaatatttaccatctagtttttcttttcgagttttctgtttttctagtgtctccccacgttttaaaagtaatgaatttactctgtggagtttttccatttactctcagcctcacacatctgttcattaaaagtaacatttttactcgtatgaatgccccagttaaaagtaacaaatttacttgcatgaatacccccacatcgtacggcaccattcttagatggtcataaaagaattactaccaccttataacgctagtaattcttttactagtgttataaatattgtttagatttcatgatctgcgagtaaaacaattaccaccctcctctcaatatagcacatgatctcgtagtcaccgtgtagtaatatatttactgatgtattcaatacacagtataagagtaaaatttgagaccaagagtattgttaatatgtatcacaaaatgatcgtgcgaatgaaaaaagtacaggctcaatcacacacgaatgataaaattactcacaggtgaatcaaaatagaaaagaaaaaaaatgattcaataaaaaatccatcgtgaagccgggatccctagtggcttagctagatcttgctataaggatggaaaggttggtctgtgtcttgtgactgatagtggagagggcaaccgggtggcgagcggtaatcgatgatggaatcatgaaaggatgtagcggcgtggtatagagatgagcacaacgttgtgcagtagcagccatccatcatctagcaagcacaaaaaaaatgcaaaaacattatcattcatgtcatagagacgacgagaaaaagaaaaatagcaaacaacctccatcaccggcggactccaccctatcctctgcggctagtcacatggagcacgatatacaaatgtaggacctgtgcagcccatcaattcaaataaggtaatattggatattgcacgttaatttaattggcaaaaagaaattggggctttacgcgtgaaggtgtaggagagtatgcagatgcaaatcgaaatgtcattttcttacttgcttcttctgtcaatgtcgccgacatggagcaaccactggttgttgctcttggcccaggtgaacacatccttattggaaaaatagaatatatactgaaagtaaggaagttgtttttattgaagtaaatcatttactctgataatggtgggagcatgatgatgagacatagggtgggatcgaaagtaggaaagttgtttttatcgaagtaaatcgtttactccgataatggtgcgagtgaggataatatgatgtagggttaggtgggcctgtgctgatatacgtttggctagtagtatctctataatagttaactaataagttgaccaataggaaatatttttgactgaccttaatctttattaaaaggaaagtttgatatggagagtactaatatgtactccctccgtccaaaaaaaatcaattcctagcatcccaaggtagtattagtggagagtggaaatgactataatgcccttaattattgaaaaaaagtagtaagagtgatatatataaagggtattgaagaaataaaacttctcgttttacgtgctgagtgtaggtaagatggtagaagttggtttttttgataaaatttaaactctagaagttgagtttttcgagggtaggtaggatggtagaagattttttttttataaaattcaaactctataatttgaattttttttgacgaagggagtactcatctcgttccataaaaaatagtataggatatgacatatcatagtactataaatctagatatacatatgtccagatttacagtattagcatatatcatatctcgttatttattttttttatgggacagagagtatttcattgtttacacataaatatccgtgaaatcctctttggaagaatgtccgcataagcaaaattcagcattcaccattgatgtgacggatcaagttgttaaaaaaaaaaagaagaaaaaaccatgtgcgcgcgtttgagagacgaaagccgagccgagcaagctgatacggataggcagccgctgatcgaaccgcgcatatgcccattgtttgtttgtttatccgtcgtaatctctcgcttacaaaaatatctcccttctccgcatcactcactactcaactagcactactactagtaagcaagcagcagataagcatcactccctcccactccaaccaccacatcagcatcagcaagcagcagcagcagaagcagatcgatcgatcgatcgccatgagcgtggtgatcctggacgggtcgacggtgcggggcttcgtggcggacgacgacgccttcgcccgcagcgtcgacgcgcgcttcgaggcgctggacgccaacggcgacggcgtgctgtcccgcgccgagctccgccgcgcgctcgagtccttccgcctcctcgacggcgccgggttcggctccgccgagccggccccgctccccgccgaggtctccgcgctctacgactccgtcttcgagcagttcgacgccgaccacagcggcgccgtcgaccgcgccgagttccgcgaccagatgcgccgcatcatgctcgccgtcgccgacggcctcggctcccagccgctccaggtcgccgtcgacgacgaggggggcagcttcctcctcgaggccgccgagcacgaggccgcctccatcgccgccaagatcgacgcccagcgcgccgccgatgccgccgccgccgccgacgccaagtgacgccggccacgtcatcgcaaccgttgcatcggatcgggcttgtttttttttttttttactcttcacgtgtaccgtgtccgtgtgtgtcgaggtgtcggtgtacgtgtacgtatcacaggtggcaacgtacctctctgctacgcttatcaaactggagactactctgctttgaatggaaataaaataattttctatccactctaaaaaaacgtcatttatttgtactcattgtctttttctttttcacgctactcaggcctttctgagttgaggaatttttgaattttttttatggttgtcatatcggatatacacgaatacacatttaaagcattaaacgtaatataataataaaacaaaggcacagatgccaccagagaaccgttagacaaatttattaagcataattaatctatcattagtaaatatttattgtagcacactttcaaattatggagcaattagttaggtttaaaagattcgtctcgcaatttacacgcaatctgtatgattagtttttttctatatttaatacttcatatgttccaaacatttaacgtgacatggtgaaaagtttttattaggaaagtaaacagagcctaatttttactacagtaagtctttagagttgatgctgatcaatcctaggaatgctatctggcacacatacgtactcgcacgggttagctggcgtcgccttcactgcgccacatgttttccatctgtctttccgcaatgtttcctccattctggcggccgctttctgcgatttttttctctattttggtgtccctcccctcagcgcgcatttttcattttcttttgcactctttccctttttttttctgaaaaagtccattatacaccctcgaacttttatacttgtctgaaatacacccccgaactacgaaatcgggtataatacaccctctaactgtgaataccggatacttgacccccttgggctgttttaccatggattttacacacgtggatgacatgtaggatgccccttcgccacgtcagcacttatgattatgtgggccaagcccatattgctgggttgttttgacgttgctttttcacgagcggcggcggtagcggcactgcgaaggcagggttgagcggtcagtggcgcgcatctccgacaagcagctgcggtcgtcggcggaggagttgtcgcaggaaagtagcagctccaagccgctgcgcgcggtcgtcggcggaagccgcgcacgaccgcagagatggctaagcagggagcaaggaagaagcagctccgacacaagcgcgatatagacctcgtcacctcgacctgtctcttgtgacctgtgtgtgatgcttctcctgtttatcacaactactcatatatactgctctccctccgttttaaaatgtttgataccattgacttttatatactactctctccgtttcaaaatgtttgataccgttgacttttagtacgtgtctaaccattcgtcttattcaaaaaatttaaagtaattatttattctttttatatcatttgattcattgttaaatatactttcatgcacccatatagttttacatattttataaacttttttaataagacgaacggttaaacatgtgctaaaaagttaatggtgtcaagtattttgaaacgttgggagtattactaatctcggcaagctagtacgttgtgctgctagctactcatctttgcagtcatgagcatgtcaatcccaaggctaaacctgttcggcttccacgcctccaagcaggactgcaggagacgacggactagcacaagcacgagcaggagcaggagtagtactcgactgagccggagaacgcgctggtctgcggcaacggagacggagctcgatcgcagaggaggagctaggcggccagcgatgacagagctagctcgtagacgccggtcgcgccgaccacagtctgatggaggcgagcccgctcctcattgagtaaatctcgagcttgcttccgccaagctcggcgaatgggtgcgccaaactcgcggtggtcatggcgctcgagctcctccccgcgcgtgtatcttcggcgagctccacctctccactcggagctgcttcgtccctgcgccgctcccttcgccgaagaacgccgcccccactgccgcctccgccaccaccgccgtaggtgctggagctcgatttggttgcaggcggcgaatctgcagctccgtcagggacaagatgtagcaatgagcttgccgatgggtgtgcggcggtcctcgctgggcagatggatgagccatgcgcccatgccgaaggagagagaaagagagagagatagagagagagtggggaggaggaagaggaaggatcggactgacatgtgggactaactaatctatataggtggcatcctagtgtaaaaaacccgaaattttcacatctaagcatatgcaaccttctaattccaaatatgagtaggtaatggatggagttatatttttaatcaagaagcccacatgtgtgtgtgcagtggtcttccatcggacttaatgtcaaacgaaatataacaaactaatggctgctgatcattggacaaatcactagctcgtaggacttgtttaggtctaattgattgtttgtcgtcagaaaagaaaatcttattaccatttgcaattggttggatcaaccattacgagatagggcaccgtgccgtcatgccgttagtctagagctttcttcgtcttttttttttcttaatccatatttgacttggatgttgttttcgttttgaaaattggaactgtagcggtcggttgaaatataatccatctgcttggatcatcaaaatcataatattatgtgtgctaataaatcttgatttgtttcacatagaagctgcatcaacaaagggtaattataatactagcgaaacatattagtggatcatttgctttgtgcctgctagctagtttgattagaaagagaatccaggacaatacatgctcacatttggaattatgaggtcgcatgtgcttagattaaaaaaattcgatacaaaaacagtgtagaaaaccacttaagggggtcttttgcacagtattgaaagtttgagggggtcaaatgtccggttttaaagttgtggggtgtgttttagacaagataaagaattagagggtgtaaaatagagttatccctttttttttaatctgcagcacacgtgttttcaagttttcaagttgaaagttttgaaatcttgactcgaacaaatctaaactaaaagttttcaaattttgagttgaatgtttctaaatctgagttgaaagtttttaaatttactttcaaatcaagatttgaaagtttcaaattctgagttgaaagtttccaaatcaagatttgaaagtttcaaaatccgagttaaaaattttttagtttcgtgttgaaaattttcaaatcaagatttgaaagttttaaaaactgagttgaattttttttaaatttaagttgaaaatattcaaatatgagtttcaaatctagacttgaaagttttcaaatcttagttaaaaagtttccaaatcctgaataaatctgatttaaaagtttgttcagtcaactaaaaaaaaggaaaacacacgcgcatggcgaatttttatcccaaagaaaaagagggaaaaaaaaaggaaacgcatgagggagattttttttcttgatatgaatctataacaacacgcaatagaagggcgtacagctgcgccagttagccagctagcgcacgcgcctattagtagcccccgatctatccaaataaaaattaagtagtatcaaaatttggcactatcaggccacgttcggtattccattttggtacaacttccttatttttcattagcatatgcttcgtgaacggcttaacaatatttttcattatttaaaaaagctttttatataaaagtttttaaaacattcaaataaaccagtttttgtttttctaataattaatactcaattaaccatgtgctaattaacaatacgttaatgcaaaagaacgctttagttcgtgagtgctagagttggagaatttgtcaaaaaccaggtacaggattcccagttttgcacatttgctcactggatgcggcaacaagcttagcgtcaaaaatcggccggagcggatttgccacaaactgtggattactccggttgttaccgatgaccatatgcacttgtagcactagataacacaagctggaatcaagaatatgcatttaccatcttgcaattagcctttaaagtagtgctccctctcgttgcatatggaacttgggtctaggtttgtgcaaggaattaagcaaaatagttcaaatgactaggttatccttgagttaccagacaaacaaaaatactaactacagaagtaaatgcagataacacagcagcctatagcgtttatagatcaatttacaaaaacaggtgattgattacatgtggcaaggttctataaaaccatgactgattacataattggagggtttttaaggcaacttggtaatgggtatacaccaagagtataagcaaaaggcaattaggtacatcaaaagcttcaggatttctgtacccacaacatacaaattagccatctgctcgacagttcgttcagtcatagcttacaataaaacaaactataagagtttatctgacagaggttgcattgcatataaactgacagcagactattatcaggtagatacttcataagccaaggatcaattgccacgggcacaccggagtgcgccagtgagggtaaaccagaaccgcccgtgtcccgcgatcccgaggttttcacctcatgacggggacacggtggttctggttcattgtggggtggcgatcagcggatgcgaagctgatgtgctcttggtgagccagcatgccgcccccaaatgagatgctggagatctcggagcctgtcggtgtcgatggcgagcaggatgtgctgttctctgggcacaggttcttgccaaggacaacggcaccgccgctcgttctggctctacctgttggagactgagctgatgccggtggtggcttctgctgctgctgctgctgctgctgttccagcagctcctttttggtaaggaaccgaccacctgatccacgggctcgcttcatagcatgatgatgtcgagattcatggaggtaaggctgggaacataatggcatcacaattattaatacaatatagaaaagtgtagttacagacagcaggcaggaaggcacgcatgcaggaaacaaatgcaaccaaacaaggactaaacataagtggctacaaacaaaaactaagaatattaatttcgaatcattacagaaaatgtaactgcctctattgatgtttgcaggtaaaggaatgttacaagcataaatgatacatctgacatcactaaaaaggactaatcaatgaatagtacctggaggattaaatcatctaaatatgactatgtgacactgcccaagcttgtagagattgctaggaccaaatatgaaatgcttcagccataccttcagacctttcaccgccttattttgggcctccaattttgcacgcgtttgccttcttctaaggatcgcattgtattgctttgcattgacaaatatgggctcttctacagaaggatcaacaggcaatggcatcctagagtttgcagcaccagtaatttgaggatgaacctgtttgataatacacaagagtttaataccacaccacatatattttgcaggttttcttctatgcctatatattcttctaggtttttccactgggcatagtcctcactaaatgtcattattatttgaaaaactaaatttgtagcattctcctataaaattggtgagaactatttggataattttcatttccatttgaaagcatttgttgcttctgtttggataaataacaaagaaaataaaacaaaaggaggctgaaaattacagccctgtctttacttacaaatgcatgtgaagtgtatcctgttaatactccaccataatatggatcagtaccatatggataagaaacacatgcctggaaaaacacaagaacaggtaaactaaacataaggttca

SEQ ID NO: 67763 - DNA, 1818 bp, Oryza sativa
acagcagttaagtcagaggacctgcttccctcattaacatatacttgctgatgcccacaggtgtattcggtattgagggttgagaaccctctctcagaataaacgaatcaatagattagcatataattaattaagtactaatttaaaaaaatagaattagattaatatattattttttaaaaaaatatattgtttatcagtctagaaagtgtgcacgcaaaaaataaaggagtggtggttgggaagagggagtatagaacagatactattgagcttattggctcaccagcaatctactaagctctatggaacattacacggacatttgagtgagttttttctctacgggttacaaatccctaatctaaaactggtttgtaatgtgaagcaaaatgctcccccaaacatggctataattaaagcatcaaaagtttttcaccgagggatcacggtaggcgtgcacatatataatcatatacccagtctacaaatataaaataattttctaaatataaaaggctagggaccatatcaccatactgattttgtgaccctgttttagcagttgttcaacctaaagaattttctataagtggccaaacataccgatagtccacatcgcaaagatggccatgcgtatatattacaaagacctttgcattgaatccaatgtcgtcaacacgtattcttcgaagtagagcttcaacttctaaatttaactctagtattatgtctagagtaaagttgtggagtagtctaaacccatccacttctttagtttattttgtgacagcgttccacctagttctgctcctattttagatagagctggaattatttggttggactttagcttcagaagaggtggtagagctagaactagaactatgccaaatagatcctgacccaaacaggcccttcctatccagcagcttataaaaagaaaattaatggcaccatagctgttggattactgactgcttaacgtatctagatgtagtaggcatgcacatgtagaaaaagggaaggtattttggtctggtcttatccatctgcaattttttagatgcttttctagaggaagttgttggcacaaaagatctcatcaagtcgtcatcatcatcaggctcgctagctggaccaacaagcagagcgtgggcaaaatgtggctgatatatatgtgcgctgatacgtgcagtggaaaaaaaaatctcctgctcaaggacggtctggctcggtttggagagcctgtgacataactctaattatgagaagctccagaacaattcatattatcatccagattataaaatttagaaaataagcttgaagtcaaaaggctgaaaaataaaggttttttattttcagattctcacgagctactcagagtctcagactcttaagctcactaaataatgtttcattattagatacaagccaaagatactagtcggaatattaggtagatcattttgagtgacagtctcatatgatcgggatcttattagattttaaaaatacttcacattattacgtaggatcgggacattacacaagaacttgatcgtatggatcggaatagtgaaaaaaaattaagatactaaatgagattgatattatttcggcttggtatgattgatactacaatacttgcggaaccatcattttgtttatccttatacttattcgtacaatttactagaaaaaataatttatgggtaaaatttatatatgttttcataacgacgtaaaagcaaatgttgtaaaataaaccacaatgagaaaaccacaaaatcaactttaaaaataagttttaaa

SEQ ID NO: 67764 - DNA, 3902 bp, Oryza sativa
tgcacatgcaggggagtgtgcagtactgcaggggatctcaattgcacaccaccaccatcaccacctccaccagtgtctgcttgtgtaggctgtaatatatacaggctgggaggatattaggatttgggtgagtcagtagtttgcaattctgtaggtacctctttaattttctaagcatgatatttctttcgaaggatgaaagattttgtttcaattaattaaaaaaatatttttaacaagaacttaattttgctattttaacaatccgttgcaacacacaggttttcggctagtagatataaattaaataacatggtaaatgaacttaataacaatatcttagaactagggatttgagcaatacttacataatttttttaagggagcattactcaattggctagttttcttgtgttgtaaccagccctctcgggttcaaattctagatttgatacaggtgttcgcatttacggctaattattcttacatacccgtcgataacgaggcgcccatggtgacttcgtcaatatatcggtccaatcttccggaggacttcatcaatctcaagatatgacagcccagtctttaggaggtgctcatagtggtagtgtgcgtatgtacgttcatggggtgagtgagcgcgtgtttgtactatttttctaagaaaataattttttttcaggaaacactgttttagatatgtgaaacaaataaactgatgaaatagctgaaaatagccgggccaactggccaattccaccggtgtttgccaattcttcatttggtattgcatgcacacttcaattaaaaatatttaataataaaaattatcctccatctgctgcacacggttggttcggcatggttagcacactcttgtcttgggtgtctcttgtccgtccaccgcaccgcacccaccgaaatccgtcggttatgaatcgtcgtcatccccacaccccactattgacatctggcagcaacaaaaattagttggcgtccttttctgataataacgcgtaaggcaaaaacttttcatcctatcctaccaaatatctagactcatatatagagtattaaatataaaaaaaaactaattgatatagattgcgggtaaattacgagacgaatattttaagcctaatctatctattatctattattatatactaaaagtccatgaaactttctacaaacgctctcaagccgtcgcgtggtgctcctaaaaacactcataagtcgccacgtggcgcattgataaatcctaaaaattctaaacatctaaccgttgattttcatttaattggatagacccattattttcaaccattaaatctattttataaaattaccaaatcaaccaccgatagatctatattacgagtacaaaattaccaaatcaatttatctctcttaaattatccctcggtccgtgtacctgtacagcatgtatgtttgtacgtacgtatcatcccaccatacttttttttctattttttctttcttatttagattagatgaaaaatgaaaataaataattcaagtccattcacaaccattgattttccataaaacatggtggactaattagatttttgttattataaaattgaaaggcccacgtgtgccacgtcctcccttccatcatgtaagtgcgtacttagtatatacatgtatatatcggtccctctacctattcggttccctctctctatgatgtattattagccatcaaatcgttttcacaatggttgtgtagagcctcacgcactatatatgaatcgttcccaaatgaattatctatcacataatgcaaatatattggagtatacaaacctatcaatttaccgtagccttatgtcccatataatctatttattaataaataatgagaatctataccaatcttacttgcttactgataatttttttttaaaaaaaagttgacacacagggtgtaatgatgtcactatttgtcatatcatacatttgaacttaaaataatatttgtataaaatgaaacaaaagtgtaaaatgaaccaattctagaaaaccttataatttcttagaaccattgtggttcgtaactttcccttaaattgagacaaccatgcataaccacttcatcatttttaagtgactacatatcaatagacttctctctgttctatgccatagcagaagatagttggctttgaatattatatttcttactattaaatttgggttttaacactcaggttgactaaatgtatttaaacaaatatatagatcacacatattataggaagcgaggtctagaatatatctactctatgtttttattgattcatacataagtacgtataacaaattgcatcaaatgcgaaccaattaaaagaagtaataaaacacatttattataaataacctttttgagatttttttttaaaaaataggagcccaaaacatttaaataaaaagaaaaacaacaccttactttaatttggatttaaagacctacgtcttcttaaatgatgaagatgattaactttatagatatgtgcttatatagatgaattaaatattacatattgtaaactaacaaatatcttaaaagaaacatttaagaaatgattcatgaatgtccgcgcgaatgcgcgggctaccatcttagttgttccataatttgacactgtggtgctacagtaaacaattgctaatgacggattagttaagtttaataaattcatcttgcagtttacaggcgaaatttgtaatttgttttgttattatactacatttgatacttcaaatgtgtgtccgtatatccgatgcgacacgccaaaatttttgatgccaaaacttttgatccctggaactaaggcggtgtttagatccgaggctgaaaatttttgccgtgtcacatcggatatacagacacacatttgaagtattaaacatagtctaataacaaaacgaattacagaatctgtctataaactacgagacgaatttattaagcataattaatccatcattagcaaatatttaatgtaacatcacattatcaaatcatggagcaattaagcttaaaagaattcgttctttcgcaatttacatgtaatctgtgtaattagtttttttctatatttaatacttcatacatgtatccaaacattcgatatgatagggtggaaaaacttgcgaggggaaagacttgccaagggatcaagacagaccctaaacagggcctaaactgcatggccttcttttgtgcaattgcaacaggacaatagcatactagtagtagcaacatgacattccacttttgcccctacacgaacaatgccagggacccagggcacataatctcagctacccctcgctatgctgctaccaacgataaacaatcttctaacttatcccttccacttatattataactcgttttactttttttataaaaaaaattactaaaattttcaatataaaacaaacatattatcaaaaaaatattcaatgctaaatttaataaaactaatatagtgttataaatgttgctcattttttctataaacttagtcaaacctaaataattttgactaaaaaaataaaataacttaaaatatgaaacggagggagtaacttatagcttcaataaactaacatgtgagcctgctcgtgagctcatatatcaacaacctacgtcagacgactatacattagaggagcttctccttatccaatgctattgatagacgacatggactctctactgtatgtttatctatctaagaaaatccaacaaatataattgaaaatgctttattattaaaaaatatcatcgacaaatagaactttcaggaaatgttattgtacaagtcaacttggcacataaataccaccgtcattagggggtccat

SEQ ID NO: 67765 - DNA, 5701 bp, Oryza sativa
atatatatatatatatatatatatatatatatatatatataaaccatgcatatatatgtttcaatacatatatatgcatacatatatatatgtatatatatatatatattatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaatgacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgaataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcataggaaatttgaacttccgcctaagtctttctctccatttgccgcggaccaaatgacggaaccgataccaagccctacatggagtttaaagctatgattcgtagtagcaattaacataacaagattttcttaattaacaaaggaactatgcggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacaggaatgaaatttggtatgtaggaagacagtaaattactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgtaaaagggagtatattattttctatggtctacttatatacaaggacctaattaattaaaggagacgtatagtaagaaatctaactgaacgatatacttacaaaatccagcaattcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgcctttttcgatggtgcgaactctagcaattgatccgtaggtagaccgggtcagtaataaattgttctatcgtcatttctttaccggtcaccaacggctcgatctcctggtttggttgctctccaagctgagggactggtttggactttccagaagatgctttcttcagcgttcgctcatagtctgatagctgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccctgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctagaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgaagtcatcaacgggacaggtcgattcgtcctgtgtttgcatggcgtccatgctctgtgatcctacctgccccgttgaggcgcagctgctacggtttcctgacgggctcaccattgcaggaaggaatggtggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctctagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatacatatatatacatatatatacatatatatacatatatatatatatatatatatatatatatatatattgcatttcacgttaacgttcgtcctcgttcgttcgctcgttcacgttccctagctcgttcacgttcgttcgctcgttctcattcacgttcgttcgcttgttctcattcacgttcgttccctcgttctcgcttgtcttcgttcgatcgttctcgttctcgctctcgttcgttcgatcgttctcgttctcgttcacgttgtcgcggcaacgtatgttgacgtgttcgttctcgctctcgttcgttcgatcgttctcgttctcgttcgttaacggcggtgtggcggcatcggggcggcggttggcgcggcggcgtggtgacggcggcggcggcgtggcgttgtggggccgtggcggcagcggcgtggcgtggcggcggtggcgtggcgtggcgtggcggcggcggcgtggcgaagtcggcggcggcgtggtgacggcggcggcggcgtggcgttggcatgcggcggcggcgttgcgcggcgtcgaaggcggcggcgtggcgcgtcgtcgtcgtggcgcggcgtctcgtggcgggcggcgcgacggagagagatcgagatcggagagatcgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacatttaagtgttggtgaagaagacgagaaagcaccgggaatatatatacccctagatctttactcccgg

SEQ ID NO: 67766 - DNA, 1754 bp, Oryza sativa
aatatctttagtcccggttgttctcaacaaccgggagtaaatatcttttcccgctatttcgaaattctttttaaacccggttagggttaagaaccgggactaaaaattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatagataatcaatacatccaaaatagtttacatcgtgtacacaataattacggcacgtactttctcctcactattgttccctccttgtgatcgctgcgagagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccatgcggggaaagtatcaatgtgatgccgtgtaatccatgcatcggacttaccgatgttcctggcgcgaactagagccaagtgctcctcgatgtaaggagctaccaatgaagagttttgcagaacagtgaaatgggct

SEQ ID NO: 67767 - DNA, 892 bp, Oryza sativa
aaactgttgtgaaatatgtaaaactatatgtatatgtaaaagtatatttaataatgaatcaaatgatatggaaagcattaatatttatttaaatttttcaaataagacgaatggtaaaacaagtttaaaaaagtcaacggcgtcagaagaagggagtaggaacttgtattaattaaccaatatagtgcggatcagttccaacgataggtttaccaatggagaaattttacggttattaaaagacaccaaaataattaagtgtaattaaattcgaaattgcggtaccgctcgtcgtcgccttaagatagtaaaattactaaaattaatggaggtcaggagcttgttaaccgtgaacctgcagactcgatcaaaccaggtacagattggattgcgcttgatgattgttttacatatataagtaagccgtgccattagcactgtatttacaaagactaatcgaaaatgtaatagtaactacgaacaattttgatagttcagtgttagatagttacagtgttacacccttttcctgatggaactttgttaggcagccacaatataatctagaataaacaacaggagggataattataaaggtagtactgggcagaaaaaaatgcacatatatatatatatatatatatatatatatatatatatatatatatatgtatgtattattagaaaaaaaatggcatagatatagatacataagaaataagtgaattacaccagctggcgcagtggcacattcggaaaaaacatgaaagaatgagggaaattaagcaaagaataaagctaggtcgtcacttattaattccaggaaatggccaatggcattttctagtgcttcgaccttcagcaaaatatcccatcagtagctaaatcgtgc

SEQ ID NO: 67768 - DNA, 22660 bp, Oryza sativa
atgcaactgactagggtagatcctagtaagaaccattatggaggaacgaaacatcccctgtgaaatcatacatctcaagagtgatctcacctgcaaccaagtctaagcatacaacaaaccaacaattcaagcaggagtcagtacaaataaattgtactggcaagcaccaagcaagcctaatactctacatgcatggcatattcaaagtaaagcttacaatggatatttttagcataaagcatattttgtttgaaagaccattttcaaattcagatttcctttcaattaaatttcagtaagcttacacttagcaaatgggcatcaaagtaggtgttaatcacatataacatagctccttattaccttccatggcagcaaggacataatccacaaatcacatcacattttgaagtttaaattcagcttttggaagaataaaacacaagtctatactcatgacatattcacatgccgctcatgactgcgagcatggctaatcgattagttttaactctgtagagtacgtacactttacccacatgatgcgaaataataattatgcaaaagcatggtacgcgatacataagtacccgatttataactcacaacaaagcccttcaaaaattcatgatatagccttacacctacacgatacgtgttccttcatcctagtcatactagaaatatgacctagaaccgttaagtggcgggcccatgccttaaacttaatgctgtggtgacagacacgacgggaacccaccacgtggcactataccgttgtattggacacgcttagtcatctaaactaccacatcggggtaaataggaagctcctctgaattattcgaactcatacacactggcctaccaagatgtaaggctaaaccataaataatttactaagcttgggctatctcatactagcacatgtggttgtactgtatacgaaatgaactgacattgagtgaagtccttaggtcggtctaggcacactctccccctatcagcacacaactaatcaccatatgtataccacatgaggcccaaacctaaaatccacattttccaatattttatttaacaaatatcacattttatcatttctgtcaagaccataaattagatcattttatatacataattgagcccaaatggtaagtaaacccaacactaagcatgactaagcattttcatagacatgtgacctcaaacatcaaacttaatgtgacaaaatgaattgttcctaaggctaggaataatggttaaggtcttttgtggagtttaggtgataatgcaagttaaggagttgatctaacaaattttacaaagttttaatggattagtgtacaatcgacatgcacattttgcaattcttttcaaaaacctccaaatcataggttcaatgtgatcaaagaggggaggtggcttgccttgctctactacaaagtaggtctcctcgtgattcaactgcgaatcatctaaacatacatatgcaaaatcaaaattataaacatacacattaaaatccaacatgctctaaaaagaatgcttttcatagattaagtgtgttctgtgttaaattgatttttagtgaaagaattttcattttaacagtttccattcaaaacttacaaatttttaaagtgtcttcatgttaaatatagacctacatgcatttcggatttttgagacataaatcttcatgattttgttaagtctaacatttttatatgcagagcataaaaatatgattccaacaaaatttagtttgtaaattttagagttagaatgaattttctactaatttctaaagttttaccatttttcagttgatgagaaactagttttgcattttctctatttttctcaaatcattatctctctcgggtccaccggtcagtgactatacttttgcgcataagtccctggttctcgggaaatagatccagcagaccctgagcacgtgttccaggattttattcaaaacggtacttgagttttaagttatttactcgttagtacacaaccccacatgtaagtgtctaaatgattttcttaaacaccctggaagttttaaaagattgcaaggttaggcccttgctcttgacggagcagaggggcagctctcccgcgagcttccccacattgccggcggcgaacggcggcgattcagttcgagctcccaaaacaaaaagtgtagaggacaaccgtacgaacctatcggtagctttcttgcaagatttggtgctctatagcggctgttaaggtgttagaggtggcggctagcttttttgtatggtaaggactctagggactactaggaagctcaccaagcaacgcgaggtcttggcgatggagagctggtcgggcggcggcgcagcggcttcggtatcgtcggcgatgcaccttcgggcttgatctgttcaaagcgattttagatggcacaagatagctctaggcttaaaagaatgcgccgaagctcaccagagaaggaggaaaaaggaaaatggcgtcggcggccagagttgcggatgaaaaaggggatctcccgccgaggtccaactcagatcgattcctttgggattcttgatccactactaaaaaaatgatttttcatggcgtttggaaaatatttttcatggcggctaagtgaaaaaccgccagcgcagaaaatcgcgggggtcgggggtcacgggccgccagcggaaacacaacttcgctagcggtcgccttaagccggccgccaacgaatatatggtattttcactggcggccctcttaacttgacgccagcgaaaatcgtcattttcgctggcggtaggttaagaaaaccgccagcaaaaatagcctatttttgctagcggagttgttaccattttcgctggcggataatggagagcgcaagataaaaaatcaagccattaagaaatcaccgcgcgcatccacctacccgtccttatcctctctcctcctccctcctccctccatatctagccctctcttccttcctagtccctccaaatccaacacctcctccctcggatccacaggcggcagcactcgcgagcgatcggaggagagggcggcggcgagcttggggcgcgggcggcatgctcgggcgtgggcgatagcgctcgggtgcgggcgacgcaggagagtgcggcggcgagctcggggcgtgggtggcgaggtcgggcgtgggcggcggcgctcgggcacgggtgacggaggagaggacggcacgaggtcaggcgtaggcggcccgggcggcggcgctcggcgacagggaggcgcgaggcaccggatccggcgacggggaggtgcgaggcggcggatccggcgacggaaaggcgcgaggcggtggatccggcgacagggaggcgtgaggcgacatatccacaggtctctctcccccactcctcactcctccccattccccgccgccaccaccccctctccctctctcaaatctagcgttgcgtggctttgcagcggcggtggcgaggcggagaaggtggaggtcgccgaggctcggcagcagggtcgtcgaggcggtagaggtcgccggggctcggcagcactgcagcagcgtcgtcgaggcggaggcggttgaggccgacggggctcggtagtggcgacggtgatggtggatgggacttcaaggatgacgacgccggcgacggcggttctctgtatttgtgatgcttgtaatatttgtgatgatatttgtgaagcattgtatttggattgatgcttggtgttcaaattttttgttaaatgtgtggatattttttatgcttgaatgcttgggagaatggaaatttttagctgtaaatttttcatgtaaatttatgtgtggatggagttctgatggaggtagacggagcagtgttttttttaatatagttttgcttttcaaatttccgcctcttcgctggcggctagggcagctgcatggttttgatttttgctggcggttggtggaagacaacagccagcaaaaatggatctttgctggcggttggctaaagacgaccgccagcgaaaattcattttcgctaacggtcgataaccgccagcgaagatcttgatcttcactggcctttgctttgtggcggctctaaattccgccagcaaaaacctaaaatggccgccacgaaaaatggttttcgtagtagtgatcaatggaggttgatgaagctcgtggcgaagtggttcagcttgtcgcgaaccgtggtaagccgggcaacgaacaatggtgatgcggcggtgtccaaagcgcggcggcgtcccaagttgacgcggtcgcgttcccagagattggctgcaccaaatgaggcgttcttggtggtgttagagagggtgttgagagtagacaagggcgagagagagagagagtgatggtccggtggtcgggtaatatatggtgtcgccggcagaggaaaggaggaggagcgcacgttgccggcgtccatgctcacgcgcgtggcgtgagtgttctggccgtgggcccgtgtggagaacgttgtgaggctgacaataaggtcccaccatgcagccctggcccacatggcagtgatttgcgtgagagagggaaaagagatctaggtttttgaccaagtctgggactgtggtgaaattccaactttgggctcgatttaaaattagttccaggcagaatttgggttagtgaccagtggcaaagttgtaaaacaatgtttactctacaggttggatcaagtcttacagcctaggagtccaaggtcgaattttggcaaggtgtcaatgtgtgctccagagaatctgtcaaaatcctgtgtttggagagttgcttggtccatctaatgacttgataaatcgaactaaaatttacatttgttttctaaggttagttagaagtttacatagattttccccagatttttgagttgttacaaatatttttcttaagctcattagttttacttaagaataaatatgctcctataatgcatatgcaaaacatctcaaaatgcaaaagcaattaaacataaaatttttaggcaaaaattttattcattttacttcatccatcatttccatgttttccatacatccaaacttgtggtatgtgacagttcgtttacaccctattgacattttcttttttttatttcatacagatattatttttagttcaaatttatgatatgataaataatgacaacattacaccctatgtgtcaatttttttaaaagaaaaatttatctataaggaagtaagattggtatatattctcattgtttattaataaatggattttatgggacatgaggctacggtaaattcatgggcttgtatactacaatatatttccattatgtgatagatgattcatttggaaacgttttatatatagtgtgtgaggctctacgcaaccattaagaatacgatttgatgggtaattaaatataactgtacatgcaacattgtttttggattgtaatgtattgtgaatgcttctttgatttaaatattttctataacagtctgtttggttgaagggagtttctaggagggattgggagtttaaagggatgaggctattaactgttttgtttggttaggggacatggcaattttggtgggatggggatggggaattgaggaatgaattctctccttttcaatacctgggtaggggcaggtaattgggagggaattcctcttttacttcgcctaaacaaatctcagccatccgttttcattaatgatctaatctccaactaaactccctatcaatttccaccacctctaccaaacaagagactgggatgaaaaatcaaattcccatcttaatctcaccatcaatttcctcgtgtaaactcccaatccccttccctcaagttgccaaacaagccgtaatatttatggaaagctagttttatgggctatcaaccccaacataaaacatggtctaaaatcttcaagagatcttgaatccctttcaactcacacaaggatgaaacattttgagcactagtacttgaccaattatatgcatgtgatatccctcttaatagtacggcaacgtattctgtgcactcaggcacttcggtgcactcgtgcactcgctcgatctacaccctcgaatctcgatctgaaggatgtgatcgaagaaagacatttttgcataaaaccctttgtgctatgctgctcgtggggtgaagtctggaagggagaagaaagaataaaacgaggggttgtgtgtagatcgaaaacctcatccggtcctccatctccgctcggcgtcaatggaggctcgaatccgcccggcaaaaccacagtcgacggagtggaaaatcaagtttaagcctcccgttttcctttttcaatactcctctctaatcctaccatttaattaatctctctttctatctcctggctgtagatttcgttgcatcggctgcagcataagcgactccattcattgtactcgctaatttcttgtgctctttgcctttttgaggtccgtcgacggcagcagcactgatggcgtaatcgctagccatgcaaactagctgatgctacaaagcacaaagagaggcaaattttcaaagctgtagtcgttgatttaagattgctcgtgtataaattgtgtatatcttgatgtatacaccttagattgtcttgtttctcccattgagatgtgattgctcgagtgtagactcttggcattcgacatcattgtcatttttgttccttttatatgtggctgatgcatgtcaactaaacacaaaagcttttgtttttgcctctgtggagcatgagtttcctagagtatttgagccgcagctgacgccgcgtggtgagggaggactctgagaagatttttgagccgccgtcgtcacttcgtcaccacacggagaagaaggattgggatgttttagatctggggtgaagcctggaatcctggacgggagaagaaagaacaaaacgaggggtcatgtgctaacttagcaagcgcggggggttttatgaaaacatatctttctttgatcacacccatcagattgtgatttgaggttctagattaagcgagtgcatgagtttacaggatacgttgtacggcatcctaaactcaaatgtaaaaagaaaagttatatcagcaggaatacattcacaccattttctttcttcacttagagggttaccaacgtcaagattatttgatcatggggaaaatctcatcttcttgatctttaacatttcattttctatttctcaaatgattgatacatgcaacattgtttctggaatgtaatgtattgtgaatgcttctctgatttaaatattttctataaaatttcttattaaatgttaggaattgtgagatcgaaaccaatcactctgtatttgttttagctagcctttacttggtatgaattaattagaattaaattacataatgctttttgtaaagcccacaatgcatatccgatccaactaccataaaattttaaaaagagaccctagaaagtctttatgttccaacgaccaaataaattattttaatttttttgcattctagtatatatattgtttgttcctatttaatacaccctacggctaaaaagttaaggcaaagctaagcacattgtgccttctcccactctgtatatgcattattcttaactccctgagtttggtctacgtactatatatctaccgacttctattgcattccgtcacgcatatttgcgcaagaaaatatttgggttccaaattataaaaaagttaattacaatttgttccagaagtaaatctaatggttgaaaataattggtcaaatatttttactttttttctttgaaatttctaaggttttttttctaattttttagacatggtgacttatgagtgctttacatcatgttttttttgtaattattattattgattgacatgtaaaggataggggctatgttcaagtgatgtattttatttttttaataacgacaagtatggttaatatggatcttgaattatttgtttaattataaataaaacaacagttaaaaaattaaaatcatatataactttttaaattataattatttagctatctaattattggttggtttatattatgttgttatttaaaaatagaaaaattacagaggaggaaattggacaggagaggagatatgtgtatgtacttatggcaaagggagagtttgggagtttttgttcttttagatagatccaattaatgggttgttaatgccaaaatttggtatgcccgaagtcatcatcggcctagagtcagtatcggcttcagagtcttagaatcggccgatgggagttgtgaaatcgccagcagttgtgttcttggtagagtcggatcaattaaaggaaatttatctagagagtccgagtttaaggaggatacggcatggcaagtatatctattaattaggataagtttgttagttccttttatctttaggaaagtgtgtttagtgtcctctaaggactttatgttttccttttatctttaggagagtttctttcttgtcctacaaggactagtatctccccatgggtataaatatgtaccctggggtcattgtaagatatctctctcgatcaatataactactctcggcgcatcgccaccctctttcgtgaggtttttacttatcatccggcagaatttggcacctgacgcggggctgcatcggttcagttcgatctccggcgaaggggtaagttctacgttccgccgctggcgctggcgaatctaccggctatgttggtgttgttcaaggctgcatcgcttcgatctcttggatcgctctggtttggttgatatatttgcctacctgatatctcaattctatctctaattgcattgtgtttagagacgcatcggtttagctgggactgtctcagttaggtccgatcttctgtcttagccgatatatctttacaatcacaatggtgttctaaatagattttttatatccatcacattagacagatctatcggctcatcgggtattagattatcatatacaatctcgtgctgtatcggttagattcgacctactagattgttcttgataatataaatcttgttaagccgataggttcatgctagtgttttatcggggtgctagccgataagttagatttagccgatgacaacaaatactttattgatttatctaatattgtggattttatgacatcggacctccagccgatgtatgctttaaccttcggatcaatacttgttctattatatcatattgttagccgattggtttctactggattatattgctataatattgttatttttcatcatcagtcgatcgcctttatatcattatttacattggacatatagtcgattgctgaaaaccctatcgctatcagctagtatcggcatcggctggaattgctccatcggcttgtcagccgatcagcttattggtctactatttgcatatcttatccgttgcagggtcaaactgactggcacgcccgcatctcgttaacctttggacctgcactggagctaagcagatctgccaggccagtgtgtttttttttttgcatcaacacgggttcatcggtctaaattatctttatttatacataaatataatattaacaaacaaagtaatgtatttcttttaccacttaattattttaatcttattaattaattctttgtgtttcatattattctaatataagctacgtgttgttaatcgggtgtttaaaaatctatatgatatccccttaaaaatatgtctcaagtgaccaattaatagctagtccaaagcaataatttttttacttgttaaatatatatagttatgatttgggccttcaattatatgacaaaatctaatatagtacgtggataaaaaatagctataagattcagataagatagttatgatataataatatgtttgtgtctaatacatctatactagttgcccgcttgcaatcctaatggtgaaatcatcctctttcatctcatccgtccatccaccatttcatttaatcttatccgtccatatgccatctcatcccactccaccgatgccaatgatttcggcaacccgggcgcgatgactcccgccatccccacgcgcgcgctactcactccctccggccgtcccagcacgattactccgcccccgtgctcctcctcactcctctcctccttgctctacgcctcctcgccgctgacaccgctgagcgctccgcgcgcccccgtagctccctacacactgccttccccacctccgctgtgccgccctccccatgacaccacttcccgctccgccccatgcgccggacgagaccacgccacggcgccggcccccacgaccgccgccgccgccgtagcagcagcgtcggactacgcgcactacccgaggctctcgccggaggacgttgccccgcctacccctgcaccctaccacgccgcggccgcccttctcgggcaatccctacgtctcctcccccgccggcggcgtcgcacccgcctccaagagtgcgttccagcagccaaatctgccctccgttgttgccaggattacttgcggtttttttatagctgtttcggatttccatttttgcagatacaatggatacggtgaagaatgttcttggcaagatggggaagaggttaggagaggcggctcgcaagacggagtccctcaacgcccgggactacccccgacggttccccctactgctggagccactgcggcgctcgaccagggacgccggactagcgccgacgggccactgtagcgccgagccaccaccgcggtcccacgttctgcctattcgcgcacgccacgctggtccgagtttgtccccgcctgcaccaagtttgtccaacgttccgccaaacattcttcgagatgcttgggaactagtgatttggggactacttcaagatggaggcatctcactcaggtattgaatcgttctagattccctgtttattcccattctcatgcaattgcggccgtgctgtgcgaatctaatgttgcttctaatttggactggaatcatggttggttgggttggcgagttgcagatttcaaggctgttcagtgaggaaaactgaggggtagatctgttgatgatttggggatataatggtgtagcccctgattttttgttacaacatgacagaaattcagtattattggatggattcacgcaatgcgctgcaatttgtgcagaaaaggcagtttttttgttgtgtatgatagatcaagtttattggatcagcttctcttcggaactccccattcgagttgttgtgttttggtatgtgggaagtatatacgcgattttgctccaagtttgtcttgatagaatttatctgcgctggcacacttgattcggcacaaagtaactttcttgctttcccatccccattagtcctatttttatttgtcaaatttttgccctgctaccatttttgctttactgactcatgcatccacaggtccacaacactgtgcctccgccgacaccgcagccagatcgaccagtcaagcatccactgtgccgatgtaatccccagtcaagccagattgatgggcagatccgatgcaccggccagaagaacgggctgctcagttgtaggtgagttaaactttgccatcttcctttgactcctcaattaccttcttggtttgctaggtgctccatgaaatcccgattagcaaatttgttgttttgtctaccaggattggtttcgcccaaaactgaagtgaaaagaatttgttggtgaaaaaagaagttcagaatcacaggttatgtctcttgattgcaagacaaactgattaactgtgcttgcaagggtgtttgtagaaacggcttaaccactatttcttcccaatcctggtaacaagcaacagacacaaggtaataacctttggtgccagatgctgcatcacactcctgagtgagcagcaaatgtttgacaaaatgcttcttaggtactgttactactcttgcatgctatttgattctttttttccaggcccagttggcagctaaactagtattgtttacaagtcaaagatatatatattgcagagaagatctttggtatgtgtttggccttttatgttaagcgataaatgacatgcaaaacataaatttcaggtttgtcattactcaaatacccattgactgtatgcgttgtttcaagttgcagaaccataccattgtcctttacagtatatctaatcatactttttttttgtccattcatactccatacaaactattctcaattctcaactaccaatgtcttcatatggatgatcttcagttgatgatcttgctaatttaagtgtcgtgacattatcaggctctaaggaaggacatggcgatctgcgagagcagcattgatattatcaaggtaacagcggccagtgtagtgccggttaatcttgtatgaatacagtctttatatatgcacactgccgatgtagtactatgtctctatgcatgcttgtaacaatgcctaaaagaccagggagaggctatgcagagggattggggaatggggactgccaattttctacattgataagtttagtgtttcccctggaagggatatggcagggatattcacaaagtgcagaatacgtgattcagttggagaaaggcaacacatgaggaagatggtttgcataataaattatcttaggttaaactaatgtttttttctgatctggtgttttgtaccctcataaccatctagctgttgtaattcatcaagtacccatgttaaagtggttgtaccctatagcaacctagcagggctttacattttgttctgtgcaaaagttggcatggagtaagaaacagggttatgtttacaattttcaaataaattattccttaccaaggcattcccttcagttttgttgcccacatggcacatagggaacagttagaaattgtaagaaattttatactgaacatgaggaaattgtatttctcttaagtttgtctgatgggtatattgctcaatcaaaggggctgatcaaaaaaccaaaatagcagtcacactttgatgcatgaatattactaccttcgtttttaaatatataatattattgacttgtaggacatgatgcttgactgataatttttttaaaaagctatgtatatttgtgacttgtttcattaccattaaagatacttcaagcgcaacctatatttttcctgaaaagtatttcattgcaagatttgggaggatttcgtaggtactaaatagcaaaaaagaaaaaaaagctatgctatgttatgttattcaaacatataaaagtgaaagtatattgattatttacatgtgcgtcctatcttttgattatatgccactgtgaatttgattttcgaaagaatgtaattttaatataggtcacgacgtgtattgcacgtgcacaattttaaaaaaatattgccttaaaaagtcaatattgttctatctttgtatatacattgccaatatcaatagaagagagagggaaccgaatggatggagggaccgataagggacgtggcccacgtaggtctttcaattttttaataacaaaaataaatctaatgggtccaccatgtttaaaggtaaatcaatggttgtattacgtggtaatttaggagcgtttgtaagagtgccacgtgacggtttatgagtatttataagatgtttaatggacttttattatataagagatatacgactgggcaattaaagcctcttgcactactgcagaaaacacaacaacattgcacgagttcaccccaaccattgacggatcacgataggtgtggccgtcgttgccgagcttgccatggttacgacactacagctctaacttcacaaaactcggccttgactcaacagtatcacatccctgtatatggctgccaccaccaaagcttgctgcatttcatcattgctaagtaatctaccgtcaaggcgaggtgcaatgccacgtatacgaaacaacacaatggaccatataatataataaagttcaaacacgttatttttcatagttttacattatatataatatatacatgctttacaaatatttgcgaaaatatatattccccgtaggttgaggcgtgccaccgtaccgatggcgcatggccgacctaaggggtggtggcacagaaccaacgcatgtgaccgcgtcgctcccgcacggcacccgcatgccatcgcggcaatgcaacatgtaggcagtcggttctgcatgaccgatccgcggaatcatgttggtccagcatgaccaatccgctggaccgagtggtttcgcgcgactgattcgcgggaccgcccctcccgtcggtttctttcttttgagttgcaccgatggcacggcccaaacccgcacgaatgtatatttccgccaatattttaaaaacaacccgaaatattatgtgtatttttcataattagctggaagctctgacttcacttgctccaccgtcccatagcttatgttctttaaaaaaaaagataattgatccataggccatatcactctcggcccaatgcctctcctgccatatttgctcttctcctgatcattcgcctgcgtgttgggctaattcgttctggaaatattcctcctgagaaaggggttaatgactacctattggcatatacgtacaacttcttttttccaaatgcgcaaacaccttttctacgcactatgtttttgtttttgtgagtgcaaacttttttttcctgaaacataaaggctcatcaccctataagtaaatttgggtcagtatattttgaaatttacgaagtcaccacaagtgcctcagtatcgatgggtacatcatgtaccactgaaaaatagttagcaataaatacaagcatatatatcaaatttgtgactttaatttgagtgggtaagtttcaccggcaatctaactattttagggtgtgtttggttcacggtcaaggttggataggatatggcgattcatattttactcgatatggcgatccagttttttgtttggtagagtgaatatggcgatccagttttttgtttggtagagtgaatatggcgattcagttttttgtttggttgtaggaatgaagatggatttggtgatcttttttttggttaagaggagtaggatggatgagtggttgcaatcacctcatcattagaggtggtgagtatacccccttcaaattcaccaaacccaaacattatcaatctactgcaaaataaaaaatctaaagagaaataaaaaaatcacaaagaaataaaagggaaaaaggagaaaacagaaaaaaggaaaaaaaatcacaaatcttctcgccgcctcgctcctctcgtcagccgccacccgcctcgaccgccgcctcgctcctcttgccggccgccgccccgctcctctcactggccgccgcctcaccttctccagatccggttgcttctctcgccgctccgcctcgtcgctcgccaaccgccgcaacgctcgtctccttccccacctctcgccgccccgcctcgtctccttccccaccagccgccaccccgtcttcttccccaccggccgccgcgccatctcctttcccaccggccgctgccccgtttctcccagatccagccatcgtcatcgtctccatccccaccggtcatcgccatggtgcaccggccgctgccgctgtcgtgcacttcccgctgccgccgccgccgtgtaccgggcgctgcctcacttgcgtcgtcgtcgaggtctcgtggtgaggggtgacgcgacccatgttggtcgctcgccccgctcgcccgggcgcccgggcggttgcatccggccaaatcggccggatccccccgatccagcatctaagaggaatattcctcttcgggccactctatcccatcccccgcccaccaaccaaacatccacaaaaaatgggccgccatgtcctatccacccaaatcactccatccaaacacacccttacctatgctcacttcaccacctaacttaaaggtggaggcacatcgatagatccgcgatagtgtattatagctagccaatcttgtagattaataaataatttatgcttagtaagctacaccttgataatttaaaaaacataattaaaacaaataatatgaaatatgtggcattgttggattggatgcactaaagaataagtaaaaaaaaggaagaaaggagtacaacttagggcctgtttaaatcacttggcaagctttttcaccctatcacatcgaatgtttgacacatgcataaagtattaaataaaaaaaactaattatatagattgcgtgtaaattcgagacaaatcttttaagcctaattgctccatgacttgacaatgtggtgctacaataagcatttgctaatgacgaattaattaggcttaataaattcgtctcgcagtttacaagcagaatctgtaatttgttttattattagataatatttaatacttcaaatgtatgtctgtatattcaatgtgacacggtaaaaattttcactcttagatctaaacacagccctagtgtttgtagactccattacatgtccaaaacatgcatgtgtcttccatgtgaccaacaaagatacatgacacttggcagagttaacaagcatgacgggatacgtcatatgtcgcatcctaacttaaaaggatgaccatgttaggtgacaaagataggaaaggatgaattaattagtactagaaaaatttgttagatgccgtgctgatcgaggatacagtacacatgatcgacttggactgatgagcaagcaggtgcatttctctcgtgcgtcgtctgtgctttgacacagcgaacgaccaagagttaaaatggattaagttagactgcatagtctcaattaattccaaacgcgcctttcagtatgagagataaccttttctgctttcccggtagcatatacaggttgctagttaaattgaatttcaccagactttttagttctgaaaaagtatatggctgatcgtgccatctccgcgaagagaagaattttacaaaatgcatgccatcgcgatcatcctcagtctttactcaaaggaagttgagacatgctattcacgaaaaatatatactcatttaatttcgtttcaaaatatactaacctaaaactgaataagacacatcctattataacgaattcgaagaaagacttgcgtagattcattgtactataacatgtcttcaaatctaggttgtgatattttgggatatagggaggagatcaatatacaataattatcaacgaggttatatggtaaaataagggcatggaagggttgaaagtgcatctaggcccctaatgattttggtgattaattataatgcgattagagaggactaacatttttatgtaagcaaatgtgaaggttgttatgtcctcaatgagttagcgtaatgcatatcccgccgaatacgttgatgtgatgtgatgcggcaaatgagcaaatggtatggtgtacgttttcgttttcttgagttattaggaaagccgcactattaagagggatgatgcattgacttacgaggagtgatcaaagtgctcaaaaccttttttaaaaaagtgtttctcctcagtttggtgtgttctggattttttcggagttttccgaaactcattttcggactttccgaaaacacatagaaccagattttcgcttctggaaattttcgaatatgtccgaaaggatacagaagagtggcgcacggttctgatgatttttggatatgtccgaaaattttcggaaatatccgaaaaatttcggggtcttcatatatcaccccgtggacttccttctctctcctttccacttcttttccccacgggttgcctccctcctccctccccaccggcgactccccggcgatctcctcctctccggcgacctcccgcgacacccctcctctccatcctcgagggagcacgtttggggcactttttgggccctacattgttgatcttcaccatgttcttcccgtgttcttcgcgttcttgaggtatttgtcctacaatcaaatccctagattcctcaagttttctcttgcgatttcctttggtggagatgttcccctagtgccataggccctgcatattcaatttcacaagtttttgttggcggatttgtgcggcatctgagttatagggttcggccggaatttttcggacttgtccgaaaatttttggatatatccgaaaattcctggccgacccttatcacttcggatttgcatgtttcttgctctcaatcacttgtttcttatctctttggcttccatacctgattccttgtatctctattgtttgaaggatgcctctccgcaagcaaacctcccacaagtccaagcgcccgagggatcgctcttccactccatcttctcatgatgattcagacagtgattggtccggtggagaggatgcggttcctcaggttgcgcgggtggctcggcggtctactcatgctcatgatggtggtggtgatggtgagggctcttctcgtcaaccgcaaacgccgccgcaccaacccaatgtccccattgggcctctccgcattcatacccccgagagggatccggcggtgattcaccaagtgtatgattggcggcgcaagtctgaggttgttgctcgtcgtcgggacgaggatctgtaacatcctggcctagggtttaataggattaatagaatactcatatcaacaagttacaacttctttttcggaagccaatctccgaagaactccagggttaagcgtgcttggcctggagcaatttaggatgggtgaccgaccgggaaattcttctcaggtgcacacgagtgaggacaaagtgtgcagaaaagacatgtgttggcttgtgagggcagtctatgacctatgaaagctatcagatgtaagcgggcccggcctgggagaggcgggacgttacaaaacccgcgtggtcccaggtgggacccgcttgtcggcgacccggcccaccggctctctctctcccctccccgcccccgcgcgcgccttgggccgccttcttgggccggccggcccattaagctcggccgagccgccccattctcttgggccgcgccctagccgcccgagggaagtctaatttccctccctccttcttttcttttcttttctttttcaaaaaggatttaaataaatccttttcctttagaccaaaaatccaataatcttagaaattcaatatcttcccaaccgtaagtccgtttgactccgtacaacttccaaaatttcctcaaatctcgagatctatctgatggcacgcttagaggtcattaatagggctttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctatatttgaactaagttatatttcttgcaaaatattatgcattgctaggattgcacttaatatgtttgccccatctacgaggcagatcggtgagcatacctaacttgttgcatttgatccttccattgttaattgttatatcatgtttccttgtaaccacctggtcacgcctcgatattcgtgcactctgtgcgagtatcgacggtcgccttcaaacttaaaatatgataaacatcttgggtaaaacttggtttacaaaacgattggaaaacccgacgcctgggtcggtgtcttgtgaaagaaaatgagttttaaaaataaaactcgcgacacaaggccattcctgggcggaatgcttgtgcggtcgcatttaaggaccgattccttcggaattacatccgagcatataatagtgcaaccacatgggtggaataggacactcctggctgagtaattagctaatcaggggagccttgatgccgagagacaagtggattcgccggggtggtgtcggggaggacccctgggcttcctagcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccttctgcagaggttattaaaactgttcgaatagccgtgctcacggtcatgggcggatgtgaggtgattcctagcgtagttttgtttgactactgccttgtgaaatttgctgttgtggaatgggtttgatgtttggaaaatctgcgactgatgggatcagccaggcccgggtggccgtttgaaagctgttggccgggtgccaatcttgatcgattcaaaatactgaaacattgcacatactccgaccggacgagacgcactgtctcatccgtgtcgtttgagaagcactcacttagttgtttcagaaaagagtttaaataaaatcaattgcaaaaacaacagcctttctttgaagcctgcattaaacacttatttcccatggcttgctgagtactcccgtactcacccttgctctatataaataatccccccagttgttgaagaagatgaagcggatcccgctgacgaggagttcttctaggagcaagccggctacgatgagttttagggtttcggcctagttcccaagtgcctgtgatgtttggtccaagtcctggcttccgttccccttttgtaatgcagttgtgagctcgggatctgtccgtagcccaacatgactgtactcctactctataataaagagacctctggtgctgtgatattctgtcttcctgtgataccagcactgtttcctgggactggtatcgattaacaggttaatttggagcgtcacgggctagttccggtcgggactagttcagggcgtgacaggatccgcgctcccttcgccgcaccgccacggatccgcggttttggactctctttcaacaagacttttatgagtctgtaattaagtccaaagctcatcccactgttcccatgcaatggatcaattgggaggagttgcaggcacacaacgatccggtgatcaactctgtgattgccaattgtgatctcatgggtatccgctccttcatgacattgcagcaaaattggtgcaacgagatcattgctcagttttatgccaccgtatactttgatcgctatcgtgccatgcactggatgactcaggggtcctggtactctgtttcttatcagcagttggctgagatctggggcttccgtcttcgttctttgctaaaccttgatgaccttcataatcttcaaattcctgccaacacagacttgcttccccgttacactcgaaatgatccaaatgtggtgttgggcaaggtcgacggcctcaagctatactttgcctatttgaaccggatgtttcgccggtcttttgtgcctaacgatggtgatgctagcagcatgaaccatctctctaggaccatgcttctccggtttgatcctcctcctcatcgcttccatgtctatcactttgtgtgggaggagatccgcatggcttcaattcagtacaagaaggggttggtctatgcccctcacattatgcggatgatcgagactgtgactcagctccagtttcgccatgatgtgactcattctcagcttcacttgcgccttcttaaggccccccgctcctcagctactcgggacgtaccctcctcttctactcagccgcctcctgctcctgagcgccctgcctctgtggctcgtcgtgagccatctcccttattccgcattttgcggagtctttttggtctttgctccgcggaggccaaaaagaaccgccgattgcggaattcggcgaagaagacggctcgtgatgtcaagttcctaaaggcacggtattatgaggaccaccacattgatatccctccttctcctctgggtttcgaggccgagcccgatgagccagaggatgaagagattgaggatccttttgccgggttgccttccgacttcgacttctttggatatggccatggctatggctaacctcctccaccacctctcgaggaccctcctcaggcgcccttcgcttgagtcgtcagctcattgtcctctctttttggtgtcttgatgccaaagggggagaatatctatcatggctttagtttatctatcttgtccttagcgtcgagcactgttggtttttatctgtatgagacttttgtgttttttatgttaagtttaaagctttgtaagactattgtttaattatgaatgcttgtgatgtaatggatctttttatcttttaaagtggtgcaatgccttaccctctttatatggtgcttgtgatgagatgtaattattcctttgcatgcgatgtgttggatgtaatgagcatatgtgatatatttgttctcttgtgagcttcaatgtggatgcaataatttagggggagctctctacttgcttttatgcacactcttagggggagcttccactaaaactttgtaccaaaaaccttaaattatattcattctctcttgtgttctaatc

SEQ ID NO: 67769 - DNA, 3220 bp, Oryza sativa
ggggagatttaaagtgcatctaggcccctaatgatgttggtgattaattacaatgcaattagagaggactaacatttttatgtaagcaaatgtgaaggttgttatgtcctcaatgagttagcgtaatgcatatcccgccgaatacgttgatgtgatgtgatgcggcaaatgagcaaatggtatgttgtacgttttcgttttcttgagttattaggaaagccgcactattaagagggatgatgcattgacttacgaggagtgatcaaagtgctgaaaatcttttttaaaaaagtgtttctcctcagtttggtgtgttctggattttttcggagttttccaaaactcattttcggactttccgaaaacacacagaaccagattttcgcttctggaaattttcggatatgtccgaaagtgattttcggactttccgaaaaagactgcgaaggaaaaagtggttctgtatattttcggacttgtccgaaactgattttcggatttttcgaaaatcattagtagagtcaatttcgcttctgtatatttttggacttgtccgaaagttattttcggacttttccgagaacatccagaacgatgttgttggtactggaaattttcggacttgtccgaaaagttttcggaatgtccgaaaaatccttcgttgactttgctgttggtgctgggctggaattttcggacatgtccgaaaatctttcggaatatctaaaaatctcaattattgtacataacgggcagaatctgggctgtggctataaatagccccctcccctcacttgtgagggctgctggttccattcgaatcatttgtgcccttggcttgctctctctctagcacttttgagccttgctttcttgtttcccctctcacccgtgttcgatttggatttggtgtgtgtgtgagagttgtggattcgagtttgtgtgagtgcttgttgttgacttcgtgaagatttgtgagcacttgcatcatctacgggagttatttgcttcatttgttactcttggaggttgaggactcctaggcggctaggtgtcgctcccgagccaccgatctacttgtggttggccgggagaagtttgtgaaggtcggatctcacctccgaaagggaagagatacccttagtggaaggaggagtgcttactgcaacctcttgaggaaagggttagctaagacccggctcttagtgagctcctcaatggagagtagaatcccctcaaggattcgaacttcgggaacaacctcgtgagcttcatctttggtgactttacttcctccctctccactagctttgcttgtttgagccgctataggtctagttgctgtttgtgctagcatattcttgttgtaggcaactagatctaggatttactttgctgtttgtgctgactccgaaaattttcggatatatccgaaaatttcggaaatatccgaaaattactgcttccgcttttagttgttttttgaattagcctattcaccccccctaggcctaattgacacttgtacatgtgtcgtcccatgtacaggtatggctaagtctgtgcccattgcggtgcgtttgtaccatcttagatattcttttgtgccaggaaattgttttaaaccctcgagggaatattgtcttattttctaaagaccatccaaatagttatgaaattcttttgaaaaaaaaataacaacagtaatgcaatgtaaatatcacttcagaaaattttaggttcaaattcaactcatatattgagatataagaaaaaggacaactttggcagatcgataatagtggtactatttatattcgaatttatctcttctttttcagtgtttaggttgaatttgaaattgaattttggtggagttctagacgtcacttactctacaagtctacattgtcaagaaaaaaaatatttttttataattatttgcattgaatttataaaaaataaaaggtgtatgagggatattcactctccattcccttttatgccttaattatttatcgtacatttctctttttacacgatttgtatataaatatgatataggttgaatttatcgatcattttcacctcatatgtattttaaagttgtgttcgtgaatatacgataagggattctgacgctaaggccacgtgatgatgacggagtgacaattggacgaatgcagcgacggtggtggaaggagtgaaggtcattacgatggtggagggatgaacaatgatggatcaaagtagtgtttagcaacgttgcaaaattatcttatctgctgggaccaccattaatgacaccttgctgccgtgccatcgcattggctgcctaattacggttgcttaatttcatccaaatcggatccatcgctcacatagcttgggatttgggaactggagttggggccaacatatggtcatatgcccatccacatacagttgcaaacatatgctctctgatttcctgcctggtacgcgtctacaagacaagcttgtgcgtgggtacacaaaaacaagatgctgcttaccattgtacggaacggaggtttatgacaggtaaacgtcgcgtgagtgagaggacatggagctaatccctgacgttaacacatttgattactactccatattacttttactgttttaaaatataaagcttttaagttttctaaggtagctttaaaataaagttttgaatatcagtagatttactccctccgttttaaaatgtttgacaccgttgactttttagtatgtgtttgaccattcgtcttattcaaaaaatctaagtaattatttattcttttcatattatttgattcattgttaaatatactttctatatacatctagttttacatatttaacaattttttttgaataagacgaacggtaaaacatgtgctaaaaagtcaacggtgtcaaatattttaaaacggagggagtattttactatgaacgtctataaatttggtatgacatgaaaagtacatttaaatatgaatgtaacaatgtcacatggcgctacacatataaattattgagtaaagtacacagccagtccttaaaattggagtaatgtgtcatttagatccatgatcttaaaaaatcaacattagggtccacgatcttgtttaaatgactcattgaggtcctggagctctgatcgggttgactggcttacgtggccatccaaagtggcagaatattccccccc

SEQ ID NO: 67770 - DNA, 42762 bp, Oryza sativa
ccccccccccccccccccccgcgcccggcggccgcccacattttggctttccccgcttccaatccaacccttatcccccaaatcttcttcttctaccacgagcccagctgccccccccccccaagtggaagccctcacctactcacatagctaggagtactccgagagagggcggcgacaacaacgctggcgccacagatgacgccgagtcggggttcgtttcaatttcaaccaaatttcaacttttccatcacatcgtttcaatttcaaccaaatttcaactttcaacttttccatcacatcgtttcaatttcaaccaaatttccaattttgacgtgaactaaacacagccaacttttccatcacatcgtttcaatttcaaccaaatttccaattttaacgtgaactaaacacagccaattttaatattaaatcacccgttctacagtacttctgaccgtcctctctgctacacgtactggcctgctgtattgattatctcctctggaattttaaggaatttgattatctcaattttcaaactgaggaattttaaggaattttgtgaaactaatttaattatgtagaaattcctgtattgatatccgacaagagctgagagcacacatatatatttaatattaaatctagggaacatgatatatactggtaaatatttgttatagtaacctataaatgtttgttcacaccagctaatatatcatttcaataaagtaggaacatgtattaatctataaaaaaaccccaaaaatagtggtgagtagtgaatgtgtgtcaccacccagtacccaccatcactgccatgtgggtcttccaaacaataaggtacatggaagtttgcctcttctccaacctcaagccatcgaacagagaaaatttctttagaagctgggtaaaaatgatgacaaataatattaccaaaagattttacaatgagaataatgccaatagacaatagaatgtcacagacacggtaataaaaatgacggtaggcacataataaataatttaattacactagctagcagtggcacatccgaaaaaccaacatgaaataaaaggaaaataagagaggaaaagaaaaggcaagcagaaagctagctcatcactttattccagaaacggtacagtgtagtgactcgctagcgctccttcctcgggtgaaataatgtcgtcggtgcctcaaccgtgcagccagcaaatgctcggtctccagcgatcgccgtcactggtttgtcgctggtggcatgtgcggcggcttgtgcttgttcggcggtgctataggtttcggtccaggcttaggttcaggtttcagtttaggctttggttctgggtatggtttaggctctggctttggttcgggcttaggctttggttcaggttcaggcatcggatgtggttttggctccgggtgtggcttgggctctagctttgggtcaggtttaggctttggttttggtcctgggtgtggaatgggcttcggcttcggcaccggtttaggttccggttttggctttggatatggtttaggctctggttttggttcaggctttggctcgggcttcggttcaggctctggctttggctctggttttggttcaggtttaagcttaggctcaggctctgggtgtggctttggctcaggcttcgggtgtagcttaagctcgggtttcggctcaggctttggttctgggtgtggtttgggctccggctttggttccggttttggttcagggtgtggcactggctttggtttgggctccggtttcggttctgggtgtggcttaggctctggcttcggctcgggtttgggccccggttttggctctggctttggctttgggtatggctttggttctggttctggttttggttcaggtttatgctcaggttttggttctggctttggctccggtttgggctttggcttcggctctgggtatggctttggttctggttttggttcaggcttaggctcaggtttaggttctggattaggttttggttctggctttagctccggtttcgtctctggcttcggctctgggtatggctttggctccggcttaggttctggctttggctccggttttgattcatgcttaggatgaggctttggctttggcttcggcttcggctccagctctggcggcttctcgtacatcgcacggccctgcttgctcatgaagcgggcgccatggccgagtccctggccagctgccgccgcttcatcaactaaagcgctcgccaccgccaatgccccaagcaggagcacggcggcagtgaggcaaggagagcgcctagccatggctggcaagctaagctcctcctcttcgcttatcttcttctccctctctcacttctgctgttgtacgtaactgaactgtgagcttgtgccagtggatggaaggattgctggggttttatagcccgggaaagccaaacaatgcaagcaggtgtggtcacatgtctccatggcaccctgcttttgtgatctctagctgcttgccagatctcacctagtatcatgcctgcctcccttccaaatctgactattttactcttcttcactttttactaactgctaaccctactttttcctaattaatcagcacctgttctgattaatcaatcggttacttgttactttaatgtatgactagacaattagtcttttgttggaacacatgaattttatacagctttggttagaaactgaagtagtagtaattggtacgaaaagcaagtaaaattgtttgagtcatattcagcagcggagcccgcacggcaaacaaacaggggaaatggaacaagtgcgtaaaatagcttaggctaggtgcagcagaagctagcattgcaggagcaggagatggacggacggatcgatcgtcaatggacatcgccggtggtgggtcgccggaaggacagcagccagaaacattaacgtgggtgaaagtgtccggccctcgcggccattgggcctgttctgcggctgcgtcgtagccgacaccaacagtgccgtgcgcacacgacgcagccgtagccatgccgaacaggcccatattatcttgagaattgcatcgaactgaacacattagattttttatacactatattaacatcgacactgagtaatttaaatgataaatatgatcaattacggaccgatccagcgttgtttttgaaaagatgctaccgtccgttttcagctctaagactacccgccagacagaatctcccacggcttctcctctcaagaaaaagagtattggtccacaggccatacccactctcggcccaatgtctctcctttctcttctcctccatgttgggcttacgcggctgcgtgaatgtttgcaggccatgcatgcaaatcagccgacaaataaataaattcagcatgtcattggtggtacgctatcttttcttgaaatattcctctttaggcctcgtttaaccccataaaaaatgattgaagtagatttaagggattctacaccataacaggtacggtgcacaattaaccctttccaaatctccctcaatcgtcctgagtggggcacgtaggcgttcaaataaacacgtccacacactcacccatatatgatatatatgaacgtgtacacaccttatttgctataagcacctttgaaaactagatcaacatatcttgatatttataaaacaaccgtaagcacgttgttggtgatggacgccgtctattactgaaaaaataattagtcataaatatgtgtaactgtgtcaagtctatgacttaaatttttagtagacatgttacaccaccattaacctaaccagttgagttattctcatttcgctgcctaacttaaaagatggagccgcgcgttgataaatccacgatagtacgctatagatagccactctagtatatttattaataaattatgcatgaagtaagctacccctaataatttaaaagagatatataattaaaataaattgagatgaaatatgtggctttgttgggttggatgcaccaaaaaataagtaagaaaaaggaagaaaggagtacaacctagtgttggtagactccattacgcgtccaaagcatgcatgtgtctgccatgttatcaacaaagacacacatgacacttggcagagttaacacggcatgatgggatatgtcacatatggcatccgattccagaagagaaaaaaaagatggtagtgttaggtgacaaagatggggaaagaacgaattaataattaggaaaaactgtagatgccttgcagatcgaggatacagtacacatgatcatcgacttggactgatgagcagcagcagctggtgtgcatttctctcgtgcctctcgtctgtgtttgagagcgagcgaccaacagttaaaaatggattaagttagactgtactgtctcaattaattcaaaacgcgcgtttgatcagtatgggagaacctttatctgctttcccggtagtatatatagctaggttgctagttaaagtgaatttcaccagacttttctttttagataatatttcacctgactttttagttctgaaaaggtatatggctgatcgtgccatctcagcgaagagaagaattttggaaaatgcatatgccatcgcgatcatcctcaatctttactatcatacccttattccgcgcttttcctcgaaggaagttgagatatattattcacgaaaaatatatactcctttcatcctaaaatatagtaacactcattcatacgtgaatggcaaacctgaagtattgacaccgttgtttgtgtgttcctaaccaggaaagtgtggagctgacttgaagaggacggcacggtagagggtagagccttcttaatgatgcgccctatgaccatagtatatgagaaggcgaccgacataattataatatgtggtaaggaataaatagaggacggcatcacatgaacgagtaataaactaggaaataaccaaggtagagacggaagcacccattggaagggtgagaggtgagtggccaagctatgagctcatgacaccccatacctagagaccgggtctatcatattaatcaacagccaaccattaactcatcgaatcaatcaagtattttcactactacgggaaactaaaccggtcggttgagaaccttgcataggtgccggttttcataactggtacatagtagacgacacagacgagagaaatcaaaggtgtcagttttgaaaatggcacctttgaggtcccaagaataaaaaacaaaagaaactcgatgcatcggctcaaatcccaatcacccataagatttccatctaagaacaaaatcacagaattaagaacaaaatcaacattcatgaacaaacatctaagaacacaatcacagtatcaagaacaaaatgagcgtccatgaacacacacaaagaagataccatcgttgctgttgttgtcgggcgggccgcccctgtgccgctcttcctccttgtcatggtggccagatccagctgtcgttgagctctaggcggctggatctggcggtctctacctccaagcgagagaaaccaccgccatcccagcgacggtgaggggaggaggagttgcagctccgaagaggcgaggagaggggaggagagggaagcaccagagccagaggggtggcgccccataggaggctagatggccggctgctgaagagggaggtgaatagagcgggcaagagagagggaggtgaagggcgagagagtggataaggacatgctccccctccctttgcactaaaaaactggtaccaatagtattggtgtcgacttttctctagaacccacacctatagttgcttaaaagtgtcgactctatatttttttttggttccatgaaggtgggaaaagcgtcaatttatgctagttttaaattgggaagaaagtttgaaatacacccttgattattgggtgagtacaaattaacccccctaaacttgaaaatcagacatccttgaccctcaactatcaataccagatgaattatcccctaactcaattcggcgtgattttggtttcacgttgttgtcccatcagcaaatcttttttttaaatcagtggggcccacatatcaatctctcaccctctctctatccctcacctatctatctctctatactctatctctctgtctctctctttcaaatatcctctctctcttctccctccctcaccttcatctctctttatcaaggacagcggcgggcggagctcaggacggcggacaggactggcggaaggcggagcttgggacaagcagcggcacctctagctctccgtcaccgagaggcagcggcagaggcggagctcgggacgacggaggggacgggcggaaggcagagcttgggacaagcggtggcacctctatctatccatcattgagaagcagtggcggagggggagcacgggaacagtggcgggcggagctcggggcgagaagagctcgagacggcggaggggacgggtggcaggtgaagcttgggacaagcggcggcaccccccccatctctgtcaccgagaggcagcagcggaggcggagctcgagactgccgaggatggtgagcggcagaggcggccatctttcttttccctccccttctatcaattggtttggacgacgagaaacggagttggcgctgcatagtggggcatgtcacgccctgaagtttcccacttttcttgctttaaaattttgttaaataaatcgcccgaagaaattgtttaaattaacctagagctaattccttaattaatgaatgcaattaataattggaattggcattgtgggatttttcttgggtcccacatgtcgtaatatattaacaggttttttagtagaattcttagagccctataaataattttaaccatttaaaattcataaaccgcaataaagtatgacaggaaaatccttttttttcttttcctcctttttccctcttgttgggccatcggcccaacctctccccgcgccgccctccttgctgggccggcctaagcctccccctcctctctaggacaccgacaggtggggcccacctgtcggtcgtccctaacctcccaccgcccacgcctcggcagcaatcgccgctgccgtccacgctgctgctccgcgccccgcgctcacgcccacgtcgccgcccacctcttccacctctcccgctctcgcatgcgcccgaaaatggatgggattcgatttcgaatcccacccccctctctctttcctcccccacgttaccggccaaatagggggccaccccggctgtttccgcccctcccgcgcccatcaaatcactcccccaagcctcctctcccgtttctctcactcgccacgccctcccatgcttcttacaccgtcgcgccgtcacaccaagctccgccgcccgccaacgcactccggccacgcgtcgccgctgctagcgccatcgccacaccgcgcaaccaccgccaccagctttgccatcgcgcgagccacctcggccgccactcggttgccgcaaatcgccccggagctccgattccctcgcgccgccggtgagctcgccattgtctccatctccgattgtttcgtctcgccgtgccgcggctcctcccttcaccctaaccccttcaccgccttttcctaggtcgcaccgctcccgtgcgccgttttccaaagcgccgccgccgctcatcccctccgctcaccactatcactcgccgtcatctctccgcacaccggccaccccacggtgaggaatcccctctcctccttcttttcctctctcccatgagcgccgccgctcctccacgcgtgcgtcgtcgtcttcggccgccgccgccaccttttcgcgccgtccgccgccgcctcccgctccgccggtcgccaccgtcagtggctgtgcaccgccaccgctccccatggccagccggccagttttgaggccgagcagaaccagacagccgccgccgtgccgtccgatcggcctcggggccgatctggaccgtcgttcccgtggaccggcggtggccacccgcatggtcctagtccacggtagaccagcgccctttgagccgctgacatgcggggcccgcttgccggcgccggaccccctcgctgacgtcagccctgggtttattgtgcaataaaattaattaaggatttttctttattagtaaaaacacagattatcttctaaaattcataagtaattcatccgagctccgtttaagtccattcaagtctcagtaaattcataaaaatccctagaattcattaaaaatggttttgtttcctgtttcagtagtcttatagcatgttttgctagtgtgctttgtttgtcgcataggtttcggtcgtttcgtcgatccacggttccacgaagacgttgctgtggtctcatcagtgcgagggcaaggcaagtcatgcattacaattgatcatattgtacccaatttacaaatatcctgcatttctattaaatgttgcattcttttacaatatcatgtgggatgggtcctattactcagccattttttgtttacactatgccattgataacttgggtatcaaaatgactagatgttggtttaggaaatgcttagcattgcttagtttaactagtgcacaaatggggatcacattattacatagactttgactattagcatagctttggattggttccaccgtaatgttgttagttaattaaaatacactgaatggtgggctatgggtgcgtggttttgctggtcgcacccatggcaattaaggaccggttcacgggaaaccctggaagacttgccatgcttaccacaagtgggaatgggtaactgcttgacttgtagtatagctcgaccatttcctaggcaccggtgacaagggtgggcgtgatggagttgggtcagctggggtgtccggttgtccagctgctggattcaccgcggcgcatgaggggactgcccactgcctgttgagggttgggggtgaaaccttagcgtggtgtggatggttaggggagggttatgcgaagggtcttgtcacgatttccccctttgcactatcatggtgatacttcggggcatggcgacatgtgtggaatcgtgtcttgtgggtacagttgtacacctctggccagagtaaaactattcgaatagccgtgcccgtggttatgggcgatcaaccagattcaccgtggttagtcttaccccgagtttagcttagtgaactggtgtagttcaggtggttggttgggcatgtcgcaacgtggtgtagcgttggacagtgattggttaatatggactaattactgcaattgttttactgctttcaactactgtttttaaatgcctgctttatgaaaatgaacctttagcctcctttggatatatcctgcatcatacctcctcttccagtatgacttgctgagtacagtgggtagtactcagtcttgctctcttttcccacacaccagagcggaagttcttcccagttggagatgtctcagaaaggttggtttcattgctgccgttaaggatgcctgtggagtggagtcgcccgctacagaagtcaagttttcaagcttagctcgttttatcttttccgctgcatttgtaatctcttgtatttttgtaatcctggatagaggttttaatacatattcagcttagaaattctgattcgtgaatttctgggcgtgacagggcatcgagcggcggaggcggctcctcctcggcctctgccggcacacgcctcctccacgaccacctcgtgagcttgctgccaccgtctcctacactcggggatgctcacagccagcggcgcacggctcgtcctcggcttccgtcggcgcatggggctcctcctccggtccgtggcgtacaactcatctgtggcatctgagaggagagcggcgagcggcggagagagagagaggtgagagaggataaagatagagagaagagagatatgacatttgggcccatcgtttttttaataaaagaattgctaactggacaaccacgtaggaccataaccgcttgcaaagttgctcagcttggtacttcatctcatattgacagttgagggtaaaagatatctggttctcgggtttacggggataattcgtactcacccaatagtttaggggtgcaattcggatttttcccaaccgtatctatgagtcgtcttctattaaggattttgtagcagtgtttaggcatgaggcatcttattgtcttgtcttcgtgactaggctcgttgtcttaggtactcatcggttgcccatattccataaaaatccaaaacagcttattagccaataaaattaagttattgataaaacttttatatatgtattcttaacgaattaaaagctaatgctgaaaaaactaacttgaaaatattttaaaatcaactccaaaattaaatttaagaattcaaaatttaacttcgttttgacttattagggtaaccaacgggctcttacgtttattcgacaattcatttttgtcgttaactcactcaacgcacgtggatgcaccacgacactaattaactataattagttaattagccaacatgcatgcgtcgtgacatgagcaggctcggctaagtctttgcccagagtggtgtgatggtataatcttggatattttttttaccaagccgttttaaaccctcgagaatatatctcctcgtttttcttaaaaagtatttaaatatttatagaaaatttttgaaacaaattgataacggtggtggaaggactgagggtcgttatgatagtggatatggatgggcagaaaaaaaaaaccgaaccgaaataatcatatcgaactaaccgagaccaaaaaatttggtctgcattttcactaaccgaatttagatcggttaattctgtctttggcgtcggttaaccaaattgatcgaaatatatcattggccaaataatacagatgacatctcagcccactaagcccaataccacctcatccggaggcaaccaactccctgctgcaccaccacaagatcttttcatccccaatccccaccttatgcgcatctccgaagactgcaaattcccccaccgtgcggtgctgccattgacgacctgtgactgcgatgtgctgcccctgctgccgccgcatctcgcctctcaccccaaaaccaacaacccctgccaccgccgccacatctcggcgccctctgatgcatgccggccagccacacctcgtggaggccgtgcgcgggagctagagacctcgccgacatcggccatgagcaaagagatgggagccgcagtaacaacaacggcaggaggcgatgggatggatgggatcttggtccctggagccatctagaacaattgatggcagagatcgatggggagtatcgatttgcttctttttttttctttttcttcagaatcccatcgatctgctttttttttctcagaatcgtgctcgatttgctagtggcatcaaatagtagtgcatcatctgtgtgtttcctttaattcattgatcatgtacagattacttgccattcttttttgttgttcgaacttttgtaacggttagttcggtctatgaccgagaccgaaccgaactaaccaaagaccgaagtgctcggtcgttaaagaccgaattttcaaaaagaccgaggaaccgaaccgaatctctcggttagaccgtgttgtcgaaacgacaactatatacgtcgaaggatgtggttactcaacagtggttgggaaaatgaagtgtactaaattttgaattttccttgggatccccccattagatagccctaggggactatttatagccccattacaggtccttactaccagggtttaggttgtacaggaaaatttacatgattacccttacaaaaggggcatttacaggggtacataatgttataggggctcatgggcccctgatgggccgtctggcgatcgccggcctgatgggctggaaaggcttcctcagccctcgcgggggcgaacttgtcaaggcgaagtcatcctccttcggcagacagtcttcgccttgcacccttcgcctgagacgcctctggcctggcgctactcttcgccttgcaccgctcttgctccatagccttcgccatgggtttcggcaggtttggtcgaagagcctcatgccatccgccaacaagcccctcacgggcaagggtgagactggagcttcggccgagaccgtgcaaaccatgtggtatggtatgcggcgccccctttcgaccgatgctcctgccgaaacctacattattcctgcgaatgaagtttgttatttgtgcggctggtattattttgccgcgcttcgcctcgtgcgattgatggttatatatattcttttttcctgggccgaacggaatagtattgggccttcctatctttaggctttttactgtgccgctcggttgatgggaatttaccgtttcgcctacccttgcgacacgtggcgctttattactggtgggtaggcgaacggtcgcctgggcgggctatatattcctgctgctctttccttttcaccgccacacttgccattttaccgcgcgcgctctctttctccgtctcttcccttcacagcatctttcgacccctcaggcgttttgccgaaactcttttttcgccaccgaaaacgcaccgttcgccatggccccacgtacgccaaaccctacttcggcgaaagggccagatcccggccgagtcgatgacgacagcactgcctttctgggggtctctcttgtggacgacgtcgagctggcgaagctggtgagctccggagcgttggttaaggggcaggcttttgctccagggaaaaccgtggtgccgaaacctgtcgacaatcggacggtggtgttcgccatattttttgaggcagggctacggtttccctgcaacgtgttgttgccagagatccttcgcctcttctaggtggaacttccgcagctgagcccgtcggcgcttgttcggatcgccatctttgactgggtgtgccggacttccaggtttgagcccaacgctgagctctttggcgccatatttttcgccaccgtgaactcgaagacggtgattaccccggctggaacgaaaaaaacagtgttcgggagcgtgaacttcaacgttcgccccgagcggtccgatctctggccggtgaacgctgccatgtcgaagtgggaccgccattggatggcaaggtggttctaccacaccatccccttcgaggctagttctgaatcagcgaaagcccttcgatgccggcgcagggcgattgcgccgaaccggagacccaagatcgctgtggacggcgccatggaggcgcggtttgttctactgcggaaggtttgctcccgccttagctgccgtgacttggtggaggaattttgtatgcttcgtatttttcccctctcccagtcatggcaagtcgcggttgaacaaggcgaagaggtcgacggtttgccgaacctgatacttcctgagggggcgaacggtaagactgttcttttgctatatattgttgtgctttgttatttcgccttatttgacttttgacatagcttcacattctacttttacagtgttgaccctcgaccaggccgaagccgaagcccgcaggatgatcggcgatgtttcggtcgtcgagtatagtcaactgttaacgcgtcaagcggctgggcgggcgaaccgggtttacaatggcgaactgcctccccgggcgaatccccaaaaggccgacgacgaggcagggccttcgcgaaagcggatgcgtggacaagtgaagcttgcccccaagaagcgaagggttcctgcttcgtctgactccgacgccgacgacgaggatgatgccgaagaacgtgacggggaggaggaaggagaggaagaggaggaggtggaggctgtggctgataaggccgcgggtgaggcggtcgaagaccgcgccgacacccccgggtacactcctaccccaagtcctggtcacaacgaaaccagggtggagtcgaacagctcccccctttgtcggaaggatttggaaggggtgaaggccctagttgcgttctcttcgggcgcggcggcgaagggaggtcctgtcaaaaaggtggctaaaaagaaagggctcgtcgatgtcactcgcgtttttagcgatgacgagtcctccgacgggactccgacttcgcccgctggtcgcagcgtggatctttcagccgcccccattcctccacttggcgccgctggagtggacggtagtaccgccgcttaggcttcggcttctgcggaaaggattgtgatggccgcggcgaaagtattcggcagtcctccgcatcagccggttgactcgccgctgatggaggcgaagggaaagagagcggtcgctgagacatccacttcggaatattcgctcccagtaccccgcttcgcccttggcgacttcgagacgcgagcggacctccttccttttgtggagggggtaagcaatcttgtactgcccgccagcgccctgagcttgttcaccgaactgaatgagttcgacgaggggtgctctgctataaaaagcctagctgttcgggtacgtttcccccccgattttatctttactcttcctctatcttgtttttacaattgacacttgttctcttcgccgctcgtattctgcgcccagatcctcgcggctcactgctcaacggagcgaaccgtgcgagctcgacttgatgggttcaaaagccatcttcgggccaaggatgacgaactaggccgcaaaaatttagagatggaggcccttgcaaacacccttaaggaggcgaaggccgaaaacaagcggctccaatcgaaactagagaaagggaaggaagctagggccgaagtcgatcgcttaaaggccgaactagagaaagagaaggcccacaccgccgtgctcatagattattataacctcaccgagccgaagatggaggctcttcggcaggaggttcgcaaggccaaagcaagcgctgtagaggagtcgcggcggttttcgcaggaaatggtgaaaaccaccgagtccgcgcggacagcgtgccaaacgcttcgccttgcccttactgatatgggcgcgaaggtgcggggtgtcccctccgaagatgcctcagccttcgacttctccgaatggacctaacaggctggtggttcggtttcagactacgccaccgcatacggcgattgctgtgcacgcgtgtcagcggcctttaccatgggcctcctgcagcagttcggctacgagcacatcgccgagttccccaagtacgcgaagggggattgggaaatcagtgggcaagacatttcacctgcacttcgtgcgtggcgaaaacaattttggcagaaggacggccgctccgccgctaaggcgcgccttttggagcagctggcgaaagcggaggcggcggacatttgtgaagaggagggcgcggcggccggagggggtggaggcgatgcccaggatcacccagaggtgtgaggccctccgcccttctcttagattttcatagttttcttttggtgttcgctagatgtggcgaaccattgtatattcggcaaactgccgctaaaccttaaaaaaggcttttttgcatacttggactgtatgataattttaaccactttttaatgatcaaagtctttggcatattattatttcgctcattttgcattatgccaaaccttccccttctttcgcctattcttaccatgcaagatgtgttttgccttttctacactgtctaccagggggtctgccgaaaatcatgcattcgacccccttctgggagctggagaagtcaaaacgagaaatttgtggcattaaagggtttgccgaaggtgcgatgtccatttcggcctgtttatcgcgaaatggaaaaaaacggtcgcagctataaagttttcaaggttgccaactggctgcgggcgcaccccgggcgaaccttagaagattacgatcttgttcattcaagacgtttggaggatatggctcgcttttggcgaaaccatcagaagactaaacgccaggaatcgatctttcagcgtcgttacagtttagtctgtgtttcgccccctactcctcttaaggttgtgtataatattagtagtgatgacgaacctaattcgtccgaccattccttagggagggataatgattactggggcgaaaatgtaatttacttgtaaaatgaattgtattgggttgtaaaccttgtattcttcgattattttttcgaagctaataaagaacgtgctttatttccttttcgctatttttcgcatcgtcacactttgtgcttttgttaggtcggaacatgccggcccctttgcatatagtagcgaaataggtgtagtgacttcttttcgtcgttcgttttcgatctgtagcgttctgtgtcgagagaaacgcttttgcttttatgctgatcggtcgtaacgtcgttcggctatttattttccgagacaagctgttgcggtttcaacgttcggcgagcaatgcttcggccgattcgtttcgcccccctggtctttttcgctgatcaggcgtttgtcttggggtttttccacaaattatcaatcacacgaaaagaaataaaaagaaggcggaggacacaaagattttatactggttcgggcctccatggtggataatagccctacatccagtttttttttctttttctcttctcttttttcctttttttttcttgccgaaaggcttatatagtgccgaaaggcttacatgacagtatgtacatttttacaagttggcgatttgggtgccacccattctagacataaaagcgcttgagggaggcggcgttccaggaatggtcgaactcctcgccttcgagtgtcgctaggcgaaaagatcccgtcctggacttgtgtttgataatgtatggtccttcccactttgattcaagcttgccaaccgctaatgggttcgcctttttccttaggacaagatgaccaggcatcagctccgtgggtcggacttttttgttgtaagttgccgaagtgcttgtggcgtacttgtgcatgtgctcgagcgcttcgacccttacagcttccaagagttcgagcgatacctcgcgcccctcttcgcccccggagaacataacccttggtgagttagcccctagctccgctgggatcattgcatcatcgccataaagaagcataaatgggctaaacttggttggtcttatgggggtcgtccgaagggcccaaagaaccgataacaattcttctggccatttgcctttcgccgccccctcaagtcttttctttagtgcttctaagatcttgccatttgtacgttcggccgccccatttgactgtgggtgcgcgaccgacgcgaacctgatttctaggttaagcgcttcgcacatttctctgaacttatcagagtcaaactgcttgccgttgtcagtaatgaactcttttggcaccccgaaatggcaaataatatttttccatacaaacttctgtactgctgccgaagtgattgccccaaggggttcggcttcgatccatcgagagaaatatcccccagctacaattacgaattaatacccgtttcgcccccccgggaatggcccaataatgtccagtccccatctgccgaagggccatattggtgcaatgggctgcagatcatactggggcgcggcttggcttcggccatgacgctggcaactttcgcacttcttgatttgctcaacacagactttcatcacagtgggccaataaagtccttgtctaaatactttggaggccattgttcttgcagcctggtgcgcgccacatagcccttggtgtatttcctttgccatttcttcgccttcggcaaaagagatgcaacaaactaagggttgaagtaccccggagcggtaaagctgacccgagaccatcttatacttcgtggctctgagttgcaaacgcttcgcttctgcttcgtctaccggaagccagccagtttcaaggtgtttcacaaatggggttcgccagtcatatgagtcttcgcccagtttctcttggtcgattgtcatgacttccgagctgtccatgggcacacttggagcatgtaggacttcgaaaaagatgccaagcgaatgcgggccaccacaagcagcggatttcaccaaggcgtctgcttcatcgttttggtctctaggcaagtgttcgaccgttatgccggtgaagcatttttccatggaccgaacagcctccagatacctcttcattcccttttcttttgcctcgaaggatttgtcaacatggcctgctaccaacttggagtcagttcgaattagcaggcgccggactcccagtgctttcgcctttcttaggcccaggagaacggcttcatattctgctgcattgttggttgtgttgaactgtaatctcgctgcgtaccgaatcggcacaccattcggcaaaaagaggactgccgcaacgcctgcccccttgtgcgaccacgaaccgtcagagcacatcacccagaactggtcatcgggctcgggctcgggggcaagtactggtgtccattcagctacgaagtcagctagcacttgagacttgatagcagagcgtgcaacaaaatgcaagtcgaacggggatagctctgccgcccacttgctgagccggccagtgacttccttgcctcggagtatttcgcccaaggggtactgtgatgggactatgctttgtgggcctggaagtagtgcttaagcttgcgcgaagccattactagagcgtaagcaagcttttccatttcaatgtaccttgtcttcgctccttgcagtgcttcggagacgaagtagaccggtttctgtccggactctgtttcttggacgagtgcagcactgactgccaccggtgaagctgccaagtataacagcagttcgcttcctgggggtgggcttatcagagctggcgggctttgcaagtattgctttagctcgtcgaatgctgcttggcactctggtgtccaattaaactttcccgcgccccggagggtcttgaagaagggcaaacctctttcggccgcctttgagaggaatcgactgagtgctgcaattcggcctgtaagcttttgtacttcatgtacgcttgacggaggcttcatttgctggatggcatcgattttctcgggattcgcctcgatgcccctttcggaaacaaggaaacccaacaacttgcctgcgcggacgccaaaaacgcacttcaccggattcagctttatgcctgccgcgcgcaagctgtcgaacgtctcttgcaggtcgaacgcatggtcgaaagccttgcggctttttacgacgatgttgtcgacgtaagcttgtacgtttcgcccaagctgcttgccaaggaccttgtacaccagcctggcgaaggttcctcctgcgttccttaagccgaaaggcatcctgaggtgacaaaatgtgccgaatggagtgatgaaggatgttttggggatgtcgagcgggttcatgtggatctggtggtaaccggaatatgcatccaggaaactcatgagctcgtgtccagctgttgaatccacgagctggtcgattcgcggcaaggggaaatcgtctttcggacatgccttgttcaggtctgtgaaatcgacacacatgcgccatttgccatttgacttccgcaccagcactggattcgccaaccactccggatggtcaatctcttgaataacccccgcccagagtaatttttgtacttcggtcttcgccgcttcttggtgatcggcaaacatcttgcgcaactttttctttcttggcttaatatttggcttgactgctaagtgatgcatgatgagatccgccgggacgccccccacctcgttagggctccaggcgaagatatcgatgttctttttgagcacctctagcatgctctcaacttcttcttcgcctatgtggcccccccagtgatacgagctttgtggggtcggcatcgtcaatctgcacttttgttatcttgccgtgaggggtgggcttcggcgtgtgcttgggccgctcatgcggttcggtctcaacattgtgcactgctctgttgattatggctagatcgcgttttgaagcggccgaaggctgaagccccttgactactatcacccctgttgggccaggcatcttgagcttgagataattatggtgggaaatggcttcgaacttgttcagggttgcacggccgaagatggcgttgtagttgtatgggatgtcgacgacgtcgaacagtatttgctcttcgcgcctgttttctcctaagccgaaagctatcagcaaaagtgcttggccaagaacttgcactgcctctccgccgaacccccggagcgacgttggtgccggtgcaagagcttgggttggcaagcccatcttagcatatgcttcggcgaagatcacgtcggccgaactccccctatcgaccaggattcgtcggacttcaaaaccggctatctcagctgagattaccagtggatcttgatgcgggaataggactccttcgtcgtcttctggcccaaaagagatcagctggttcacgtactgtggcgccccctcacccgccgaagtgatgttgtggaccatacggatctgcatcttcctccgccgtttcgacaacaggcttggcggatcagctcttgtaatcacttggattacccttcgttgtgtatcttggcgttgttcggctgggggtatttgctcctgaactgcttcacggggtgcttcgacagttgttccttgctgcggccttgggtcttgcgcgttgccacgttgcctaatgtttcggcattgctccgtggtgtgcgaagagcattcgtgaaaagcgcagtagaggtcttttcggaccttcttgcgggctggctgctgatggttgcttgcttgctgggcgtcgaactccttgcgtagggcttgcacttcttcgacagccatcacagccttgcccgcccgatctgttctgaactttctccaagtcatgggggcttggccttgccttggcggctgtccctggatcgccggctaagactggcgaacagagaagggaggtggatcggcaatttgaacttgtgcttgagcttgagcagcggcgacggaggctttatcgtactcagcttgtatagcttgccgtcgcttagaatcctcctcgccccttgcgaacccgtcaatgatgcgaagtaggtgctcgagcgtctgcggctccttgttggcgatttttcttgttagttcgccctcaagcagaccggccgaagcggcgtttataaccgacgcctcggttatgtcttgaacttggcaccgggcttgcgagaagcgacgcatgtactcccttatcgactctcccggcctttggcgaatgccaagaaggtgttgctgcgtcttcggctcctcataggtgcctcaaaagttaaggacaaaaacatcgcgcaattgctcccatgagtaaatgctattggctggtaaattgaaataccaagaacgggcgatgccgtctagagcgagatgtattaccttcgccttggtattttcgtcaccatgagccgcttcgatcgctgactcgtagatggagaggaactccttcgggtcagtttcgcccgaataatgtgggacaggtgggaacttgaactggggcgggattggacgagtcttgattcccccactcagcggcagccccttttcgcctcccgccctgtttaccgcaccttgctgcgggtacggtatggcaaagggcgaaatcacggcttgtgcgtggagttgggccgcggcattcgactacccggctccaactggtggtacttgctgggccaccatggatgggtcaaagattggctgcgacgacatcatggcagcttggattggtgcttggtttgttccgaagcctagggttggaacttgctgccgaacggttgtcacctgagcagtgttgccgaagtcgaactactgtcctttactccacggcgaaggtcccgagcttggctgaatcggtggcaaccaattaggtgcaccttgacttgtattccccaccgggtgagccgatggggttgtacttgaaatgtagtggggttggttgagttgctgaaggaaagcttagagttgcgcctgcagagtcgaagccccttccgtcactgtttgtgtcacttggccaggtggttgatgctgctcggcgaagtacaccggcggctgtgcggctagtggtggagagggctgggtcaccacttgcggccggacttgaggtggggcatagcctgccgaatactgaaggattggagccgacgttgccttggtccgccttgtcgcctcgtatgcttgttgttgttcttacatttggcaaagcatgtcttggagccgtgtcatgttctgccgcatggcttccatgtcggcttcggcttgcacttcggggtccaggctgatttgggcctgtacaacggcgagcgcaatcggcgccgccggctgtgatggggcggcttgaggcaccaccagttggtttgtcgaaaggttccccgccctggtctggagtgcccttgccgccgcagccgccttcgccacatcggccgtgttcggcacttgcactgaggttgcgggggccgaagacagttgtgatggcgcgggggccgaaggcggctgtgatggcgcttgtccttctccatcttcggccacggacgccgaaggctctgctccttcctcggcggccatgtctggtccgtcgtcgctctccttccgcctgacggccttctccttcacgaccctcttcggtggcactcgctctcagtggtttcgctcggagtccccatggacggcgccagctgttgtcgaaacgacaactgcatacgtcgaaggacgtggttactcaacagcggttgggaaaatgaagtgtactaaattttgaattttccttgggatccccccattacatggccctaggggactatttatagccccattacaggtccttactaccagggtttaggttatacaggggaatttacatgattacccttacaaaagaggcatttacaggggtacataatgttataggtgctcatgggcccctgatgggccgtctggcgatcgccggcctgatgggccggaaaggcttcctcggccctcgcgggggcgaacttatcaaggcgaagtcatcctccttcggcagacagtcttcgccttgcacccttcgcctgagacgcctctggcctggcgctactcttcgccttgcgccgctcttgctccatagccttcgccataggtttcggcaggtttggtcgaagagcctcatgccatccgccaacagaccgaatgcccacccctaatggtggaggatgagcaaatggtggattaaagtacagtttaacaacgttctaaaattatctcagctcatgggataagaaagtaatgttggttggttttatcggctaataccggttagctagggaaggggtaaaatcctaccagatttcctttcctaacaggaaagaaacgaaacaataaacgaagggacaagagataaacgttaccgtgattggtgataacaaattttgagtcttatccggatcgaccccgagtctcaccagtgcaaataaaaagaaatgaaggcattgaggagaggtgacgactaattctctacgtgtaaattctgaagccctaaaaaagagcccgattgatctcaaacagtggaaagggtttatagtgcaaaccactcctgtgcaggtgaatcaagaaggacaacagaagaatcaaaagaaattagcaaaacttcaattcatctggtcagtaattatctcaattccgtatttagaattgatgatcatgtcttaagctaaaaaatagatcttgagtaaataatttcaacaagtaaacgccaccattaatgatacctctattttctaaaaaaaaaacccattaatgatacctcttgctgctctgccatcgcattggtcgcctaattacggttgcttaatttcatccaaatccgatccatcgctctcgatcgatgctgcctgctgaagatcatagcttgggatttgggaattgaagttggggcctacatatggtcatatgcccatccacgtacagttgcaaacatgctcctctgatttcctgccgggtccgtgtcacgcgtctacaggacaagcttgtgttgtgtgtggagtacacaaggacgtacaagatgctgtttatcattgtacggaacggaggtttatggcaggtaaacgtcgcgtgagtgacaggacatggagctaattcctgacgttaacagagttgattactatactacttcattttactttaactgttttaaaatataaggctcgtaagttttttaaggtagctttaacataaagttttgaatattaatatatttcttttactatcaacggctatataaatttggtatcatatgaaaaatacatttaaatgaatgtaataatgtcacatggtgcaaaacatataaattatttttataatacagcaaatgcacatgtacacacaacaccaccctcgcacaccctcgtgaacccatcttttaacacacggttaaagagacagaaaccaaccatacattcttaatttcactaaatttctattaaaacagtgtattcttgatttcataaaattcttataatcacccgtgctccctaatacatataaattattagttcaattattaattaaagtttgtaaattttgattttttttaataaaaaaacatgtggatgtcttttgcggtgggactagagtagtacagtagtgctccttcggctcctgaatggtcatttcttttttttgactcttgtgaatactctctgctgcattagcctgctgtatgattatctcctctgcagtctgcagtgtgcaccaatggcgagctggtcagtcatttacaacattggctgggtgtttcccttcaaacttcaaatttttccgttatttaaaatttttttgaaaaaatttaaaaacataagtcacgagtaaagtactattcatgttttatcatatcataacaaacaaaaaatattaattataaaaaaattttaaataagacggatgattaaaattggacgtgaaaacttatggttagactgaaatgggacagagggagtactagcaggagacagtggcaacgatgtgtttaccaatggggaaattatggtaccccgcactttgtcggtgtattctactagtaactaatagtagaatagtaaaatcaacaaaaatcaatgcaggtcatgagttaaaccgtgaacctgcagagggcagactggaacaaaccaggtacagattggattacccatgatgcttattttacgtactaatgcctccctctcaaaaataaattcattttctatcgatccaacgtatatcaatataaaaccaaaataactagaaaatccccactttatcaaatccaaatttaattatgtttctttatctaccctgatacatttatcatatacttttacaaactctgatgtactgattgcttgaaaaaagatattattttgagataaatgggagggaccaaagacttatgtagagatggagggaggagaagagagcccgtaccattttcactgtatttatgaagggcgctaattcaaaatgtaatatttaggataaacagttttgatattttagtgttggatagtactctctccgttttacaatgtaagtcattctaccatttcccacattcatattaatgttaatgaatctacacatatataatctagaagaaactcaacaggagcagtattaaacagaactggacagcatagaagatgcacacacatatatattattatttatatacactactaagtagaaaagaatgccacagacacggtaataaaaatggcagtagatacataagaaataatttaattacactagctagcagtggcacatctgaaaaaacaacgtgaaataaaagggaaaaaaagcaagcagaaagctagctcatcactttattccagaaacggtacagtgtagtgactcgctcgctcctccctctggcgaaataatgtcgtcaatgcctcaatcgtgcagcagcaagtgctcggtctccggtgatcgccgtcactggtcggtcgctggcggtatgtgcggcggcttgtgcttcttcggaggtgcttcaggttttggctcaggcttaggcttaggtttcggttcaggctttggctctgggtatggtttaggctccggttttggttcgggcttaggctctggtttaggttcaggcttcggctctggttttggctccggctgtggcttgggctctggctttggttctgggtgtggtttgggttctggtttgggatccggtttaggctctggatatggtttgggctctggttttggttcaggctttggctcaggcttcggttcaggctctggttttggctctggttttggttcaggttttggctctggctttggttctggcttgggctcaggcttaggctcaggcttagggtgtggcttgggctcaggctttggctttggctctggctttggctctggttttggttcaggttttggctccggctttggttctggctttggctcaggcttaggctcaggctttggttcaggcttaggcttaggctcagggtatggcttgggctcaggctttggctttggctctggctttggctttggttttggttcaggttttggctccggctttggttctggctttggctcaggcttaggctcaggctttggttcaggctcagggtgtggcttgggctcaggcttaggttcaggcttaggctcaggctctgggtgtggcttaggctcaggtttcggatcaggctttggttctgggtgtggtttgggctctggctttggtttgggctccggttttggttccggcttcggttccggttttggctctggcttcggctctgggtacggctttggttctggttttggttctggcttaggctcaggtttaggctccggctcaggttttggctctggcttcggctccggttttggctctgggtatggtttaggttcaggcttaggctcaggttttggttctggctttggttccggtttaggctcaggctcaggtactggttttggctccggctgtggcttgggctcaggttttggcgtgggtttaggatgaggctttggctttggtttcggctcaggctccgacacttctcgtatgtcacacgaccctgcttgctcatgaagcgggcgccatggccgagcccccggccagcagccgccgcttcatcaatgaaggcgctcgccaccgccaacgccccaagcaggagcatggcgacggcgaggcaaggagagcgcctcgccatggctggctagctaagctcctcctcttcccttgtcttcttctccctctctcacttctgctgttgtacgtggtagaactgaactgtgagcttctgtgatcttgtgccaatggatggaagggtggctggggttttatagcccgggaaagccaggcatctgtggtcacgtgtctccatggcccccagcttttgtggtctcgagctgcttgccagctctcacccagtatcctgcctggctgcttcccctttccaaatctgactttttttttttacccttcttcactttttaccaactgctaaccctactttttgctaattaatcaacacctgtgctgattaatcaatcgattatactttgctatacttcaatgtgtgactgggcaactagagctttcttggaagttggaaaaacatgaatatttcagacaacttttgttagaaacggaaataccagtagtagaagtaattcgtacgaaaaccaagagtaaaattcttgagccatcatggcaatggcgattggcggagcccgcaaggcaaacagtgtaaatagatgcagcagaagctaagcattgcaatttgcaagagcaggagatgaatggcagcaatggcgactgaacagcaagaaggggacagcagccagaaacacacattaacgtgggtgaaagcgtcccatattcccttgaaaattgcatccaactcaacacattactagattacccgcgtttcacgttgcattcgatctctctgtctctgctacaacgtcgctctctcgccgatctctcaatatacacggggtagctagctaggagctaaccggctgctgtgttcagaccggccactgtgtttaattgccgtgatgcttcaacgaagttgacgaaactggcacggggttggaaggatttgaaagctaaatttgtggtagatttgtaagacagatgggtagatagatagattatgatcgctatcgatctgcgaggtcgagtaaactgaacttaatttgctgatttttcaattctttgacgccctcggctctgcgacgacagataattcaaggtcccgtacgtcaagctattttactggtttctagtttctagaaatattactggtcctggtctgttgaaaacttgaagtacacgtacatatcaacatatgtacacggtacacctgtattgctgatgattttgttgctgtatgtgccgaccttctggaatactaccttcatttattgaattaaccaacggtcatacttcctccgtttcacaattccatatacatattgatgttaatgaatctagatatatatatatatctatctagattcattaatatcaatatgaatgtgggaaatgctagaataatttacattgtgaaatggagggagtatattattgataagggtaatatggattttaccttgagagcatgtacacgtaagggcgaacatctacacaacgtccaatgtacgagtttggtcgtcattaaaactagcaaggtaactagcctgtgtatttacgcgggtatgtatcgtagtttgtatttgaaagacttgtaagtactatttctccacaaattttcttcatgcacactgcttaaataagtttttcaaactattagtttgctctaaactataatcgtcttcattacctagaaagaaggtagacttagattatttagagaacatgtcaattaagtgtaaattaaaagtaagatattttttaattaaatgtttaggtgctctcttttttaacaatttaaaaaactattatttctaataaatgtgttttatttgtacatgcaagcctgccttctaattggttcatattgacggttacatatgaattactaaatatagaggatatatcctagaccttgttttcctatgatatgcatgatctacggtgtgtgtgcgttttcaaaaaaaaaaagctagtcagcatgagttctgtaattaaaatttaggagtaacaaatataacattaagcccactatataatgctaccttaatgtagcttatatatgcaataatgtgtggagaaactcataattccacggtacaggataagtggaagtccgtatcatatctaagcattatttaaaaatggttatggcaattaaaagccaatggttgttccaatttaagtcaaaagtaagaatcatttcttacgaatttaatagatttttctccgaatggctcaagctagtccctattgccagattgtaatttatgttttattttataccaattttaagttcaaaatataggcattacgaaacttaaattgttggtttatttatgaatagagcaacaattcgattaaaaatcagatgtgcagcttaaaatcatggtcgttttaatgttattgattgtttctcttttagtttgataagtacatagagggggagaagaatggatggtggagagcctaagtcgagaggagaggagaggagaggagagggggtgggcagtgctgtgtgtattcgaggggaagggcaaggtagaggggaaattgtttttctcattttactaaatggtttaaagtgaaaaccgatgataatatggtttttttcacaaaatttcaaagactttttataatttttatgacgtgacatatggcaacaaaagatttttctaaaagtatacctaatggttagaaataattgatctatcgatttgattagaaaccaatagtcacatgttaatttcctcataatttctgagagattttataattttttagacgcaacacatggtgacttagagagttatagaggatgtagattgatttaatatgatgtactatttattgtcaatttttttatagtgattcattgctgttgttatttggtcgccacacaacgaatagaacttgatgttccaaaaacatatgtaaatttttattcaatacaatttgagcaatattcatcttgaaatttttatttaattataaaacaacagttcaaaacaaactaaaaattgaatataacttaagaactattatcatttagcattgcattcattgattatttttatattaacatgttagttaaaaagtaggagaggaagggatatcctgatgggagaggccacatgcgcatataatggaggatggggaacatacaatagtggtatggaacgagtgaggatgagagtttgttttctttaagaatacaatggttagtaagatctaatgttataaaataatacgtccatcacattaggtgaaatttgctaaaattctattacaattatatatgttttgtgcttttgtacaaactgattgtgttttagttcctattaattactttactaactgaaattagcattaacaactctattgattgattaagatctatccttttttttttacttctgtgttcctacaatatattcagtgtagatattaaaaatatgaggacacaaaagtataaacgtagttttcatgaaaaatctgataatattattgtgacttatcataatttaagaatggggagagcaatttttaagaacaacaatcacagttttgcttattttaatgttatatagttgtagatataatttaattattatgaagttatgtacgatagtaaattctacattattagttttttcatatgttttttaatagcatgaaaaataaaaaaaacccaaaaatgacatattccttttgacggttgaaatagggtaaatatgggtctttaaatgtaagtttgttttcataatttttttaatggcatgtaaaataaaagagtaaattgcacccacaatgcaacaacttggcaggtgggtgcgatatagtgcaagaaattgagaattgaacgtctgagtacaacaacttgacaagtgggtgtgttctaatacaagaatataataatttattattttggtgtatcaacttggctaagcatatgctaggtgagttttttttaatcatatggatattaccttataatattgaatttaatttttaagaattatacagcacataatagtataatttacatccaattaccattaagaattttttgttgtcttcaccttctcaaatatcaaccgaaatataataatttttatatccaatttaattggctttcagttattagttattaggataaaaatataaatatacttttacaaatatgtgctagtatattgtcaaaattagtacttaaaaattgaatttatataaaaaatactccgaataattaagttgccgcataaccttttaatttattgtatcaaaatcatacctaccttgcaaattattgcatttatacgatcactgataaagttcttatactaaattgcacctacatgccaagttgttgcactagaacactcatttctcaagttattgcatcaaattgtacccacatgtcaagttgatgcatcgtgaatgcaatttactcaaaataaaaactataaaccaaagtgacatatttatttaaaagttaaaatatagtaaatatatataggtctttaaatgtaaattttgtcataaataatctatcaaaatatgagttacctttatgatttacatgttatagctatttaatttttttattagaaatcatgtttcctaattaatgtagcatcaatataggggagagaaacagaaagatgggcgaggtgtgtatgtccattacatattcatccacacacgggtcggccggggttgggccgtgggggttaggaggtggctatttatttttctaatcaaacataatttaaatggttaaaagtaatgggtccatcaaattaaatgaaagctaatggtttagattatttttaagaagttctctaatttattagagtgtcatgtggcatattggaaacgtttacgggggtgtcacgtgacgtcttaggaggttttataggatgtttgatgaatttttactatataatagatagatagattcataggtacaatgaaaattgattgtttttccggggagtgaagatctgcatatgaaaattaatttttgctgtgagtgtggacctgtatgtgaaaatcgattacagtcgatccacacgtgaaaattgattttgggacaatttccctacaattaacatatgttagtgcaccataatattattatgcaatagtagatgttaaaaaccaaagtcaactcttgtctctcctcccccttttaatttgtctcccattatcaaaatgttactagctagctgacagcattatgcatgggccatcatattattgattgttccaaatacccagatgcgtacgtttttttaatggaaaaatctatactccacgtactaaattattttgtactagcactagtactaatgtgctacgccgtaactacatctacatttaatttctatatgtagcagcaaactcatgtaattaggtgtgtttagttcgaaaaagaaaatttttgagtgccacatcgaatgtttgatcgaataggggaagtggttttcggatacgaataaaaaaactaatttcataactcatctggaaaccgcgagacaaatcttttgagcataattaatccatcattagtatatgtgggttactgtagcacttatatatggctaactattgactaattaggctcaaaagattcgtctcacgatttctcccctaactgtgcaattagtttttttataattttatatttaatactctatacatgtgttcaaagattcgatatgatattttttgaaaaaaaaaatttgagaactgaaccagaccttaacatcccgtgggtgtaaaattcaggctgcttggatgccaagtcgatcgagcagcagcgtaggctccaaaactgcgcatgagtactattttttttaacaaatatgtgctcggcagaacataatttcgagcgcatatcaggaattccaaggaggagaaaacttctactatctccatcttaaaatgtacttcctccgtctcaaaaaaaaaacttaacatcatactacgacgtgacacatatatcacatcctaatattatattgtttttttagcacggagaaagttactatcagtataggatgtgatattacatggtgctacgaattggtgcagggcagcagcagagggttggattgacgcaccgacgcgagcggccgatatcatctgtgctgcacggggtcgtacacgcactgaacgacacgactactagtggaccaccggactgcctgcatgccgcgccgcgggctccactccaccagtagtccactgaatgcccacaggactaacagctagctagacactgcagtacttgtgagccaagccatgtgaagtgatgatcgatgtgaacggagatgcctatgccgatgggatcgacgtaagtgtagtatagggaggtgaaaacgggtcggattcggtcggatcccatctttcttatatcctaacccatattttataatcggaatcgggttggacacggatagtgccgaataaggatacaaactcagataatgtcgagcaaaaatacagaatgaacactatcggttacgaatatttattcggatatcaagtcgaagacaacaatcttatatatcacatagacaataaccatttaacaataccatatatccataatacaattatattaagctattaggatcttagaaaataaatagggtacaatacatcgtagtagaaccaatacatagtactaaaagttacctcacaaaaacataatacgggtaatatctgtataattatccgggtaatactcggaacttttactggataatccgtatccgtcggatactacgtttccgaacccgatctcgtatccgccaaaaaaggcccgtattcggacccgatatccgaaatttcgatccgaatttatcccgaaataatgtggccgggcgggcgggagggaaatacccgtcccgttttcacccctacgtagtacgtgcacaggcgcaacagtcatcggcaccgggtcgacctcaatgtttaggccctgtttagatccctagcaaaattttacaccctgtcacatcgaatgtttggacacatgcatgaagtattaaatataaacgaaaaaaataactaattacacagattgtgtgtaaattgcgagacgaatcttttaagtcgatttgataatatggtgctacagtaaacatttgttaatgacagattaattaggcttaataaattcgtctcgcggtttacaggcggaatctctaatttgttttgttattagactacgtttaatacttcaaatgtgtgttttaatatatccaatgtgacacgccaaaactttacacccctggatctggacacagccttagggtttaatttgtttggagattttttttcatagatgtagcttcttccaaaattaaagtcatccacaaacattctatttttccgttaaaatttaaaaagttgtagaacttataaaatgtattagaaaaccacagcctaaaaagcccaggccagcttcttcatagggtgtgtttagttcacaccaaaattaaaaatttggttgaaattggaacgatgtgacggaaaagttgaaagtttgagtgtgtgggaaagttttgatgtgatgaaaaagttaaaaatttaaagaaaaattttgaaactaaacacggtcatgatcgaagaagctgggtaccaaccaggcaatagaccttagctacatgggcacgggacgaggcgcggattgatggagaagctatagctagctagcccccacactacgtaccccacagccacgcgcgacggtcggccagccgatcgatcgcaacctatctgtctatctatctcgccaaaacgcgtgcgtgcactagtgcccgctctgcagcaattgcctcatgaaccctctccaagactcgaacgatccatccatcgttctatcgcaggcagatgagggtggatgtgtgtgcaggcaggccggggcgggtggagggtcaccgcgacgtacgtatggcgaccgcttccccgcggccgcgcgcgcacgcacggcggctggcgtgtgcatgcacaagagtccatccgtaggcctaccagccgggtacctaacatgcatgcatgtaatctagttacgttccgcgtatataacatattctaatactactacgaattatgacattcggattatagtattatggctgtgtacgtttagttcacgctaaaattgaaagtttggttgaaattagaacgatgcgacggaaaagttagaagtttgtgtgtgtagaaaagtttcgatgtgatggaaaaattaaaaatttgaagaaaaactttaaaactaaacacacaaacttctaatttttccatcgtaccattccaatttcaaccaaacttccaattttaacaacacaccctcagtacgtttagtacgtgctactcagataaggccaatgagagccgcacatagcgtgacatatgtgcgatatacatccgccaaccggatacgtataaagtctgaagttgatcgatggaaatatggaatcgacgtagggataagatagaggggtacagctagtgctgcaggcagaaaatcacaaccagagaaagggaagggaaagggttcatccaaaattttgtatttcatatgtttagtcatattcagttattcagttaggtactactgtttcatttattgtattacgactctctcgagctagcctaatatatatctcgacgacggttcgcattatataagaaattaaagacgattgaaaaaaaaaaggaattgagagctatgacaactagccaaatcttaagtgaaaacaaaacacaggaatccatgtagagataagtaagagtacaaatgcagtgagaaagttacaataagagagagatggttcagccaaaatttttgtctcgaattgcatatgtttagtcatattcaatcacacaatgttttattatatcacgactctctctagatagccaaaattggtggaggatagttgtgatcggttataagagatgagaaagttggagaaattaataagagatggctgagataaggggtatatatatagaagtggttatatattgggacataattataattaatgctaaatgtagttatattatgaaagggaggtgataagaaattaattaatggctcctttcaaacacaagattgcaaaaattacagaaataggaacaataaaggaattaagcatcatatatatatagctagccgaatctcacataaaaaaaacatgtatgagaatttggtaaagaggattttggttgctccagagaaaaatgtaaaagatgggctttcatcaaatgttttgggatcgatggaaaacaaatcatgtagtgattttggaacacattcctacaatacaaatgactttacagggaatattctcataggacttcaatccttcaaaattcatgaaaaaaattctcaagtggtgtttgataaattatatatattatatgcttacaacagagcatgtatatatgtaattactactagtttgccttgctttcgtttattgtgctccaaattatttaatttgtcatgcaatgcctagattacaagtggcacacattaatttccaccaagtcttgggaaacatatcatgtagattatcgtcattatatgtgttgctgatgtcggtgtatgggtggtggttattttttcttttttgccagaatttttttccctgttccctatgtattatggatttgaggttgaaattgtacccaacttaccaagttgatatactagaaggctcatttatcaagttcttgcaccagaactattaattttaaataataagtagtatttaaatgtatgttaagttggtacatagaccacattatgatttttttttaaaaaaaagaacatagtacaaacataggcgttcaaacgtgcatgcacccatccctataaacgcacgcatgcacaccctactcctatgagcacttctgaaagactgagccgatatatcttgagattgacaaagtcatcacggatgtcttgcttttcacaagtatgtcgcgtaccagcaaaagaataattagccgtgtgcacatgtggtgggttagttacaccgcaagaaacctaatcagttgtttctaaaaagaaagaaatataatcaaatgagttacgctcacttcgcacattatgttacatttgtactcaaaagtatagggagtatatattatcaataggttaattaaattatgtaccagaatcatttagtctattattttttaaaaaaaacaaatcctccctacatagtgcccaaaattaaatgcccgaaaatgagatatacatacacataggcatcaagctataaaaatggcacgtttttcctgcgaggtgtttcagggatttattaatatcatattggtgacagtttagcagacggtactgaataatctccccattaatcccccgatgcccccacacgtcactggtcggttactaggtgtcgccacaagtaaattaaagcgcaagatcgatcgagctcatctcttcagactagatccacaaattaaaggcgagaaagagggaaaaaaaagattagagattggatcgatggatggagagatggcatctgccagccagaggccatcgttgtcgctcgctttttcacgctgtgatgaggacaatcctgcaatacctccggctttttggcttgcaaacttcgcacaaatcttccatggcctccttccgcggacacggacagcgacctcccatccgctgccctctgcatgtgtacaattcattcgcgttgcgtttcttgccaatctggatctctctctttcacctgtattctctctcgatcttgttcttgttatacatgcgtttgcgtgtggcgaccggcgagtgatgattcgatcgagctgcttgtgagctacattttgttcctatatgctgttgttgttgccatgttactccagtttaattgatttaattaattgtgattctcttttgtgtatggctgccgctaattattctggcccacatctcagggtagctataggccacgtaatgatggaattgaggtgtagcaggattaaggaaaatcttgaaaagcaatattttacataagctgttacatttgtgataggattttttttttggttggtagcatatattgcaaatttatttatttatttgtagcaaggtgatcatcttagatagatgcagggcactggattaattgaatgtagccgtgtagattgtctttctttgagatatggttcgctatcagctgttcacacatagctcatgcgtcagtgtcaaattaagagtaatcactgtactagcataaatgaaaagaaagagcaacattttctgttacaatatagtcaattaattcgtcctacatgtactcttcccgccaattgcgagcagcggagtaaaatgttctgttggcaccatattcccctctcatcctcatttccttcaaattaagtcgctctcgcgaagtcattttacgtcaaaattttatatgaattttcaaataattaaattaattcatgtaaaaattcttcaaaactcttttagttcaaaggagaccccaattggtgtggattaactctaaagttagctgagttgaagagtccagcagtttagctttttgggtttttctttggttccgtcaatattctacctgaaagtattcgctcaaaaaaaatattctgccagaaattgtttacacacatatggtgcacattcatgatttttttcatcctagatttactgttaaaccctgataagactctgaaatgttcatatagttaatatgaagatgaagagatcaacctagctagtacatacacatctttcttttgactgtaaagattacaagcatcgtcatatattctctcgggaagttattccactattgaatatattgatctgttctaaaataaaaagattattccaccattgttctattagctggatacttctcggtacaaagactggatgattgatttctattatcgaaaaaattattatcctagcccacacaagggcttccaaatcgtaggaaaactggccctgaatccatgatgagatattcggacacgcaactaaaccaaatcctatatacttatctagttcatccccactaagtgtagttatcgctatttctctcttctctcaataagccacatcacctcaattatttttaaccattggatgatagatccatagttcaaattgtctcttctttcttctctaataacaccatgcaatctcaattatttataggctcaaaattcatatgtatatcaatttgttttaattttaataatcatatttcatcatatttgtacatattatgtaatttaatttcccgcagcaacgtggcggggtattcatctagttaaaaagaagaatcatgagtgagtaggtgcaaaatgtgcagcgaagaaaatagtcgcaaagctttaattagggtaaggttgctaaataatatttcagtgataaagacatggttggggaaatatcctctagaggatatcagtactaataaaggggcctaaaagagttccaacctaattaactaaaatgaagcacaataacgaacgaaataaattaattgctttcagaaacataattggatgaggtgtaccatctcgtctctatagaaggttcaaagtgtaccatcatcagggccatactttggattttggatgagatagagagaaagataatggacaaggaaaaaccacctgcaggctgcagttgccatggaaagttgtaaaccatagttattagttaaataaaaagaatcataatcacaaccagttcgcatgtaaaccatagtaaagaggaaaataataataggcatgtagttgcagtgaaaataatagcaaaatgttccatgttactgtcatactacctaggattttcgatgagttggagagagatgataaacaagaaaccatgacctgcagttgccatgtaataacctttataaaccatagtcaaataaattaaagaataacaagcccaaccagtgcatgtaaaccatagttaaagaaaagaacaatgagagagcgtgtaggtgcaaaaagtgcggtgaaaatagtagcaaaatgttcagggtcacaggtgacagagacagaggaccgaagagctgatacaacaaatgagagggataaaagacatctaatccaattagttgaggaagggaacgtatcgaaggaaacaaatcgctctggcagagacagcagtaccaatgcaaatagatggacgcgtgaaactgaacaaaaataataagaagaactcaacagctgctgggctggggcgtgcgtaatacatacgtcatgcatttcgtcacggcagttaaattttaactggcgtaaaacatatcagcttcataattttggaccacatatggatatggaagtgtctaaacgagttagctactcaagtgccggttaatttgtttgtgataaaactgtattcattgagacggatgaattggaatgtaacagtttcaaaacgatcattgaagatatgaagtgagcgtagttcctcatcacggaagaatctaaattttacactttacacggatattcacatttacggccacattcttttagtgataaaccatcatcaacaatacacttgtagtgattttttttaatcttaagatatgattgtctagttttttagaaatgctcgcaaagatggggtatatacatttataagtgagcactctattagataaaaaagggaccctagatgatgctcaatttgctcactaatactaggaaagaaagtactggtcaattggactgctccagagaaagtcctgtacgatttggtcacgcaaaggcttcgttcgacaatgctgattgtccgggccttttcaaattcagcctaactaggactgtttttggagcaatccaaatgatcagtgactttctttcctgttaaacaaaaaatgggtacggtttcgaaaagatctgaagttatgaaccgccctacgggaaacaacacactctaggatttcaagttttcaacccataattctagaattcgaatagggaatttcagttcataaggctcaggcagataggaagcaacgacattccgcactctgcaagtccgaaacataggaatacagctacaactttgcaacgttacggtaggtaatggcacggttgacgataagacaagaacaatttaaagttggcattcttcaaaccagaacatgccatgacaagtggatgcgatagttagcacctagagtactttttagcgaggatttaactcatgtcaacaatgtatcaaaaaaggatggcacaaaaatttatcattactatccatcaccaacagcgcgtcccactgtaactcaaaggagagcttcagccctgatgatagcaggttcagtcaaattgtactttatccagctgcgtaatcatctcctcaaactgcaaagtatgacaaagaaatgatacattatatagggtataaatgagaaaactacaagtgcatccaacgaaatgatgtcgcatgtgtgaccaagtaaacatggtaagctgtaaaaagatctacaggtaccttcaaaatctgtctcaaaaagtaatcaccatggttcttggttaacttggattcaacaacatgaataatgtcctgtgtggatacaaaaagatttggtgagtcaaatagaatagtcatttgtaataagtcacatcactccatttgtaaggtaacacgtctaaagttccatactaggaagtgtgggaaaaaaaaacacggacttcatgtcattcatgcagtatttcagccactgataatcattacactagtcaaattcataaccccaggtacagaaagttttgagttcaaaagcatacacaaggaatttatattttcactaaaagcacaaatcatggagataatatttcatgaacatgtaaaacaaaaattatattctccaagcatttaatcgccatcaggaaatctaaacaataatagcgcttgaagcgcagaaggtttcaaattaaaaagcacacacaaaaaagttatcataaaaacacaaagcaaggagataatgtttcaagaatacgttaaaatgaacactattttctccaagcatttagtcatcaacaggagatctaaacagtatgggtgagtctggttccctgtatgctggatgacctgtctggacacaccaagcctgcctcagatggactggtttccaacatagattttgatttgtttggtcagctgagtttatttggccagtctaccacagaaattgtttggtttcatgcatatgtcacttctctcatggaacatcttgagaggacactgcatataggcagctctttcttgactcaagcaaccaggccaataagaaatgattctggaacttgtttcctcatggccagtgctcccactactttttgcgcacagagg

SEQ ID NO: 67771 - DNA, 18181 bp, Oryza sativa
  unsure (1)..(18181): unsure at all n locations
tagaactgaacaaaaagaatatcactgatactgcattattggattatcagaatttagtagtaatgtctgagcaagtagatacccaaagcataggcgggatctaggggggtggcccnggaccacccaaaaaaaccctancccaatgcatattacatatgtgaaaagaaacttgtggaaaaagaaaaaaaaataactccattattaatatattgtgatgtacatttaatccatttatacttctaaccttgtcatatatatatatatatatatatatatatatatatatatatatatatatatatatatatatatatatatatatatatataacttggaccacccatataaaaatactagatacgccatggacccaaagatgtgcatttcaggtgtcacataagatgctaagtaaagatactcaaagtaactgacatgcaacttccgcaaattgtaatgttaatgcataacaagggaaatagtaaaatgaacctcaacgttcagctgctcaattgtcatttcaacaatataaggcagtaaggcacaaacaaacaataattcaaaaaaataaaactcctacatcacttgagatattacagacaatttgatacacctagaatgctttggtcctagcccaattaagggtgtagtatagtttcaaaaaaagcataaaaaagaccaccccaatctttactttaagtaatacctggttgtagtttgtgtatggctctcgtagaactggaggcgacgcagtaatgaacttggggcaggcataggaaaagagttcatcataaatagcatatgcctcatcatcatacctatgcatctttgtcattttgtccccatacttttccttcagctgagtgccaacgttttcatctatgagcttgtcctgtggacacaatgagaggcagatcgccaatagtgcatacatctgctcattcttcttaagtagctggtcatactggggggaattctggtggtattgcttacacttcaggatatacaacagaattttgttgaattcacgtataccatcaatatacctgaaatccatccagaaatatggtttatcagataaaagaagtcagacaggacaattcatgatggtgaactaactagtaacatgactccattcatccattaagcattaggttctcatatgggacagaatagcatgcttcacagtaaagtttttttttttttttgggttcacagtcaacaggactacctaaatgttggaaaatccaaatttttggtaaggttgcaataagcaataacaaattttggtaacaatccaaatgaacgaatactccgttagcattatcaatattaagtaggcaattttggcatcaaagagaaatgatcctaagtacttcatcagaggtaagtaggggaagtgtcgggctaagctcaaccttggattcttggaccattattaagtagagaacagcataagcactattgactacaaaaggactgcccagaaagcttttgccatattccataagatgaaatgatgttaaacggcaatgttacatttagttcacatacgcagagcttaaaagtaggagtaatatactatataataggaccacctgcaattatggtaaacataagcaatttatatatatatatatatatatatatataggacactcatatgggggcaccatggtttcaaatgcacaaaatcactcaaatttttcaaaattttcaaattgtgagtatatacctagttataagaattcgattcatacctatacctatcaacaaaacaactcaaatttaactttattcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatatatatatatatatatatatatatatatatatatatattaaaagaagagttgaaagagtcattctgaagtgattgaagaggtaccaaaaaaagttcaattatatggcacagaaagtggaccatcactggttacccaaaggggtgagggtacgcattttatatcccatcagcagaaaacaagtatagcatgatgctagacaagtacacatacaagtatcaaaagaaggataatcattcatactgtaccatactgggtaggaaagtaaaagataacccagaatttatatagctgaaatatcactagatactccatcaaatccaaaatataggtcatacttgccttctcaactcttctctctaaatgagtcatgtgaacaagtctcaattgacttatttggttagagaaagcatatgatttttttcaacaacaaaactctagatgtagaacaataaacgatagataaagaaaatagaaataaagatgggaaacagagatgctcaggcaagttagcttaacgcatacctgcgcatcatgaggctggcaaacccatagtgataaatagtggaaatgtggcttccaatcacagtggtgtagacaccctgctggcttatatctattggagccaagcacttgagcccagtatggtaatccccaagaaggcaatgcaccctgagcagcccaatcatgctgtagtaccccagcatcttcaacacattgctcccgccctcatagtcatacccatcagttgccgtgaactgttcaagccctaccttctccctctccaggatctctccaatcattgacttctccaccagtgctttcaagtaattaagaaccccataaacactccatgcctgtaaaattataaacagattaattatgacagagctatcaacagaaaactcatacataaaacaaagctaagccatccagatccaggattcatcataccgagcacccaacctgaatctaactctgataaacgacctccacagcacatgtcattgaacaaacagtgaaataaatgaggctactgctaaataaactcgtaatggaaatttaatgtcaatgcaaatctcatagcacaagcaagagcaacctcttccgccttaattacaaatcacaaagaaaattgagactatcactaacatgtgcaatcaagaaccagctctattatattacttcataataaataccatagtccaaataaataacagaattaacaagcctacccttcattaggcaacaccagcataccaatggaaactcgtcgaatcgcaacacgattcctgatttactctgaacgatggactaataaaaactaagggagattcagattatagaggacctatgccactataccagtggaaactcatactgatttactctgaatgaacgatggatataataatagtaaaaacaaaagggagattgagatggtagatgagaggacctggtcgtactgcttgaggagggcgatctcctcgtgggtcttgttcttgagcttggcgcggtactggcagaagctctggaactggtagacgaactcgtcgaccatgtcccagagccactggttggggagctgcatgttgacgacgccctggaggacgacgctgaagagggagcagtagttgtcccacgactcggcgcgctgcgccggggtgaggccctggacgcgggcgtgggcgtggcggaaccagagctcccggtagaggaggaggaaaacgtggtcgccgtcgcagtgcgccgccacggcctccgccggcggccacggcgtgtcgcggaagtggcggtcggagaggcgggtgaacccgccctcgtacatctggtgcgtctcgtacacgttgcggtcgcggatgtggcggtagaggtgcgacacgaacgtcttcaccgagtccggcacgtagctcgggtcgtacgccgccatggcgccgcctcccccggggccggacgacggcggcgccgcgtcctccctgtcgcggtagaaggcggcggcggcggaggaggccatatggcgatctagggtttcgaggtttcggggggtttttgcgtgagctggtcgaggaatggtgatgaccaagcctatctcactatctggtcggcctgaaagtgggcccatccacctaatgggccggcccaatttcgaacgggccggtccaagcccaactcgagctggctaaatttagagatttagggttaaaacgataaggctccatcctcgctagttgtggcgagccccaaaaccaactcccaatccgcatctccctccgctgcgccggcgccgccgcccgccgccgccgtggcccggccgtcggctcgcctccgcctccatcctcgggcaccggacgtcgtccccgccgcccggaggccgacccctttgcctccttaggccttctgccctagttccggcggcctggctctaaattcggccgcagccggcgcaggtcgatcaccgcccgcgcgccattggaagcggaggtaatcccccgcccagctgccaagatgaattggctctttatttattgatatgtgctcccggctgccaagatgaaatgtttatttattgataaatttgatatgctgagttgggaatttttgtatgtgcttgtgcactggatcagttgatctgattgaaactaatgctgattttaggtggagaaaggaagctggcattggtgcgtgattgaaatgctgacctgattttttttagtacattgaggatgtgcgttctctgaactttttactgaaatgactgttgcatgaaaaatatgtgctacattctatttttgtacaacactctatagactgaacatatgccattttttgttataaattcaacagtagcgatggatggagacagttgttatgttaactcactggttgttaaaatcaactcgccagagtgggatgatggcaccatgatgggggctagtccacccgaggagcaacattcaacggtcgaagaagttgttgtcgtgagacgaaaccagaaaagaacaaagaatttcagcgggaaggaagacgaagggttggtttcggcatggttgaatgttagtaaggatgtagtccaaggcatcgaacaatctcgttgtgcatactggaagagaatttacgattacttccacgcaaacaaggacttcacctcagaccgttctcaaaattccctcatgcaccgctggtctactattcaagagaatgtgaccaagttcgagggttgtctaagccggattggggatagaaagcaaagctgggtttcaagtcaagataaggtttgctcatatgtccttaaaactagttcctcatttttcatatagtgactagacatttaatatgacattttgatatgtgcagattatgcatgcatgtgctctgtacaaggccgaagatgagaaccataggccatttcacatgatgcactgttggaatctcttgagaaaccagcaaaaatggattgataggtcgtctcagctgccatctcacaaaaaacagaagataaccaacaattcaagtctaggtatgtctactactactactgatgatactgcggctgctcctcctcctcctccaggatttgagttatcgaagactccagaaagtattaatgctcctccaagatgtgagttatctgagagaccagaaagtaggaatgctcctccaagatgtgagttatctgagagaccagaaaataggaagggggagaaagaaaaactacgacgaggtggagatgtggtctttgtggaggatttagatgatttgttggcaaagaagaaagaggcagatgtggagaaagagctcaagaaagatgagagatatatacaatcacatgccctagagcaagagaaggttgcactagaacaagcgaaggttgcaaacgagacaaaaaatcttgagatgaggagcaaagaattagaattgaagaccaaggagatagatttgaaaagaatgttagaagaagagaggattatgactatggatattagtgccatgtctgggctacaacaacaatattacaagagcttgcaggaggagatcgtcactcgacgatttaatagctcgggttgacctcgtatgtctattattgttgttacggactattatgttttgcgaaccatgttgaagtcgtatagagaattatggtaaacagcaaaccttgttaaattgttcggactgttatggaatgcataccttataggcttataccttatcaagttgtatggactgtcttggtgtgtgaagctttaggccctctttgtttaggcttagtcttattggcttagatttttaagtcagcttattggcttatatgatttataagccagtgaatttaatgtcctaagtttagtggtggagtcatacatctatctcagataagccaaaaaagcttctccaacctagcttttggcttaatagtgtaagagtggcttatagcttcaaaaaagccaaacgaaaaggctgcttgtaggggtggacaggaagctcgtggctcgttaactcgctcggctcgtgacaggctcggctcggctcggctcagctcgtttgaatttcctaacaagccgatctggcatttcagctcgttagagataacgagccagctcgagctggctcgcgagccttaacgagccagagcagatgaggcccaggcgcctagcccagcccaacagcccatcacccagcccatcaccttgtgaaaaccctagagtcaatccccttctggcttgtccccatcctcaatccccacccaagccaccgccggcctcatggctgccgctcgcccgcgcctatcctccccggcgccgacgccgccgtccccgcctctcctccccggcgccgacgccggcggccgtggacgccgccgcccgcgccgctccttcccgccgccgccgccggcgccgcccgcgcctctcctccccggcgccgacgcggacggccgtggacaccggcgcacgcgccgttcctccccggcaccgacactgccgtggacgccgacgctcgcgccgctccttcccggcgctgacgcatccagtcgtggacgccggcgaccgcgccggtcctccccggcgccgacaccgtcgtggacgccgctggcgcgccgctcctccccgggcccctcgtaggctcctacacttgttcgctttctctcttgtccccaaagctcacgagcctaacgagctggctcgagctttcaaacgagccgagctgagctgggtttctagagctagctcgttatcctaacgagccagaccgagccgagccgagccgagccagctcgacatccacccctagctgcttgtttgtttaggcttagactttttggcttataaattggcttataagcctaaacaaagaggaccttattatgtttgagcttaagttattttggtataaattaggacagttcaaatatgctactccccccgtcccacaatataagggattttgcccccatctagttgtcccacgatataagggattttagtgtactacttatcacatccatcaactccaatttaaatttttacctattttaaccctcatctacccactcacctataagcaaatactccctccgtcccacaatatatgggattttaaaaaagtttttgtttgcactgtttgattactcgtcttattcaaaaaattttggaattatttttttttgacttactttattatccaaaatactttaaacacaactttttgtcttttatatttgcacaaattttttaaataagatgactggtcaaacaatacaaacaaaaactcaaaatttcttatattatgggacggatggagtatcatttaataagggcattctagtattttcttgctatccttaaacttacataaaagggaataatactttatattatgggatggagggagtaacatggtactgaccacataaatatattattccaacaatatggactacattcctaatgcatttctccatgacattcacttcaagaaaattgaagtgttcccccccaaagttttcaacattgtggcaataatttatactgttgccaaagttttagttttttggagtaattagtacaatttgttgaacaatatagtgttgtattagtacaattttttggagtaattagtcttttttttttttggaaaaaagtactttatagttttgttccaacataaatgagttatggcaacaaaaagaaaaatggctaacctttgcaacattaaaaactctaattctacaattctgattttgtgccaaatagtttaacgtattggcgtattgccatgttatacaattattgtatttcacaaaaagaaaaaagaaaaatacaaggacatagtattattcaagtagtactgctatgatttcgtatcgatgtaatcaatttctttagcttttttatatccttttagccatgaatatcaatttattcttaatagggaaatcagttgcaggaacacacgggcagttggactcttgtagccaccagccaaaccaaccaacatcgccaccaaagcaagcgttgattccgcccttggtctctcgaccatcggctacagcggtagtggccccctgctgctaccattgtgacgtagtggacttgatatagcatcttatcttacaacttagtggtcactattttggatttggcgggtcactatagaatgatcttattttatataaccactaacccatatataacaaatgacaaatttcttagttgtttttgtgtcccaaaacattgtattattatgagttgtaacgtctaatgagtagaatagcatgtttggttcttaatttaattttagttagaacaacatcttcgaatgctactaaatatttacttatgctcataggttatatgtgtattgatctatcactaatttgtttctcagttgatttcttaatgtttttgaagttattattcaagatatgtacactcaaatatgtgtgataattaaatgcggctattggaatttagcatttgctatagcaccggttatccgcgatccgctacataggcaaccttacttctcttctccattcgaagtgagatctgtctcttctcgtcttcttgagttggatacttggatttgctttaccttaatactaaatcaatttcttttgtctcttttgtgtttgtgtgcgaacatggaggtacgatggcttcacactatatccttccttgttagttgggagtatagtcaactctaatgacccaaaggtaggcaactgcattcgctgtgttgcacttggagagccactagaggagagagtagaggatagtgtcatacccatacattgggttgttttttctagccattcttgaccaaggctgagtttagttccaaaatttttcttcaaacttctaactttttcatcacattaaaactttcgtacacacacaaacttccaacttttccatcacattgttccaatttcaaaccaaacttccaattttagcgtgaactaaacacaccccaaatactagataccagccattgagttcaattctagtggagacagaatgtgtcagggcccacatgtcagataaattatgtctttggtctacatattgaagagagctgatgagtttttttaatataggtgaggcttatgataatacctatggctaattcatacactgtagcaattccagcgattcttgtacacgataggccaatgttaatgttgggttctctcacgaattcactttgattaactagaaaaggaataagtttacttgaggttcctcacaattcgtcaagtctgaaattcatccctaaaccgaaaaacatgacagaatgcgtctctcaactcccaaaaccactgcaaataagctcccaggatggtttggactgcggtttcagctgacttgacacctacgttgatggtttgacttgatccttgtcccacgtgacattaaaaaaataaaaaattaaaatgaaatatatgggcctatttgtcaataaaataaaaacataaaaaatatagttggacccatacttcctcgacctcactgcttctctcctctctatctccttcccatccatggagctgcatctcgccgccctctgcttcccccgcctccacttcccctgcctactttcctaaggccacctccaccaccaccgcctctgctgcctcctcctcctcgttgtcgtcggcggcagaagccctcaagccttacatgcatctctcgcggctgatggaggagcagcccgttgtaaaccaccataggctgcgaaaggagctgggtcccgccgcgctctcctccctctgcacgggcatcgagacactagtcaccgaggggcggcaccacaaggcgcgtgatgtgtttcgcggggcctaggctagggtgccgttcatgtcgctttcgagttcaccggatagaaatggagcaaaattcacgagatttaattcgagatttctagggctttttttggggaaagaaggggagatcgagggaattccatattcaatcaattttgagggagagaaaacgcgtggctggatcgagcgaagcaggcggcgtcggtctcaggtgtgcacaggacttccattcggaggagcaagacaatgactagcagtggggctgaagctgtcagcgagatgggaaggatgagatagagaggagagagaatgggtgaggtggaggaagtggacacactatttttgtatgtttttatttgactaacatatgggcccatatatttatttaaatttttaaattttgattctaataccacattaacgctacatgggatgaggatcaagtcaaaccattcacatagacgctatgttagctaaaactgccgtttaaaccatcttgagaccttatttgtaatggttttccgagttgagagacagaccttatttcagttaagggatgaactgcaaactcggcgacaaattgagggacttgttccactagaaaatccagttcgagttcatcctttccccaggtttccagcctgttgcagctcagctatttggcccactccggcccatggacacgagggtttggaaacctgggtcgcaggccgcagctgtcttctggtagattggcctggtcactgcttgtgtattgtccggagcctgtcttgcttggtcaacaggacatgtcaggcaccgtggtctatgcaacgaaaatacattcaaaaatttcactgtaaactttgcataaggcagggcaaatacattttgatttaactgtttcttttttaaaaaatgtgtcaataatataaagtttaatcagaacaataacgtctatcgtgaacaacacacgaggtaacacttctaattaattaccattatagggttatcattctcaaccttcatcgacgatggttaagacagcttcttagcttaagagcgatatgaacttgacggcgacggccaccgcgttctgcgccgccagcgccgcgaacacgccggcctcgttggactccgcggagccgccgccggcgaggtcggagagcgaccgtatggcgatgaacggcgccccctgctgcgccgccaccagcgcgacggcggccgactccatgtcgatcggcgtcacgcccagcctggaccgcaggaactgcctgtacgccgcgttgtccacgaacacgctggcgctgcacccgcgctccacgcgcgccaccgccggcgcccgcgccaggcacgtcgccggcgacgtcgccgtcccggtgcggttgacgcagcgctccagcggcatcgcctccagcttctgggcgagctggtagtaccggccgtcgacggggacccagaactcgtggcggcgagactccggcgtgccgtccgccgggaacacctcctccggctggtaccacacgccgttcagcaggttgccgccgccgccgccggcgacgccgtagtcggagaagttgagcgccccgtacttcctcgtgtagtcgccattggactccagcgcgagctccttctccggcccatcgccgtaccgctgtgtccgaattaattaatgaacaccgatcaaatcaccaaaaccaatttgttcttgatttggatgaaatttgatgaaattaattaatcaatcattcacctgccagttccagagtccggtgtgcgcccagtagcgggggacggtgacgtcgccgatgtggaggtcggggtcggcgttgccggcgatgccgaagtggacgatgccctcgacgtcgaagagggtgaggaggagctgggtggtcacgccggagttgagctgcgttcgtatgaagccgcggcagttgatcaggttggcacaatggaattaataattaaggtaattgacacaatctactctatgatagttatgacgccgttaaattctatcatgtcttattaaaagttttatgtaaatatataagatataattcgtacttaaagtactttaagagataaaataatttacaataaaatacattataattacgtgaatttttttaataaaacaaatgataaaaattgataaaaaattagcagtgtcatctattaaaagacagaggtagtataagtatacggcttaattaggtaatgaaattaatgaaggtgtacaagtatttaccatgccgaggcctgtcatgacgatgatcaccttcttctctcctatcgatccgaagcgaaatctccttcctacatggaaagacatgtggttttggtgagaaaaatatttaaccgaacttgattgatgtcgttttttttttttctactacagaaagaacaacttgatgggtattggtttgggggtgctaatgggcctgagtttgaggcagcccagctggcagtcttggtttgggctataaattaagctcaagcctggtgcataattcaaaatcttggcaaaaaaaaggagagaaaatctgtaatgtggaaatttatgatccacttgaaattcttcaattcaaattgggattttgatgaaaatttaaaaataaaatttaattttcgtggattttgatgcaaatttgttcaaagtttaaataaaagtttaatttcgctggtctgtgtaatcttttgagtttaggttgaaggggcatttgcagctctgtgcgtgttagcatatatacagccatgctgcaggtgcgtcgactcatgtactactcgtagaaaaagatcgatactactactactaattgatggtgatgaaccactaattttattttgtaaatctggcgatcaatttattcatcaagattgtgagagagtcgcaaacaagcagttgtgactacttgcatttatatacgtacgtacacagcttatcataatctgtttgatcttcaagctggtcaatggtatgcgttcgtacacgccatgcatggcctaaacgagttgaaattaaacccgacgattagtagaggaaacgaagtagaagagtagtactgtagtagtaaaagcttagcaacttggccacatggctagctaggtaggtacacgtcgtcaacttctcatcttttgacatataaaagtctatacaaatactcctccgtctaaaaaaaagtcaaaccatgtatttccgtgtacaactttaactgtccgtcttaataaaatttttttataattcgtattttcattagtgttagatgataaaacatgattaatattttatgtgtggcttgtctttttaatttttttcatatttttttcaaataagacggacagtcaaacgttgggcacggaaattagggtttgtctttttttttttttggttgtagagagtaatctagatactgttgtaacgtgtttctttagttctaagttaacatatattttgaagtggatatactaattaacacatacttccttcgtctaaaaaataatttaaaactggatgtgacatcttagtataacgaatctaaacacatgtatgtttaaatttattgcattagaatatgtcatatccagtattatgctggtttttttttatgctacaagtattaatgattgagctgatcctgacgacgtcgcccacagtaatcaatcatttaaataatcctaccgtacgttacatgcatgtgtagcaagttgaatatggtagagaataaatcacaactgaccgatcgaatgaggggtgtttttttttccttaatgtatgtgttaattgtgcatgcgcaagtatgggatgactaatatacatgcacatccctatatgcatccattggtttggattaaataaacatacgtattcaacccatttttaacaatagtataatttttatttgccttgtaacttgcgtgttagatatatcttctcaaaaaattgaattgaaatattcaaagagaaattaatggtaaaatttttaaatatgttgactacacgtattattataaaacatcgttacttatttgtggagtattatcttcttgaaaattaaatatagtacgatctcaaatcccactggttctgactcatattgtataagcatatatatgcagcagtgatatcacgtgcaattcttttagtagtagttcatttgcagaagatttgtttgaacaacatggaattaattcgtaaagcgattgtttggaaaaggaaatgcgtgaagaaatctacaacacgtatgtccgcagaccgcagttttaatccaacataaaaaatcgtacatgctacgtgtttgttcgatatagagtacagaagagtcgttccctacacgattatccaatcaagaacaatacgacatacttttccgatgtgtttgttgtataattaggttgctctcgagagaactattgaaaagtctatgttttttcgcacaaccttcccaaaaccgtgaaatggtacgttatacgaaagttatttttttaaaaaatattaatctatatttttaagtttaaaataattaatactcaatttgtcatgtgttagctaatgactcatctcgttttacgtatgttctcaatattccactttcctctctcaaacacgacgttaattaaggtttatttatcagacattcgcatttggcaacctgttaattcttgcataaatatatggttctatctctcactttttaaacgaaatctgatcgggtgaaaaaatttacaggattatatatgagatattccgggacctataatatcgacatgtatatccgttttttatagtgaatgtttcagtctacctatgttttccattcctccaaacatcaagcggctaactgtggttctcaaaaaaaaaaaagaagcggctaactgtctaggtacaaacattcaggctcctgtgccagaatgatggtggtcatgcaagttttcaccaattttaagatggagatatatagtaataggattaagtgttgaataataatgtcttttcaccatatatatagtaatagggttaagtgttgatgcaactcaaacatctacaggtttcattcacgcaaatatttgagttgcaaactttttaattggttatagcttctaccaaaacaaacgctgagtttttgggggagtactcccaaaaaagcaagcatctacactaaaggaattacataatcaaacaagggtatggtaataccttcgtcccgataggtatgtctagattcctcaataggtatgttcagatttgtagtttacaatgtgtctaattttattttagttactatacattttgcgtaattccaagaaacagagtacaaattaattagtttatgcgtgtatgcgtacacgagtgtgtgcctataggcatgcatgcaagtgggtagtcccactatcaaaaaaaaaacccgcttgcatgctagtctatttttttttgcatgatatatagtacgaagaaaaaataaactagaagtgggataagcggggaaaaagcgcgcttgtccgcccctcttgtatccctatgtgcctactcatcgtttactaactaatgtaggcgtgatgtatatagttcgtatgtatacctgcgacgtcgaggtatggcagcttcttggccggcgagaaggccggcgagcggaggagcggctccatctcgaacccgttgggcaccaccacgcccaggtacgggccccgccggttcacttgccggacgccccgcgccgcgtccgccgccacggccgccgcctccgccgccacagcagcggccgccgccgcgaccaccaacagcaaagccagcgtcgtcgtcgtcttcgccggcgacgacgacgaccgagcagccatgtcgttaattaattaaccttgagctaatgaactaagctaataacgcgtatgcgtataacgtgacgaatcgaaatagctctagcaatcgatcatacaagtctcacacaagatgtgtgtgtgcgcgcgtgtgtgggaagaacgagatgaagagagacaggagaatggtagggtttatatatagagctaggaaacaggaagaggatttgatttgagtcagagctcaaaaagaacaatcgtgctggccatctccaattaaatactcctatttagcttccaggacaagattacatgaatggaatcaatgcaattacactaaaagaaataacagaggggtttctatagatatatatatccggtagcgtatcctgtgcacatgctcaccttggtgcactcatgcactcacgcgacatgggaccttcgatctccatcggacggatataagatgagagagtcttctttttacaaaataacccttcgattcatcttcttgtctcccgttcaacccctttccccaaatctatcccctctgtgaggcgtccatggcagctttgaatctctgaaaaataaaacaatgctcgacggagatggccgctagaaattaagattaatcaagattccagcatgcagccgtcaaatccttgctcaacgatatgtatgatctcaacctcaggatcttttgcatgatatatatggcatgccaaaatttcgaatcaaacaagaaattccgatcggatatgccatcgatgcacacatctgcaacccccgggcaaagactcatccattccatcccatgggcaagaactcttctctctacagagtcaggtacactgcgccgcagctgctccatcggccgaacaccatggccgtcgccctggacacgctcgcccgcgcatcgtccctctccaacaagctggacaaccacacgcaccttgaggcgtgacatgccactggccgcgccgccgcgctctggatgtgatatctctgtcgccaaacatggcttaatttgagccgccattgacgtcagatagagattttggggaatacatcttggtaaggacccaacacgggaagacaaaaggaatcaagggtctatttacaaatttacccgtgtatgtgcgggtggttttatgaaaaaacgtccctttgcattacatccgtccgatggagattgaaggtcccatgtcgcgtgagtgcacgaatgcaccaaggtgagtgggtacacaggatacgatgtctatatatccccaatcaacaaatatagaaaatacttcatccgtcctaatatatagtaatatagaacgtgtcattatgaatttaaacatgtatccatgtatctatatgaagatattgctgaaacgaaggtaataggaacgtaggatatatgttatagtatttgacatataggcctgcagcgttgtcaagtggcaatgcaattactatatgattcagcgctgagcaatatgaaccaattaaccagatggcccgtccacgtacgtaagcgtaactacagctaacgtgccagtttgattaacgattatatttgctgaccaatacattgtgcgggagagggcgcacgtttttgtacacacgtcaaaaatgggcgcatggttttagactgacttggaatagtatccatcatatcgcgtgctgcttgccacttgagatgtgtgtggtcatgaacttgactggactttaatttgcatggaccaaattaagctacagtacttgatcgagtacggaaaattaaggaaagcttcttatcttgttcttatttttttttcctttgagacaagagacttgtatccttacttgaacgagagtacaagacgaaatgggcaaggatccaacttgtattatttgattgagagtacacggcgaaatgggccttcaaagtttgcacgtggtgagagccgggtgcacgtggtatgtctgtgtgtgcactagccataggcttaaaacgagagggctgcagtgcgcagtattgt

SEQ ID NO: 67772 - DNA, 4576 bp, Oryza sativa
acacaatactgccgagggcccttatttaaatggttccgtaagttgggggacccgtcgtaccaggttttgcaacgaagggacgaaaattggactggacgacaaataaagggacccaaagtgaacttattcctttttggccatgaggggggaggtctattagctatatgggctggtctcctttcacctgccccaacctggccgattggaataagttcaccgaaggtccctcaacttaacagtgagattttttgtggtcccttaaccacaaaactagaaatgtgtatctcctaaactcacataaactgtgtactcaaggtcctattgcagtattattaacgaccaaatttggtaagatatgaatcaggttcggtattggaatcaaagtggattcggcaaagagttagattcgaagaacagagtatgcatcggctgaaatggaccggacagaggacagccgatacattcgacagccgatacagccgattccgatgaagatagttgtaaaactgcttctagaatcgatcaacgtgcttcacaaggattgccacgatggagaaaagctcttagaaaggcaattgtatcatccattaattaggatattttgaatagtttttttagagatatgtttgggcaaaagtctgccgtaaagacttatgtgtatcttagagtttgttagagataagagtcgtgtccggcaaggatatatcacgtatcttgggtataaatatgacccaaatccatgtaaacagcaacacacagttcaataacactttcggtgcatcgtcacccttttactttcgttctatttcgacgagttcttgctttcgggttgagttgcatcggtttcgatcttcaactagaggtaaacttgtcactatggcttgcattctcgtgattagtgcttccatctttatgacactctaatcttgtttatgttattcgtcgagttatcatatacactttataatctttattagttgtgttatataacttgcaatcgactggttttactgtcagaaagtagccaatagagttagatctcgttattaatctagattatatcgtgtatctaccatctcttaaagattttcattatcttgtttagatcttacagttatctttatgattaatgctacatcggttgagttcgatctattaagttctatctataattgtgatatctagcctgtttcatgatcatcaatagagatagtatcagagtttcagccgatcttacctgatttagctacttttatcttataaacttgactgttatgctagatctgccctttatattaagatcttattgcattaaagtatattaggctttctgtttgatacattttgcttgttttgatatcttaatatagagtggtatcggagtattagccgatacatattatatctatctgatcaggtatgctataaacgttcatatagtcataatcttaatgtacatttagacttaagtgatttatactgtctcgacatggcgtttgatctatcccaatcacttagtttaagtatacatcgagagaaagattatatatcgttaatatctatagccgatcaagtagatttagttttatattgctttgtttctcgttgccgatctaatgccaatatcatcggcttagtgattgatgatatgtcattagctcatagccgatcggctatcgtttatggatttaacctcgttttcttgtcttttattcttgttgattgtaggatcaaatcaattggcacgctcacgaacctaaaaacaagattttggacctacacaggagttaagcagatcttccagaccagcgtgtgtttttcgcatcaacaaatatatatgggtggtttcgctgacgtggaatcctaatcagaaaaaaaattaaaaaaagtacgtggagcccatatgtcagctgcacgttctcttttcttctccttagatctcttctctcttctctcttctcttcttcaacaagaaggtgggcatggaagcatgctcgggtcccgcgaagtgaagaaggccggaccagccgcagcgccggcggcgacttcaccatcgtcgtcgtttggcttgtggagttgctcttcccgctgccgacgctcatgtcctagctccgccgacgacgcgcggctcagctgccgcttgttgctgtcccagcgctggacagcctccgcgttcgcatgcgttggcgtggcaaaaggttcgcgctggtagggcttagacgatgaagccgcctaactgccggctttcttgtgtgcgtcccacctctcaacggcgtcagctcgaccaggcttgggatcagaggccggccacacgcggaaggaggcgtggaggatgatgaggcacggcgtcgggagcaacggcaacatctggctcctcggcggggtcaagagcaatgccggcaacatgcttgtcggtgcgtcaggcgccgcagcgccgggaaaaccgctgtcaccatgaccgccctcgcccatcgccgctccgcccgctgcccgcatccgcgctcgcccatcacggctccgcccgccgccggtctccctcactgaagaagagaagagagaaaagagaagagaaggaagaaaagagaatgtgcagctgacatgtaggccctacgtacttttttttattttttttttctaactaggataccacattagtgaaaccatccatatatactgccataggaccttgagtgcacggtttgtgtgagtttagaggtacacatttctgattttgtggttaagggatcttgaaaaatctcaatgttaagttgagggacctccggtgaacttattcttggccgattagccggaagcccgggacagcccaagccaagcaggccgacctgcaacccagcagtcacatggacatggccgaagccattaacttgaggcccagctaatcggcacaaggtggctaacgttcatactacccagctatctataacgtcctctgcatttttttctctttccaaacaaaatataactcccggcctatgtacatagacatatcctgtgcacataaattttgcatgcacatcaactaacaaatattatcgaaaattgtagaaaaaaaatgtgcatatgcttttaatagtaatacaccgatatgcaaagttttagcatcaaattcattatatattagctgtaaaaatattttctgataattttaaggttataaatttgtcaaaattttatatttttccctacgcatgatgaatttaaagataaggctctcatcttttggcccaatcaacatatgccaatgccaaaatttaaatttttgaactttattttgaagttgtttttttaatcatagtttcttttaaacattgtcatttaagtcgctatgagcataactgtaacagttttaatcacaaattatattttttcactaatacgacaaatggtgtgttttccacatatagccatcaaatgaggccataagattttacgcatagatgtaatactattaataatacatgtaaaataccttctagaaatttctttgatattttgatagttggtgtgcacagtgtgtacacgtgaaaccttatgtgcataggatacgatccatacttatgaacattagtattcaaaacctagtgaatgaagtcatgcactcataagtcataactctactatcatacccaatggtgcttctccagtattcctaaaaaaaatcaagaagacgtttcgtttgatttaaattattagtggattattgccacgaattatctacttgattatagggataaattaaatattttattaaataaatttaataaatagtttatggcaagtgttccaagtaataaatcaagcgaattttttttgcataacatattttttccaaagcgttggacaaataaataattaaaaagaacatcaactaaagtggtacaatcaattgcagaatatttgaaagaattagctagcagtctagcatgtttgctgctaattgagcatcaagtcatcaaccaatagaaattgggctgcacaattatctttggattaatagaatcaacctgctcacaacaaattgcaagctctgaactatcaagagctataggtagcagtaaattgctgaactgagcatcacgactcatggtcatggggagtttcagaatagagcacagaaaatttcttggcaatctagagacagtacaaaaaggtgatcacggcctgttatgttcttccatggattgcagcaacgttatttcaaattttaggcgttcaaaatcaacaattggcacagaatgttcagaactacgttcagagctctgaacattagcacaatattttagtgttttgagcatatacacattgcgctcttacctctgaatatttgcagctattttacccactggtttgcattgacacttcagtgacatgccgttctatttcaagaagcatggctacgtgagtacgtgtgcataggaacaagcaaattgaggatatgtacactggtggagaaaccatctttcgtcggtcggccgatttccacaatagtcccggatgcaataaaaaccggggctaaagatgatctttagtcccggttcaaaaggggggctgcagg

SEQ ID NO: 67773 - DNA, 1078 bp, Oryza sativa
cggttggtgctaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgccgtaaaaggtttgcaacttcatcctccaatgttttttttgtcatactacatttgcacctatgttttgcacacttttttttgtctccaaaatttagttgtaagttgatgagagagaaaatgtgtgtggggaagaaagaatattaaaatttagttcatttgctaaacaaggtttttataaaatagttgaaaaggaaaactctagtgaaagttaatcttaaataatagaaaacaaattaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggttttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatattggatttgaaggaaatcaaacgggcgaggaggaaatagctgctgatggtaacgacgttgcggatgatcttggtcagatgttgcaggacgccagggaggactgcgaaagtgaaaa

SEQ ID NO: 67774 - DNA, 2133 bp, Oryza sativa
  unsure (1)..(2133): unsure at all n locations
agcgaaagtcatactcaaagtcaaaaccagaaccagaatccaagccagaagcaaaagcagaacgacagccagagtctaagcccgagccaaaacccgagtcagccccaaagaaggaaacgccttcgtcggcctacccatgatggagatccatggagatcgagggcatcttgcttgctgcacgatttagctactgatgagattattttgctgaaggtcggagcactaggaaatggccattggccatttctggaataaataagtgacgacctagctttattctttgctttatttccctcattctttcatgtttttttccggatgtgccactgcgccagctggtgtaattcacttatttcttatgtatctatatctatgccattttttttctaataatacatacatatatatatatatatatatatatatatatatatatatatatatatatgtgcatttttttctgcccagtactacctttataattatccctcctgttgtttattctagattatattgtggctgcctaacaaagttccatcaggaaaagggtgtaacactgtaactatctaacactgaactatcaaaattgttcgtagttactattacattttcgattagtctttgtaaatacagtgctaatggcacggcttacttatatatgtaaaacaatcatcaagcgcaatccaatctgtacctggtttgatcgagtctgcaggttcacggttaacaagctcctgacctccattaattntagtaattntactatcttaaggcgacgacgagcggtaccgcaatttcgaatntaattacacttaattattttggtgtcttttaataaccgtaaaatttctccattggtaaacctatcgttggaactgatccgcactatattggttaattaatacaagttcctactcccttcttctgacgccgtagacttgtttaaacttgttacacacattcgtcttattggaaaaattaaaataaatatgaaggctttccatatcattggattcattattaaatatacttttacatatacatatagtttacatattcacaacagtttttcaatgagatgaacagtcaaacatatttaaaaaatcaacggcgtcaaatatttagagacagagggggtacttcctcgaaaaattttatcagctggtgagaacaaatattatttgtcagtattataacaacatttggcttccctgatctaataatagctactacctttcctaaaaatatattaaacgaacctatgtgctatcagatcgtgtccaatatgaatgcaggaaactaaatttctacataaattattttcacaaattccttaaaaaatttccagtctctgattgggttgagctacgacttatttgctgtgaataacgaaaaaaatattatgggtaaacttttatctgtattattcatggttttagaagacaatattaattagaaaatggactacaataaaaaaaacccttaaaagccattgagcaaacaactagaatgcgagttccaaaagaaacctgtaggcctagagccttatcgtttttgccatacaacgaaaatgagtcattgctaaaatttaaattttaaaacattattttaaagctaattttagagtatatttaacgtagtgtatgttttacaatgtgttttaagttactaaggataagtataaatgtaaaaatttacatgcaaatcatttttttagttgtttataaactgattgacataagtaaccagctcttggtcaaccaggtgtgcctgctaattactgtagtaactccgtatggacagcattgtcatgagtttaccctctgcacaaacgagaaaatcaatacggtcagaactgtgcattcatgtaactgtgcatccatctttatgagtaatcagctctgttaacatcagtgattagctccaagtcctatcactcacgcgatgtttacctgccattaaccatgttccgtacaatggtaagggcaagtttaattaatactccctccgtcccacaaaggtggtcgctttaccctgttgaaattgtcccaaaaagcttgatgcctaaactgcctcgttagaaaagtactcgtacaaataaaacgcactgaagtgggtccatctaataccatc

SEQ ID NO: 67775 - DNA, 3898 bp, Oryza sativa
  unsure (1)..(3898): unsure at all n locations
ttgttctggatacacaagatgggtacaacgacgaccagttctcctcagaccaggagcttgtgcccgagactgagttccaggattgtggggaagtggaggagaagggtggtaggattcaagactatggcgaagtggaggagaagggtggggtttcaagattgtagggaaacagaggagaatgtcggtgggattcaagattgtagggaagtggagaagggtggtgtgatcagtggcagcagcagcatggtgcactcacatcatggagggatatggcctactgcccggagatgcgggcaacagcttcgagacaagtgatttgatcgtaaatccggccacttattagaagaaggcaagaatataatctatacgcaagatgggtttgatttggatgagtacgagttttggcctgatttggatatgaaggcaacgacttgatagtttattggttcaatgattttgtgcgcaagaaaatggtgcaagttggtgttgcactgcaggggaagggaggcgatgaaattggcgagctgatgagctgcgatgtggctcttggcatgggacgagctaactcctccgttaccacggtgtcctctttgtgcgggttcttgttagtcttgatgtactaataggaatccgcacaaaggagcaaccgtagtggagaaagaggaacactatcaaggttcatagataaactatgagatctttcatgttctttaaagttttcctagctattagagcatgttggcaccaagaagatgcaagaagaacaatatttattcagcaagataatgctagaacgcttgtccgaatcgatgatgaacagtttggtgttgcagtagctcaaatgggtcttgctattcgtctcgtgaatcaacctccaaatttccctgatatgaattggcttctttggctcacttcagtccttaacatctactcgggtctctacaaacatggaggagctagcaaagagagaatgttcataaggaatacaatgactacgatccaaacactcttaatagggtgttcgtgggagtacaaagctgctatatggaggtaatgaaaactagtagagggaataagtacaagatccctcacatgaacaaagagaagctagaggcacttagcattcttcttaaagcgctttgttgtgatcatctgaaagatcaagttctctaattttgtgttaggaggagttttggtgattaataacaatggttgttggaactaacctttgctataagtttgtgatgacagattatgttctggcctcaagcaaaaaaagaaggttgatggctcaaatgtgagaatcaagtgataggattgtggattaatgacaaaaaggatgatacctcacatattgggaatcaacaagagtcaaatgttgatgatgagaatacttgatgacatcccatcatgaggtgatggacatgttgaataatatacaccatggttcaagattgttagaaataaagatggtgtgagaagctagaagatggattttaccgatggatgagaattgaagtcaagaagttgaagatgcgaggtatgaagtgactacctatggcaagacggtgaagcgcaagcgatgctcagctgcgatggaccatgcagtagtgaggacaagcaaggggcttgacgccgacgaaccgaaactggtggtgaagagcgagtgaagactttgtcgtgatggaccatgcgagaccatttgaagccatggattatccgcatcaaccttttgagaaatgaaagatgaaatgtcaaagatcaagaagatgagattttcccaatgatcaaatgaccttgacgttggtaaccctccaagtgaagaaagaaaatggtgtgatggtattcctgctggtataactttcctttttacatttgagtttaggatgtcgtactattaagagggataccacatgcatataataggtcaagtactagtgctcaaaatgtttcatctttgtgtgaattgaaaacgtcaaccaaaattctaactccgggttgtttcacatgtcacaacaattacatcagcttcctttacaatttttttcaacatctcttgaagattttggaccatgttttatgttggggttgatagcccataaaactagctttccataaatattatagaaattatttaaatcacggaagcattcacaatacattacattccagaaacaattttgcatgtacagttctatttaattacccatcaaatcttattcacaatgggcgtagagcctcgcgaaacgtttccaaatgaattatctatcacataatggaaatatactgtagtatacacgcccataaatttaccgtagccttatgtcccataaaatccatttattaataaacattgagaatatataccaatcttacttccttatagataaaattttattttaaaaaaattgacacatagggtgtaatgtagtcattatttatcatatcataaatttgaactaaaaataatatttgtatgaaataaaaaaaagaaaaatgtcaatagagtgtaaacgaacaaattgtagaaaatcttataatttattagaatcactgtggttcttaattttcccttaaattgaggcaaccatacataaccattgcatcatttttaagtgaccacatattaatagacttccctctattctatgccatagcagttgattgatggttttaaatattatattccttactattaaatttgagtttaaaaactcaggtcgactaaatgtatttaaaaaatatatatcacacatattataggaagtgaggtctagaatatatctactctatttttgttgattcatatgtaagtacatacaactaattgtgtcaaatgtgaactantaaaaaaaaggaataaaacacatttattgagcataaccttttgagatttgtaaaataagagcccacacattcaattaaaaagaaaacaacaccttactttgtaatttagactganaagacctatgtcttcttaaatgatgaagaagaaataatgtatagataggtgcttatatagattaattaaatatttcatattataaactaacaaatatcttaaaagaaatatttaagcaatgattcatgaatgcccgcgcgaacgcgtgggctacctcttctagttaaaataacacgtaactaatgaattgattaatgaggagaggtgctgactgattagcagaaagtaattatggttaccagttagtgtaaagacaaattcgagaaaggaagcatgcatgcggaacactcgatgagaggttggcagaggcggcttgctagagaccgaccatatcgattgggtggccgggtgtcatggagtggagccacgtgacaacacctgcttgcctttcgccagcaatgaatcccccagccatccttccatccagttcccaggctataaatcccagccacccttccatccattgccacatcgctcagagaaacacgcacacaagaaacacaggagtgagggagaagaagataagggaagagagagcgagagagagagagagaggggggtagcaaagcaacttagctagctttgctagccatggcgaggagctctccttgcctcgccgtcgctgtgctcctccttggagtggtggtggcggcgattggagcctttgctgatgaagaagcggcgagcggttggggactagggcatggcgcccgtttcctcagcaagcgaggccgtgctgcgtatgagaagtcgtcggaaccagaggcaaaacctgcgtcgcagcaagaaccgaagtcggattcttactcgcaggcaaagcctgggccaaaagatgagcccaagccggaaccagaggcaatgtctgcgtcgcaaccggagtccaagccggcaacttactcggagtctaaacccgaatcaaaggcagagcctgaatca

SEQ ID NO: 67776 - DNA, 2508 bp, Oryza sativa
ggctttctatcaggagctgtagctgcctttgcacctgtagacatgtttgaaaagagcagtaagttacattctctggaattggaaagagtagcacctgtagacatgttctgcgttatcaaatcttgtttggcactatcagtgtaaacacctgatgactgaaataatgcatagatgaaacaaatctagttacattattttgaagcagtacagttgagaagtcaaacataaacagaagatgtcactgtatagaattgtttttagttacaggaaagagcttatataattttttaacaatatccatgtacgaggttagaagcagcgtgtctgtaagcaatttaataaaactagactatccgatccaatagagaaaacaacacaatgttaaaggacacgtgttatttgacagcattagcagaaatgcagaattgagatgaagtacaaacatgaagtcagacataaagaaggtgcccgaaaggcaacttgcctctaattgttcatgtagccgcttttgcacctccatctgcaactttaaagcctcccctatttccattccccttcatatataagtatgctttgttaagaactcaacatcctactttggctactcgatccttaaacaagatttctgggagtaaagaattgctaagtagtatctgatggatgcatttaaactagacaatgcaaaattgaactttctacttcgaatactacatcaataagtacagatttgttgaacaatattgaatggatgcctggaaacaagataacgaaaaacagaaaaagtgcatattgtatttatgtttctttaatgcagcagcatatcatttcagctgttcaatttatttgtgatatgcatgtaaacaagcaacgtgatgcagttagtttcaactttagaagttctcatgcacatagtgtgcattgctatctgaaaattctgcacaacagaaatattttcaatgctctatgccctaaatggataacctatattgctacagacctatggagctagacgctttccatttgtattgcttaaccacaatgatcagaagaaggaaaattcagaacagtttatcagcataaacaacaggtttatcattagaaaaaagaaaataataattggttggcatgtacatgcaatgctatgaagtacaaaatgaggcaaccttagaatttatttagggtgatgaatgcgaacggaagatgaaccaggaagtcctcatggtcacgtgtcatggggctaattcctcatggaggtaatagctatgctttctcaccattactggacatacctatgtggtgctgggagatctaaactcacaattagaataataatagtttgtgaatgaatacttaaattcagtgttggagaagtaaaagtttatgcgacagaggatgaccatataggtatgtgtggagcggctccacgtcaaattgtaccagactgttgtgctagtagaatatggcaatagaattagattttttttatttttcttaagaggaacccatcaaatcccatggacacaaacagctaagtgaatggaaaagatagtggaagttcacaactattagaagagcacataggctccagatacataccaacatgcatttttttttgaaggaaggagaaataacttacgaggagctttcaatgtcagcaagcaaatctccgagatctttcttgtcagacttggcacctacacaaattaaatccttatttcttaacttgaaaattgtaacatctatatcaaactcttatgttccacaacagcaattacgtaccatcagctgtgggatctggaatgtatttagcaagccgatatttctgaagaaacaagcaattcaatcagtaaagtctagaacataagctggagaatagactatatgcaggtattgagaatctcaagctcaattacttgcagatggcttttgacatgatagatggtcaacccttgaacacccattattctaagaattcccttcggagttgcccctgaaataagaattgaaagatagtccgttagcataaatgtatttagcatcacagggtttgtgaacaaaaaacttaatggagagcaagcacaggattttttgtactaggagaaaagtaattaagcaggcatagtaacttactgtcgggtccaccaagctgtgttacagcatccacaaaacgatcatggaggtcatcagtccaccgtaagcgctgtctggcggcaaagttgctgtttgagctgttcccaccactattagatactacattgttgttaatacgttcaatttgttgattgtgggaaactggatcgttgtgagctagtacaatgcttgagaagggctttggttcatacatttggcatcctctgcacaagacatatataaactgaattaccatgctgtgaaataaggtaagaagatcaaatactcatcttcacaaaacattaaaacaatattccaccataacacaaaaaagtggtataaggagccatatgaagtgaaaataggaactaatgtttt

SEQ ID NO: 67777 - DNA, 1774 bp, Oryza sativa
caaaaatcgccgaagtaaacataaatgtaacgagcatttccccaaatggcgctctcttctgcagcaataacaaaggatttcccctacaaaatccagcaagcagtttcacccgaagcaattcgcaagcaaagtctataacccggagaacctaaactgaccccaagaaccaacgaatccccaactaaattcgccaagaacccagcagcaatggacaggaccacgcacccagatcaggagctcccgagattcagagctcgagcggaggccgaatcggggtgaacagcgagtgattcccgcggattgggagatctccaccacctcctctttgctgggaggaggagagatttccgatgggcttaggtttctttccttcctttttcgtgtcttccagctttggattcgtcagttattttgggttcaggacaagtgaagagccaacacccgtgtgagtcagtcagattgggggttggacacgtggcgtcatctgcttggcctggagttactttggacggtgtatgattgcatcagagatgagccaaaggcctttatttggacagagattcccaaaaacagatggtaagcagagtcagtgagaatttgttttttttaacaaaaaaagaaaaaaaaagatgaaagaacctagattgtccgcagagctcgatatttcagagcctcatcagttggcctaataagccaaaatttgaattttttaattcgattttaaatttgattttaagatatttttaacataatccttttagagttggctttcaagtcgctacgaacaaatatataaaagttttacctacaaaataatttttattctctaaaacttttttggcttattagaaaatatgagtaaccgtaaggctctgaaagaagctttactgctaaagcttctccaaacacggccatgtttgcggacctgattcatgtagaaaattggctcaagcctgactttgccacccacgtttgttatgaaaatagatgcacaacggagacacgaatttaacgtgaaaaacccttgcggaaaaaaaccacaggcgccgaccggcaatgatcactatagagaaatgggatacaaacgcaagggatatattgggctgtcgcaccctccccgtgcggcttacaagggatatactaataggaaactaatcctataaagtagagtcttattagataactaatccgaatatactgtaggcccaaaattcggatcacatatttaacaacgtttttgccgtaaactcgtgccaaaaccacgacataaaactgaatatcacacttgtgatcttgtactatttaaagctatgattgtgccgttaaaccaaacaactgtagttacaataagcaaaatcacgtacaattcaaccaagttgagaaagttcagcatggattttgccattttggacaccacagtccaggaagaccatcacccaggctacaacaatttcagtaacacaaaggctacaccaaaatccagtaacatacatcgggataaaagccaacattttagttgcgcattcatagttggtgcagacgctaagagtgttaatttttgttacgaaaaataattttaaaaaaaggaggaagatcacactgatgtagccagaagtctctactggttgagagcaatccactccagctccaggtccacctatccgcactccacattctgcagcctcagggagacctcctgcttcaccctgccgtcgacgacgctcaccgggctgtccctggcgagcgcattgtcgcgcgacatgagccaccggcc

SEQ ID NO: 67778 - DNA, 5989 bp, Oryza sativa
cattagctattttgtgtcaagtctcctgaatgtgtaacacatctgatcaccgccatcgagtggtttgacaggcacatctcgggctgaagttaactggcaggctaaaggcccagcaattaccaaatttggttgttaacaggtctcatatatctttctctcgcagcgtcgaatgccttattatgtttgatggaagaattgatttattctattcatccttcaaatataataaggggttcggagtacttccgacacgaaccaattgtagaaaatcttataatttattagaatcattgtggttcttaattttccctcaaattgacacaaccatacataaccattgcatcatttttaagtgaccacatatcaatagacttccctctattctatgccatagcagtacatagatggttttaaatattatattccttactattaaatttgagttttaacactcgggtcgacaaaatgtatttaaaaaatatatatcacacatattataggatgcgaggtctagaatatatctactctatttttattgattgatatgtaagtacatacaacaaattgtgtcaaatgtgaactaattaaaaaaaggaataaaacacatttattagcaataacctttttgagatttgttaaaataagagcccaacacattcaattaaaaagaaaaacaacaccttactttttaatttagacttaaaagacctatgtcttcttaaatgatgaagaagattaactttatagataggtgcttatatagattaattaaatatttcatattataaactaacaaaatatcttaaaagaaatatttaagcaatgattcatgaatgcccgcgcgaatgtgcgggctaccttcctagttaaaataacatgtaactaatgaattgattaatgaggagaggtgctgattgattagcggaaagtaattacggttaccagttagtgtaaaggcagatttgagaaaggaagcatgcatgcaggatactcgatgagaggttggcagaggcggcttgctagagaccgaccatatcgattggctggcccggtgtcatggagtggagccacgtgacaacacctgcttgcatttcgccagcaatgaatcccccagccatccttcgctccagttcctaggctataaatcccagccacccttccatccattggcacatcgctcagagaaacacacacacaaggcacacaggattgagggagaagaagataaggagagagagagagagagggggagggagggaggggtagcaaagcaacttagctagctttgccagccatggcgaggagctctccttgccttgccgtcgctgtgctcctccttggagtggtggtggcggcgattggagcctttgctgatgaaggggcggcgagcggttggggactagggcatggcgcccgtttcctcagcaggcgaggccgtgctgcgtatgagaagtcgtcggagccagaggcaaagcctgcgtcgcagcaggagccgaagtcggattcttactcgcaggcaaagcctgggccaaaagatgagcccaagccggagccagaggcaatgtctgcgtcgcagccggagtcgaagccggcaacttactcggagtctaagcccgaatcaaaggcagagcctgaatcaaaaccagagccaaaggcagagtccacgccacaaccagaagcaaagtcagagcctaagtctgagccaaagccaaagtccgagctatacgcagaaccaaaatcagagcccaagtccgagccacagtcagaaccaaatcccgagactaaggcggagccaaagtctgaacccaagtctgaacctaaatcagagcctaccccacagactgaaccaaaggcagaatcgcaaccagaaccaaagacagagccaaagtctgagtcgaaggctgaaccgaagccagagcgaaagtcatactcaaagtcaaaaccagaaccagaatccaagccagaagcaaaaacagaaccacagccagagtctaagcccgagccaaaacccgagtcagccccaaagaaggaaacgccttcgtcggcctacccatgatggagatccatggagatcgagggcatcttgcttgctgcacgatttagctactgatgagattattttgctgagggtcggagcactaggaaatggccattggccatttctggaataaataagtgacgacctagctttattctttgctttatttccctcattctttcatgtttttttccggatgtgccactgcgccagctggtgtaattcacttatttcttatgtatctatatctatgccattttttttctaataatacatacatatatatatatatatatatatgtgcatttttttctgcccagtactacctttataattatccctcctgttgtttattctagattatattgtggctgcctaacaaagttccatcaggaaaagggtgtaacactgtaactatctaacactgaactatcaaaattgttcgtagttactattacattttcgattagtctttgtaaatacagtgctaatggcacggcttacttatatatgtaaaacaatcatcaagcgcaatccaatctgtacctggtttgatcgagtctgcaggttcacggttaacaagctcctgacctccattaattttagtaattttactatcttaaggcgacgacgagcggtaccgcaatttcgaatttaattacacttaattattttggtgtcttttaataaccgtaaaatttctccattggtaaacctatcgttggaactgatccgcactatattggttaattaatacaagttcctactcccttcttctgacgccgttgacttttttaaacttgttttaccattcgtcttatttgaaaaatttaaataaatattaatgctttccatatcatttgattcattattaaatatacttttacatatacatatagttttacatatttcacaacagtttttcaatgagatgaacagtcaaacatatttaaaaaatcaacggcgtcaaatatttagagacagagggggtacttcctcgaaaaattttatcagctggtgagaacaaatattatttgtcagtattataacaacatttggcttccctgatctaataatagctactacctttcctaaaaatatattaaacgaacctatgtgctatcagatcgtgtccaatatgaattcaggaaactaaatttctacataaattattttcacaaattccttaaaaaattaccagtctctgattgggttgagctacgacttatttgatgtgaataacgaaaaaaatattatgggtaaacttttatctgtattattcatggttttagaagccaatattaattagaaaatggactacaatagaaaaaaacccttaaaagccattgagcaaacaacgagaatgcgagttccaaaagacacctgtaggccttgagccttatcatttttggcatacaacaaaaatgagttattgctaaaatttaaattttaaaacataattttaaagctaattttagagtatatttaacgttgtttcttttttcatttagttttaagttgctaagcataagtatacatgtaaaattttacatgcaaattatttttttagtcgtttataaactaattgacatatataagcagctcttggtcaaccaggtgtgcgtgcttattactgtagtaactccgtatcagtatcctgtatcctccaagcgttacattatcctctctcttgttttctcctcttccccatcatgttctgttcttcctccatgaagcttctcccacctaacaccacgccacaccaacccccatccagttccccacaagcaagccacatccagcgtgcgacaacatgtccaacggcggtggcggaaaccctctgggcgctggtgacgaaaaccctaggggcggcggtggtgaaaacactatgggtaccagtggcggaaaccctaggggctacggtggcagaggccctaggggttgcagtggtgaaagccctagaggctacagcaacagcaagcctacggggacggtggagggttgggttgcggcgcggtgatgacggcgaaggagggttgggttgtggcagcggcgataacaacgaaggcagtggagggttgggttctggtggcggcagcttaggcaagtgggtggcttgtggcggtgatgacggcggtgggtttgcaaagtgcctcctagatgcagtaagcaacaccgttgagacaagtagtactcgcgaccacttattggaagaaggcaagaattttgttttgaatacacaagatgggtacgacgacgaccagttctcctcggactaggagtttgtgcccaagactgagttccaggaatgtgggggagtggaggagaagggtgataggattcaagactgtggaaaagtggaggagaagggtggtgggattcatgattgtgaggggagaatgtcggtgagattcaagattgtagggaagtggagaagggtggtgtgatatgtggcaacagtagcatggtgcactcacatcatggggggatatggcctcctagccggaggtgcgggcaatagctttgaggcaagtggtttgatcataaatctggccactttttagaagaaggcaataatgtaatctatacacaggatgggtttgatttggatgagtacgagttctggtctgatttggatgatgaaggcgacgacttgatagttgattgcttcaatgattttgtgccctagaaaatggtgcactatggtgttgtacttgttggaaatttggtcatatttcggcatattttaatccaaaatgacaagataataaacatgacatttacaatggaatttgatccaatgatagttgtgaatgtaatcaacatgagcatgcttaacgtagaataagcatcaacaatcacataataacgcaatgttgacattgcgatgaacagtaaaacttctaattgaaataatgtaagaaggttagaccccaagaatggtcctccgctagagtttgaggcagtattgcctccgttggtgttgacgggaacctccttctccttgtctccagtgttgccgttgtctccagtgttcgacatattggtgaagacgaagtagacgttgactaacagtgagtgcgccttgcgctcccaagaaacctgatcgcccgcccgtccgtgcaaacgtcgcagcagtgcgtggtttcggaggcctattctcccaatgcgtgtgcacacactcgtcaggatgggattatcgtagcagcaatagccttggaaatggatgaaagtgtctcacttctacttaggcagatcaaatccattctcattttatatgaggaatggaagatgaagagtaagagtcatggaataagaagaaaaatagagtaactaattctcatcaattagccatgaaccatcctccactacacaaccatcaaccaaccatcaattaggagtaattgatgtaggttaccaatggaataggaagaggaatagagcaactaattgtcatcaactggccatgaaccatcctccactacacaaccatcaaccatgcatcaattaggagtaattgatataagttaccaattccctaatcaaatggattaattctcaaaactcctcatcccattgatatctcataagagaatgaatacacatgaattcctagcgtaatgagccttggaatttatttgatttaattgatttaaatggatcaattacccaattaaatctaacagtactactagggaagggaggcaatgaaattggcgagctgatgagctgcgatgtggctcttggcatgggacaagctaactcgaccgttaccaaggtgtcctcttcgtcagatgcttctttgtgcgggttcttgttagtcttcatgtactaataggaatccgcacaaaggagcagctgtaatggagaaagaggaatactattaaggttggtagagaaactatgagatctttcatgatctctaaagttcttccagctattagaccatgt

SEQ ID NO: 67779 - DNA, 16042 bp, Oryza sativa
ataatgtatttcatacctgtacctatctctagtaattttttcatgaatttacaaaacttttaggtataattttcacaagtttccaacactaagctcgttttcaccatatatgtcctccacatatatactccctccttttcaaattagtggtcgtactagcttttccctaagtcaaacatttgtatctttgactataaacatctagaattatacagtttaacatcataagataaatgttagtacggttttaggttcatcacgagaaatactttcataatatataatgcacatgtccctcaaatgcaagtatgcagccgcgctcaagtagcaagagcacacgcgttgcgataaaaatgaaaaaaaaaagcggaagaggaaatgacaaagtctcaagctcagcactacctctgctggtactcatttcagcagctgccaccaaacactcccctccaggtgcgcctcaacgctgctaagaataggcaaattttaacgacaatggtcaagaacagcatatcactttcttcccaaaattacggcatcaatgcagtaatagtagagaaaagagagagagagagagaaggaaatttgccccttgggggatcgagcaaccctcatctaagtcatcttcttccaccgggtagaaatagatcgaccagtccaccgaacagaaaggattgagagcgaacaaaccacagatattcacagaaaccactaagctagcatcgcggattcgcagtgaaatgaagaaatcaagaacctgcctccttcgaaacgaaaatcagcttgaaaaatcccaagaagcttcgaaatcaggaggcgaaccgaagcgccggcgctaggagaagaagaggagagatcgccagatggggtctcgattcctggagcaagcagcaaagactgcaagcgagggagaaatgattggattggattcttgcgaggctcttggcttggatctctagagctttctttttgctctgttgcttctggtcagagctaggagaatcataggtaggagggagacctgggacccacctgtcagtgacatggagctctcgtacacgtaggagatctggtaggaattggaatattcctgatcaagctaacatggaaatgggaagggattaagggaatgatcagatgaaaggttgacattgcatttttttttcccggatacacaatacactttggttcatgtgctcctatttcagttacatttttgaaaaaaaagagaaaagtttgcagtccttttatgtgaaaaacttgaatgtatctgtgcctattttttgtgtaataaaataaaattatttataagcagcaatcaacattttggatgttagcatcaacctaagacaaatataataactatatgaaaaattctcaacctgatatttgctgtttattaaaccgatgactgaaatttatgtcctaatcaaaacctcctagctacttctctcagtgttcttgctaactaaagcctaatctgagacaccaaaaaaaagaaaaaagaaccaaaaaataataataaatccaagctccaggcctccagccatggcgcatgggcatggcgtccccctgatgatcaactctcctgcgtcttgacgacgatggggctccgcacctggtggttcccgtccgaccagacgatggcgccgaacgcgtagttcgccgccggcgcggggtccctcacggcgaacttcacccagaacgtcctcacctcgccggtgctctcgaacgtcagcgtcgtcggcgtcaccgtcacctgcaccccctcgggctccctcacgacggcggccgtgtacgtcgccggcgggccgacgttcctcaccctccgccgcgccgtcgccggcgggcccgccggcgccaggtcgaacgcggtgatggacgggtagttgaagtcgagcgggtcgagcgggtcgtcggggcaccggaacggcgcgccgttgaagagcgccagcgccgtcgcgttgtagccgatggtgcagaggaagctcaggtggtcgtcgacggtcaggtcgtacaccaggcccgggtccatcgcgcggtgcgggaacacgtgcccagcgccgcagctgaacggcgtcgccggcgacatcgacgagttcatgatcggcctcatgtcgttgcccagctccgtcgctgcccatgacaaacggctcgtcagctagcttaataaatacttcctccgtcccaaaataagtgcagccataagtttccgcgcttaactttgatcgtccgtcttatttgaaatttttttataattagcatttttgttgttataagatgataaaacatgaatagtactttactcgtgacttatgtttttaatattttttaaaaaaatttcaaacaagacgaatggtcaaaattaggcacggaaaactatggttgcacttattttgggacggagggagtagagatttagtccggtcatatcggtacctcgcgataccaaatcgttttcgatcgttgaatctagataggcaggatggacattgttagatctaatggtcggaaacgatttgataccgtgaggtaccggtaccttgaggtactttttgttggatcggagcaaatctctaataaataatgatgagttcgtcgtctccggcgcgcggcgtcgtgaggagagaatttctcaccggtggtcatgatggcggacttgatggcggcggggctccagtccggatggagcgtcttgatcaggccggcgacgccggacacttgcgggcacgacatggacgtgccgctctgggcgttgaatgccacccgccgctggtcgtacggcaagcccgtcggccccgccgcgccgctccacgccgcgatcacgctcacccccggcgccgtcacgtcaggctgcatccacgcatacaaaaagatttacctcgtgtgcgcgcggcgcgacgtcgagctctcgccatgaaaagtttctcacctttaggatctcagggttgacggtgttcggcccctgcgacgagaaggccgccatcaccggcgccggcttaacgccgaccaccgtcttcgccctcgtgatgaaggctttagcgccccttcattttcacaaacaccttccgctcagctcgaacaaatcaagaactcgactcgtaaatttgatctttggaaagaaacggtgttgtttgattacttggtggagttgatgtaggccaggagcgcgtggccgtcggcatggttgatgtgcaccgccgggaggacgtgcgcgtcggcgatgacgtcgttcccggaggcctcgtcgttgacgaggatcattgcggcgccgccggcgcggctgacctcctcgcccttctccaccctcgggttgcctcctcgcatgcacaccacgatcttccccatcaccttcttgccgtccagtgctcccagctcgcagagcaggctgtgacattggcatccatccacagagatggttagtgttcgacgccggcgtcggcggcggcggcggcggcggcggcgagagttgatcggtgtgtgtgtgtgtgtgttttgcttacgcgtcggcgggcgggtagccgggaacggcggcgttggcggcgctgatcatggtgtagaaggtcttcccgcgcagccatgtcggggagaggctctggccttccacccggttgcggttgaagacgaggtgcgccgggaacgccctgtccatggtgctcgcggcgacggtgaggatccatggcgcgacgttggtgacggtgccagggtcggggccgaagttgctggcggagcagacgacggtgatgccggccttgacggcgtggagggcgccgatggcgatggcgtcctcgaggtagtcgttggggtcggcgccgacggaggcggagatgacgtgcacgccgtcggcgatggcggcctcgaaggcggcgaggatgtcggagtcgtagcacgcgtcgctgccgttgaagggagggtagcagacgcggtacgccgccacgcgcgcccgcggcgacccgcccctcgccgtgccgccgccgaggccgaacgcctcggcgccgcgcacggccgacccgccggcggtggccagcgtgtgcgtgccgtggccgttggcgtcccgcggcgtcttgtgcgtgtcgttcagcgggacgccgatcaccttcgcgtagccattgttgaagtagcgagcgccgatgagcttgctgcacacacacgcacgcacacgaaaaatgaatcaaatatatatcctttggagaaaattcatatatgcctacattttgttaaattttttcaaaattatttttactctgtttttttcgccaccgaaagtgtacatcggtggaaaaataggaataaaaactccggaaattcaaccctttttcttgaagaaaaaatccactaaatttattgcgacagttacatttttgaatagttttttttaccaaaattgaaagaaatataaagaaaattcatacttgggagtagatttgtaacataaaattacctgttgcacttaaacgttttgtcgtgttcattccggcaagctcctttccaataatttgggatcggaccaagctcacggtcattaaagctcagcgattcaggccacacgcctgaatgtcaaacacaaaatcagacggaattagatttaaaaaatgaccatgttacacagtatatgtaactttcccattcgaaaatcaaatgcacttaaggacgttttcgaaaatgcttatcatcagacgtccgaggaaggaggaaaaatcggacacctcaacccaacggagtagtagtagcgcaggtgcattacaagtgcatgcagccaatggagcgtgcatgcaagttacatggattcaaaatttaaatgatcttttctattaaactatttattagaattatgaactaattataccattggatttgttataattaactctttataacaaagatctcacatgataataatccgatgatttttatcacataatattattctattgtttcaataagtatttactcatgtttcactaattcagatataatgttgcatgtggtctttttatatgctttagtaaatatattttgtgtttcaaaaaaaatacaacttgacgcttaaagagggatataaaattttaacaaaataaagtatttgcaaatattttgcatcatatatatatttttatgtttccctaggtaggacctagtgtttcctgtaatggtggttattgttgtagccagtaatttttatatagttattgttgcacgtgatctatttatatgtttcaataaataattttttttagctttcaaaaattgcaagttaacgtttcaagaatgatataaaattttaacaaatcaatatttgctaatatattgcatcattttttttatgtttcagtagttgggacctaatgtttaatgtgacggtggttattgttgcatttagtaatttttataagttacatcgctctgaaacattttttaaagtgggttgagttatcggtacaagtgataaaataattttatggtgcaacaaaaggttgatttttctaaaaacacatataaaatgttgcatgggcattattttgatgtttcaataaatattttttctgatgttttactagtttattcatgaatgttgcatgtggtactattggatgttttagtaagtattttctaatgtttcactaattcatttataaatgttgcacgttttgcatgggatgttgtagtgaatattttctactgtttcaataattataactcgttgtttcacgtataatatataaatgtttcaattagtaatataatcatatttacaaattttatcagaaatatagccaagtgagatcttattgtaaagatttaattgtaacgaacacaatgatgaaatcggatgatagatcggctaagtaatttagaaggaaaaatagtttaaagatttattggtagagaagataaaagagagagactacatgtatgcatgtactagagaaggttataggcttgcagcatagcagcttaactacgatggttttttttttgcatgcatcagatatgtggatgaacaacgtccgatcttttgctaaatatcgaacgtccgatgtgtagcagccaccggatgtttgatcagtgtatagtttacctaaatatcgaacgttcgatgtgtagcagccaccggatgtttgatcagtgtatagtttacctgagtcgaggttgccgatgatgatgttctggccatacctggcggcctcccatggcgaccacggcgggacgcttccgtcgggcctctcgaggcccaagaactgccacgaccgcgtggtgtgcatccgccgccccctgtccgggaacaccgacaccacgccgggccgctccgccaccgccgccgcctcctccgcctccagcctcgccgcaaagccgttgatgttcttcgtgtacaagtagaagatggcgtcacgtgccttctccctgctgcatttttgcgcacgcgcgcgtgtcgttcgaccaaatgcgtctcgagaaatcatgcaaaagagcgaatctggagatcaatggagttgggagaggttgcgcttactctccgaggacggagccgaggaggtcgtagtgcgactccgcggccgtgcggtgcgcctcctccggcgagatgacgccgccgtcgtcgccatgggagtggcggccgccgaggtagacgatgtaggacggcttcgtggcggcgagggcgggagcaacgatgaagacgaagacgacgaggagttcgaggcgcgtggacatggatcgagccgacatcgccgtggtgatcaccatggcgatcgagatcacgggagaggagaagagaagagagggtgaagtagagtgtggtgcagcttgtggttttgggctataaaggagaggagacgagtagacgagaggtggtggtggcgaggtgagaggctggactgtgtcttactttggctctgtgtaggcggttttggctttgcgatggagaaagcttcacatggccgcgatctgcactgtgcatgtgcatgaatgtaccctttgactccatgtaactatatgttttttttaagataatagaataaaatatctcagcatttactcaaacgagttataaccaattattacatagttcacacaatagcaaactcacacaacgagtctagaaccacagaatgaaaattttaaacaagcacgaactaatagacaccaacacaagataaagatcccacaactattgaattctatttgagaacctccagctgcataatcgttggctcaagtttacgacatgcatcattaattaggttaatatcttcttcataccttttgtaattgagcccaacactagagccaatacgttgccctgaaaagtaccttcaataagattttgatggtgatttaccaaaaaccatgttattcctactaagtcaaagagcctaacataaagcggatgctccaacaagaataagattcttaatctttttatcaacaccaacaagtcaattcccgaacatatgagacatactttgtggaggatgaaccaaaagaaatgtgaaccgatctccaaagaaatatagaaaaatggtaattgaagaatagatggttgatggtttcatttttcatataaaaacaacatcttaaattaccatcccaattccttctagccaaattatccttagctaacacaattcctttaagtagataccacataaaaattcctttgagtagatcgaactatgaattgactattttgatgaaagtttcatctgaaactatcactttcttctgtcagatcaatatgcacaattgaagcacacaagctatgccatttgtctaagttctgaccaactaatgatcttctaaaagacacattaagtggaacagatctcataacattcgcaaatgtatcatttctccttctgactatagcatacaaagatgggtatctatccttaaaggaaaaatttcctaaccacttatcctcccataacctaacttgttcaccattattacttatccaggaactcatgtttagaaagttactcttaactttcatcagatctgacaaaaaatggaaatcatatgttttttctcaacttgagttattaatttactattaatgcattttcttttcaaaaggtcctccagacaccctgctcatttattaacttcaataaccatttacttagtaaacattggttttgaattcccaaattatgaataccaagacccccctgatcttttggctgacagataatgtcccatctagttagtctatatttctttttatggtcctcaccttgccagaacaaacatgatctacaataatctattttttgggatcttaaaaaaaatatgataaacatagttaagcttgataaaacaaaatttatcaaaaccaatctcccctaacagataaaagtttccccctccaactacttaagtttttttctcaatgtcactatgtaattaattatgcagctatatacgtatgcaaatatgtaattatggggtgtgtgtctgaccaatccgagccgttctagggacaattttttctaccttccacgtcagcaagcgatcgattgatctgggacatttttttttaacgcttagatgcagtcgtacccgttatttgcatgggatttaagcatttatctataactaatataaatatttggatttttcctgtcgtcacaatccgatttcgtccatcaccgtccgtgccatggcgctcgcgcaagtgaaacggatatcccacatcatcccaatccaacccaaaaacaaaatctcaatctcaatccaaacccaaatcgaaatcatcacaaaatcatcaaaagatgatgagaggagatggaggggcgagcgggagcaacaacaccatcatcacataaaaaccccaaaatcaatcgtagcaatgacatcatcatcacatatacaaacaacaaatacacaaccaacaacaatggcggatcgggccgaggggacgtcggcggcgtcaggcagatcccctcggccggatccgccagtgggtgccaccaacgtcgtcgtcgccgccgccgccgcctgatccgccggatccgtggtgggtgggagaagaaacgggaaaggcggcgctcactctcgttgttgagaagagacgtgataggggagagggaggtggagtgccggagagggagagcgtcgccggttgagaggagcgcgaggagaaggatagaaggaagccgagaagaccgagaggaaacgtgccgttgtctcggcttcgacgcatgcagcagaaagggtcgacgcgtgcagcagaaaagcaaagtagtagtagtataatctcagttcaatgtatgcccgtgggacccacgtaaaagttttcaaaattgagcagtatctgccgttctcaatgcaaaggaataggcaatcaaacgaaatcttctgttgtttggtccctgttctcttttttttccgaccttctttccgttaaattcaatttttttctctaataggacatgactaaatacaacgctgctgtaaattagaattaaaaaaatgtgttctgtttttctatttttaaggtaaatataaagattttgccttttgccttgcgagagaaatctatatagttttatgtgtgtggatactaggaacaactagaaatatatagcgaaaggtttcaatgaaagaaaaaaaaggcagagtaggaaaaggcgtggaaggacatggactcctggccgtagaataggtctttgtgaataaacctggactcctggcctgctccggactgacctggactttgtagaatgcgttctctcacgcactttgtccctaccatcggtgatcgctttccccgcggaaaagaaaaacacatctgcacagtgcgggattggattcttgatcgactcggatcgggattgaatggatcgtgttagctccctgccgccactggcatgcctcctgtcgttctgcgcagcggcgaccgccaccttatcgacgccctccctggtggccagcttgtttgccaggagcacctccgcgacaccgcccaccacgtccttgagtgttgtggccttattaatcttctccctgtcatcattgggtggtgcctcatattcgcctcgacggcctgagcaccgcagcaaccacacagccggggatgaccctggacaggaagaatagccccgtggcgctcatctcggcaccctgcactgccgccacattggcggggtctataggcttaaatcccggggaaggtcgccgatggttgtagtagtgacatatcaacactgagatacatagcaaatgcaaattcgttgagctacaccctccaaatttatcaccatagatggctcatcagtaatgctctagatcaatacgacaatatggaattcacacgatttgcacaactcatatgtataaaatttggagatatttgcgagatatgtacaaattcaatatttttgtgcacatgtgttataagtacaaacaatcttacccatcaatatttgtttgatatttacccggtgcaacgcacgggcatatttgctagtatggaaaaaaaattcaaaaacaattgttacgttgatgaggatggcacaattatgtatagggactacctagtatctttcgacatattttttttttcttaggtctcacacgaattttcagtcataggataaaaaacaaaataacggacaggatgtttcgacacattttctaaatgatatcactcggcttttatttcttacgtggcagtggcagtggcaggtctgcaatgcaccgatgcatccacggaagattgttgggctagggaacacttgagtattctattcaggctatttgcaacacaaattatctaagcgacaatgtttagcatatcctcattaaatagaagactggatcttatttacaattcaaaagttacactgtaaatttaaaaattacactgtaagatacaaagaaattacactataagtttgaaaaattacaatgtaatttttaagaattacattataggctataaaaaaacactgtaaaaattcataagtactcgtatactgacacgatagttaattcattgagaataaatataaaaacatggcaaacaaaaaatagtatggctctacgaattaacagactagctaagcatctaacagccacaaaaatttgtgaggcgtaagaaaaaatcacgcgacaaaggaataacaaaaatcgttcatatatagtgatgacccattaatgtaaatatctgagccgggtattcatgacccgacccggtttctaacgacaactacatgcccaccgcacggaggaggtttcaaggagatcgaaacggatttagtacaattaactaaccccttccaaattttgctcatatattctactccgactgggactcgcaaattaagatcattgcgccgtcggactcgggcatcggctgcctacaaattcggccgggaggttgggagttgggatctcaggaggcaaagcgatcgatcggtacaacaatagcaattagagaaaaaaaaatttagaaagccccagccatggacgacgacggctcggcgatgcggcgcctccgcgacctgctcgcgccgccgggggagagcgagctggcgcgcatgtaccggaggtgcgccgccatcgaggagctccacaggcgcaagcggagaggtccacgaaggcgctcaacgactggtacgagctcaaggccgtcctccacgcccaagggctgcggtggagtgctgcgcctgccgcctccggggaggagggcacgccggcgggatcaatggcccaacgacggcgacggcagttaaagattgggagtagcacagcggcacattcaataatactacctccgtttcacaatgtaagatgtatattggcaaatgctagaaagtcttgtaaaacgaagggagtagtaaataaataaagatataggggagacaaattatggtaactaggtgatatctgcgcgttgctgtgggactttataaagtcataagtaaaattatgttatgtgcgtaaaattgcagaacaatgattaagaatgatgactggagatccattcttcctgttactgaggaaattcttaacttagataaattggagggcatgcttagtatttgctatatataatatacttctatattaactatattaaatacaaatgaccacgtgtagtaatgtaaatcaaatggaggtagcaggatgtaaatgaaaaggaggtaaatcaatagtagagtaggagtagatattaattttaatatttgttcctggtaaacgaatggggatgcatatggtaaaaaagaaggaattgatatgggtaaaactggtgtaacaaaatgcgagatagccaaactggaaaactaatgcaattacaattatgtatggagcatgcttacacattgaaatacatgtacgaactgaaatggtggtcctatttttgagaaaaaaaatcagaccaatttgccaaaaggaaagaggaagatgatggctaatatagcttgtgctagctagcttgttggagtgattaaagaagatgatggcgtagagatgcttatgattccagcgagcaaactgcagcaacagaaatggaacaccactggtcctatatattgatgcatagggattatgtaaatttataggcagcatgagaaaagggggagttagagcatgcggcggcggtgtcttctccgacgagcatgtaaatttatttgtttggggatgggaatggtggggaagaggagagcggataggcactcagattttctccagggggtcaggggtagagtggtaattcaatatcttctaaatcattttttcctttttatttatatatttctttaatttaatatgggggatccacctaactgccaaccatagtaggggtaaacggtgccttcgtttaaaaaaaaaaagggtaaattcgcaaaccctagaaagtgagagcaaaatgataattaaagttgaaagttggggtataaacatatttgtccaaaaagaaaatgatgacatccgttttcagaatcaattgctgttgccaccaccatggacggttgctctgtcgtgcaatgctcggtgagaggatggcagctaatggggactggatgggctgttctagccgggtaatttgggccaggcttgactggcaactgagctatggagtgtggaatttggaacgttcagatcgaatggcgtggaatgtcagatcgaatggctcaccattttagatgacatggcctcacgattttacagctttacagtgttattgctctgagcgggtatcaactagtatctaggaagaagttcccacaaaaaaatatatatctaggaacaaggatagactttttctcttttttttttcggagcttggagaaagtccgagatgtcttttctctctaaatctttttttactagttttatatacagatttcaagaaaaaatacttaaaaatatctttccaatataatcatagtagtataattgtaatgcaattatactgtgattacactaataactaatttgtaatgcacgataacaacaaatcaagtatcccaaaatcaatcaaaaggggttgcataaaaaatcgatcaaaattagtggaccagccgtgcttttcttcaggttgtatgaaaagaacgcccactgtattaacagctggaaaccggactgactagtagcagcactacggcaatcaaggtcgaaactacgagtatatccgtattccgtaatgcaccactacagcaccgcgacaacatgtcgagtcagagggcctgtttggtacagctccaactcctaaatataactctaggagttgagtctggagtgaagttgtggagctgcctaaacccagctccacaactctagtacattttgtgagagagctccacccaactccactcccagttttggtggagctgaaactgtttggctgagctccagctccaggaggggtggagctggagctagagctgtgccaaacaggcccagagtatccgtaatgcaccacccacagcaatagatccgagtcagagtatcatcccatccgagacatatcgcaccacagcaagagtcagagtatcatccacaacagtacccagagacatcgcaccacagcaacagtacccaaaaaagtgcgtcttgctgataaaaaagatgatcctgaactccgtcttgctgaaaaaaaaaactgtaaaacatgaattcacgttatcagaataaacatttcaacaataaacatacatatgattcctttttgatgatataggtactctctccaaatagatgttctacctctgatgctgctatttgctcttgctcactcaaccgtagcttgtcacttcgtcttgctgaaagaaaactgcaaaacatgaattcacattatcagataaacatttcaacaataaaaacatgcatatgattctattttggatgacatagatactcacttcaaatagatattctacctctaatgttgctatttgctcttgctcacttaaccgtagcccgtcagtgctcagacgtggtaagtgccactgcaaaagggaagcgacaaagctgcttgttaattgtgtgttctcatgcaaagattaaaaggttctcttacaaattaaattaaaacaaaaactaatgaattagtccaacttacacatctcgttgtagtacttgtcaacgagaatagccatcttttggagctccctcaccagcgtgaactcctcgtggtcctggtacttgagggacgcctgcatgtcgagcctgcgctgaaccagcgccgcggcctgctgccggtcagcgtctcgaagcgccccgttggtctcaacaatggactgctcaagtcctgcttggtgagctcggcactctgcaagctgggtatccatatcgtctcgcttccgcaagactcccttgacagcctgccattaaatgaaaagagaacaaatagaaaacaatatgttatgaccagtaatcttggaagatcgcagcaaagtataagtaagacttcataatatacaaagccacaagagcaagtaatttaacatgttaacgccttataaaatcactaagtcaagatcatttggttgagctctaactagattagaaagactgctatgcggatgttagggttagggtttgggcgctgcccgggcgaccgtggtacggcggcggtctcgcacattgtgcaatggatttggatggggattgtctccgatccactcttgagtctacaaggtatacgcctgctgttggcaacggtgttggatggttcgattctgtcgtttctcttgattctgccctaaaagtctagatggaattctatcgtcaggccaagaaactatgttccctgtttagtaagttgcgttcaaatgatggaatttccatcagggttccctgtatcatattcggtggcctacatcgtttggaaaatcagggagataataggaagtctgatctgtattggaattcctgggcagatttcgtgggaaccggactcaggttttcatcggtgtaaaacggagggcttggtgtggccaaaggtacgattcaggaagtctcccaagtttggatcatcaatctgcaatctaggtttcgagctctacgtttcgccaaggtacctcatggcggctgccgatggtgggggtgataaagggatcattgttgagatggtttcccacccgaagccaatcggaagcggtgagggtgccttggagatcttagggcgggagttaagggtggagggtatggcggaggaaggaggatctatccaaagaccgaacaagacatcgacatacaagaagagatcgaaggagagcccgaatatcaatccatcgcagggaccgacaacctttacagagggagtggttgatgatgaagaggaggatgctctatgtgtgaatctggaggaggtggtgaagatagcaggtcgttacgatcttagcgagattctactcgttaaggattccaaaccaagtagctctctttgatgatatgcgtagggcttgaagattgaggtcggacattagctataaatcgctgcgggatagcatgttcatcgtaactttcatggcagagggatattatgaatttgtcttgcaagggggccgtggatacatagaggggatgctct

SEQ ID NO: 67780 - DNA, 17231 bp, Oryza sativa
atatactagctaataccctctatccgatgccctcctggtacttcgagaagccacccctgactgtcgagttccttacgacagcctgtcatgaccatacaaccggtgctaaatacggaggaataccctccctagggaattaacttaggattatataccggcgcggaggaatacccgtactaagttgtcaccatcagcggcccacctcttatccgcaatatataactccaaatatagatatctcgtaatctagacaccacatctaaactaccagatactactctaatatcatcgtcatgacatagagtaattgcataagcaaacactatacccgtactaaagcatctcccagataagctagccgtatattcagtataacatgaacataatgtaaagtagttactcatatactcggaaagtatttcaataccataaatgtatttagaagagtattctaataaaagtacaaagcttacaaaagagaagagaaaagttactagagccatacccgaactcttccgaaggcttccggactcctgatttctactctattcctattccaccagctagatactactaaactaaacttgagagaaatgagagagctattgcttgatgtgtgtgtgtgaagtgagaaaaggaactccttttatagcttaactatgatggttgtgacggttggagtggtctgtaataccctccaaccgtcattggggcttcgtctcaaccgtccagccaagacctggatacaacggaggcgagggaggtcggccgaaccccctggttcggccaaacatagggccagcccaaccaacccatggtttggctggcggcctcctctgttgttctactccgaagacttgtgaattttggcccagtttgtcgtgtcaattcttagttcttggcccattcatacataagtctggttctcgacatcgtccgattgatttattgtctgagttgatgtcgattctcctccactttattgttattctcttcaaaaggttagtagacctaatactagtggaatattattattctaacatatttatgcattgcaagcatcaatagttctcctttattttggtaatattgacggtcaaaactgatcgataatgaccgtcaacaatattcgtctcgtgaatcaacctccaaattcccgatatgaatagtttaaaccttggcttcttcgcctcacttcagtccttaacatctactagggtctctacaaacatcaaggagctaagagagaatattcacaaggaatataatgactacaatccaaacactcttaatagagtgtttgtgacactacgaagctgctacatggacgtaatgaagactagtggagggaataagtagaagatccctcacatgaacaaagagaagctagaggcatgtagcattcttcctaaagcactttgttgtgatcatcaactctatgagagagccatacagcttatagttgactaattgtgcacttgtgtcatctgtgtgtctatgtaattgtggaaactaaatatataagttgtttggttgtattaatgtttcatccaaggttatattaacaagttgactattcatatgcacaatcacaaaaaaaagaattagtacaaattaagagatgcatggaatttcattaaaatgttttcataactatagtgctaaaagatgccaccaaaacagaaccacatgacgtataacatcataggatgaactatgcagctcattcattatgagttcatactttggactaataacaagttgtaggtagatcgcacataattcatgtcacataatcagcacactacttttttttggatggaaacactaggtgtaacctgggattagtagacaaagcatttccaacttgatgtcatcaatgggctcgtattcttcctcctatgaataaccccaaaggtctataccaccaaactgatcaccacctttttctttgtctctacgcatctcctcgccatgtatctcctcctcgttgggcatgaattggatagacacctcctcaacatatataaaaacaaactaaaactgaaagtaacaacaataaaatagcagtgggcagtacactctatgtccagtgcttgcacaacatcatttatttattacagttgatttttctctagcgtaacctggacatattcaagtttaaatgacccaaattttcatatcaacaattacatcagtctgaacgggttttctaatgtcaactttgtttttaccagcaccatgctgctcaatttaaatgaaatttttatttggctagataggtggttttgcttcattaactgtaggaaaaaatagaatcattagtgcttacttatattggggtggttatcttttgctttgtagcttaattaggtttgaacccataaccatatcttaaccttgaactagacacacagcattggcacatactgccaactggtatagtggtgtgggccattatggatcattgtaaatttcacagaaaggataagcaaaacatacttaaatgatgcgtctgtgaatgtcatttctaattaagcctcatgaaagaacaaaaagtgatacgattatctatggaaatctattataagaacataatgttacacttttgcatttatagtttaaattcaatattttcaaggacagtagatcttttaatatttgaaccttatagtttatttagaggggtatttctgacttgggacatggaagaatagaagcagcattctaaggtctttagatttttcccatttttcagtcaactaaatctctaattgattaactatcttaggccctgttcgtttcttctacgagcagaggataaaattttggatactcgtggtatgcttttcaaactgctaaacggtgtgtttcgtgtgaaaatctatagaaagtctctaaaatatcggattaatccaattttcaagtttgtaataattaaaacttaactaatcgcacgttattaccacctcgtttaccacctcgttttgcatgaaacacttaatctttatcttcatcttcatattcaggagattcaaacaccactttaatatgttcaaaaactagcattttataatccactacagcccaattttcaagtcaaaacttcatgattaaaagcatgcaccttgctttgctcgttgatatggaggactccaccctgatgtgcttgcttagtccagcaccgtgattggccattgtccctcgccgcaggtcacctctatgtgggtaagaagcatccaatgaagaggacgccttggtaatggtggagttggctcatcccataccaagagccacatcatagctcatcagctcgcaattttcaccgcctccctacccgtgcagtgcaaaaccatcgtgcaccattttcatgggcacaaaatcatcgaaccaatcaactatcaagtcaccgctttcatcatccaaatcaggctagaactcatactcatccaaatcaggcctatcctggatatccaagattatattcttgccttcttatactaagtgatcagatttacaatcaaaccacttgactcgaagctgctgcccacacctctgggtagcaggccatatccttccaagatgtgagtgcaccatgttgctgccgccacagatcacactacccttctcctccatttccctacaatcctgaatcccactaacattctcctccgtttccccacattcttgaattccaccacccttctccgccactttgccatagtcttaattctatcacccttctcctccacttccacacaatcctagaactcagtctcgggcacaaactcctggtccagggagaaccggtggtcgtcgacttcattattggaatcgggggtgaacttgaactggtcatcgtcagacccatcttatatatccagaacaaaattcttgccttcttccaataagtggtcgtatctacgcgatttccatatgcctcaacaacattgcttattgcgcatctaggaggcactttgcaacctgccgccatcgacatcgtcacaacccaaccttttgtgtatgtcaccgctaccaaaacccaacccttccccaccatcgtggccgctgctgccaccacatcccaatccaacgtcgtcgtgttcgccgcgaccgcaacccaaccctccgccacacccctaggcttgttgccactgtagcccctagggcctctgttcccgctgccctagggtttatgccgccgtcgcccctagggtttccgtcgccgccgcccatagggtttccactaccaccgctggacatgttgtcgcacgctggatgtggcttgcttgtggggaactggatgggggttggtgcggcatggtgatgggagggagaagtgatgcactgctacagaaaacattttcctggacgctgggcctgtttgtttccagatgggccgtaagtggcgccgtctggaaaaatcggacgactggcatcggactgtcgcccgcacgggaaaatagattatcccgtgcgggcgtcttaacccgaccgcaccggaaaatcctcattatcctgtgcggtcgacttaagtggaccgcactggaaaatacctctctctcttttccctctcacccatttcaaacttcacacactctctctttatttttcctttttattctctctctctgcctttactcctccccatccctctctctctgcctttactcgactcccctccccccctccctccccaccgagcggcgcggcggtgcggctgcggcggcggcggcgaagtgacagcgcgccgcctgagtggtggaccgcggagctcgcggccctctcgctggcatcctgaatgtcgacaccgtgcgccgcatcatcaccgccttcgtggagcgagactcggcatcttcgggcggcgcgaacggctggagccgaggcactacaaggcggtggtggcgcgatgcagacaatggcgaagaccatggacgaggtcgcggcagagatcgcgacggaggcagcaagtagcagcatgcatgcatgagcaaatgaagctacgcccaggaaatgcagtagcagcatgcatgcatgagcggctgcggcggggagcggcggctatgcgacgacagcgatgacgacgagagcggcggcgtgacgacggcgatgacgaccgtggcgcgacgacggcgacgacgacggcgactgctggcagaggcagagcggcggcggggggacaagcggctgcgcaaccaccatgcggatcggaatcgggatcgggatacggcggctgcgggatcgggatattttttgtttttttgggttttttttcttttgtttccgtgcggttggtataatttgaccgcacgggataatcgattgttccgtgcgattacgtcgcccgcacgcgaaaatgttgattttcgcagacacctgggtgtagacgggcgctacttctgtatagaaaaatagatttggaccgcacagaaaaatgaatcttgtagtagtacgcgatgggagaagagaaaatgagagaggataaggtagcgcttgggtggaaaattcgtatggagcagaaacattcgacggtgctagatggacccaatgtgtgttcttatttttacgagttcttttgctgatgggggagttcagagcgtgtcttcagggtaaagcgaccacgagggagagagtatgaaacttctctgacaacatctcgtgtacgataagctcctctgttgacgagtgacagatacccccttcgtttcacaatgtaagtcattctaacattttctacatttatatagttgttaatgaatgtagacgtttagattcattaccaactatatgaatgtgagaaatgctagaatgacttacattgtgaaacggaggaagtaccattaatcccggctggaaatcaagagagcatttgtgcaactgggcataggtacgcctaacttaaattcccaaatcttgagttgcagagttgagagcgatcgatgggatcaaatttggttgcagttagcagccgtaattaggcagccaatgcgatggtacaacaaggggaggccctaatgggcgatcaagcgatcatatccgcccccctcccctatactcgatacattcctccctcatctcccccctttctcctccccttattctcttcctactacagtacatcacaaaaaaaatttaaaaaaaataaaaaagttaaaaaatttatgtatagaaatactatatataaaaaatttgaattcaaattcaaatttgaatcgggtatgtaaacttttgacttataaactttgggtctataaagtttaggtgtataaactttagatgtatagaaatactatatatagaaaatatttgaatttaaattcaaatttgaatcggatataattcaaatttaaatttgaatcgggtatgtaaacttttgacttataaactttaggtctataaactttaggtgtataaactttagatgcataaaaatactatatatagaaaatatttgaattcaaattcaaatttgaatcagatataattcaaattctaatttgaattgggtatgtaaacttttgacttataaactttgggtctataaactttagatataaactttagatgtatagaaatactatatataaaaaatattgaattcaaattcaaatttgaatcggatatataaacttttggtctctaactttagatgtgtaactttgggtctctagatgtgtaaatttgaggtgtataaactttaggtgcataaatttactaaaataggaaagtaatgcggtgccaaaaaaaaaggaaaccagtggagagagggaggggggaggggaattgatcgctacccccatcctaggcgatcgatcgccgattaggatttccgacaacaaggtcgatcactacagtttagtcctacctgcagcggatttaatttggaaactactctatcctaatttaatcatccactaaatagaaaacaccaaaatatccatattattgcaaaattaatcatcatcgatcaatgtcctatatccaacagaaattaattcgcactttaaatgttgcatgggttaaaccaacataaattaatcttgattggctacatacatgcagaacattccatgatgaacatttactctctgcacaaataaagaaaaagatattttgtcagatgatattcattttgagaaaacctagataatgatcaaactaggatagatggtgtttttgtactgatgaaactattgatagataagtaactccacttgtccatgacagaactcgcacagtatagacggcatgcatgtagtctcgtagactcgtatacatgcaattgcaagcggacgacactagtatacatctcattcctttttaagcaatatatacttccttcttttctgtatttaacgttgttgactttttttttttgcttgcattgaactattaatcttatttaaacttctttcaaatatatatatatatatatacatatatatatatatatatatatatatatatatatatatatcatgtttaaagggcatgtaatgataatataaatcacaacaatgtaaatgataattatataattaattatgctataagacgaatgatcaaactcatataaaaaataagtggcatcaaacatttaaacataaaccgagggaatacaatatatacatctcagtgtgtttcttgagtgttctcagtggtctctatagtaccagtcacgggtggagaagtggtttactctcctaaaggtctctatagtaccagtcactggtggagaagtggtttacactcttaaagatagatatttttagtctcggttaaaataatcgggactaaagatgatctttcaccaaccgtaactaaagatggtaatgccaggtatctttaaggtgttaccaaccgggactagagttttttttcttttttttcattgttttttttgcttcttgcatctattggtttttgctcccaaattctcaaatctaattgaaatccccaaagtcccaaatcaaattaacatcacagatctaattgacattacagatccaattcataacatcctcaacaacaaaattattcacaaaaacataacaaaaatatacaatggagagggattcacaaaaacatcacgaaaaaaatctgccgccatcaatacctccgcagcccgcctcgtgcatcgcccgctgcccacatcgcccgccgccgcctaatgcctcccctcccatcacatccagtggaggagagggctctgccgctgcctcctctcccacaacggtcgtcgttgcctgccgcccccctcgtgcctcatgggcgcccgccgcccacatcgcccaccgccgcttgacggggctctgccgccgcctcccctcccacaacggtcaccgccgcctgccgcctcccctcctgctagatccggcggaggggacgccggatccgacggagggggcgcccgccacatcccctcccacaacagccgctgccgcccgccaccgccttgtgcgccgcagctgccacctccgagccgccgggccaccgccaactccgagcctcccatcgccgtcgccgggcgcgggggagggagaggcctcgagagatagagctgagagagggagagagagagagagagagagctgtgagaggaaagaaagtgcggtggaaggagagggagcgagagaaaatattgacgcatttggcgagagagagttcgggaatattatagacgcgcagttgatttttttagtcccagttgaacttaccaaccgggaggggtcctgacaccgcctgtcatgttttaaccaggactaaaatgatctttactcccggttgatgttaaaaaagtaccaccggcttttggaccgggactaatgatattctttagtctcaattccttattaaactgggactattatagattttggccaacccaccaaagatggtttctctagtagtgagtaaacattataacaacaagcagtttattgtcttttagaattttaattcaatggatacttagtttttttttttactcacatatcgcccgaccaaaaaatttgataatttagctttttttttctttgcccaattactttaattgacacttgtgaggataagatttgggaacatctgagtgaatgaaagtggatgatatcgaataattgaaaaggagtgttaaattatcaaatctctctccgccgaccagtcagtcaccaccccttcaaccgctgcagtccttctctcccatcttctcccttctgaccaacagcgaggttcatgaattgcagtatatgtcagccaccaattttctgtacccgcaatcgccacgcccaattcgttccaccatcgccgtacgttgtcatcatctctccgctgctgccgatctgctcatccccatcattaactgctgtcattgccttccccaatcgtccctttaaccaccgcccttgtctctcgtcgctcttgatcatctcctgctatatcccctgttcattctcactaccatcatatgatcctctggtcacctcttctttgatccttcttcccacaactgcagggagcatcaagaagaagactctacgctccgaagcgaaatctttcctaagtctgctccttggtttcctgattaagaacggacaacgccgccaacgtctcgagaaatttaggattataccatcacaaaaagaatgatttcactggaatatcattgcttcaaacgggttcgctacaatgccatcctaaactgtggtatgcgttctttttgttaatataaatgtttttgctttattttattttttttctccggaaccaaaatacccctgcctctatctctttctcccaggatatcgcacccgtcgccttccaagagccacgaccgccgtcgttgaccctccttctgtgtcggctccagggccagcgccggtgccgacccacacaaacaaatccagtgagtgccaaatgggcactgagttcagttatagataaatgggagaagctaacttgggggcaccactacttctttgccgtttagtccatggatgttggtactggtcatcgctgtttgggttgagcgggcggcggtggcgcgaatggagtgaaggatggcggcggtgcgggaggagggagaggaggtggagaaggtaggggagggaaggcaccggcgcctacaaggaggaaggggaaatggcggtcgcagcttgaggaagaatggggcggcggcacaaatttagtgagggacgttggaggcgcggggaggagggaggaaaagcgacggtgcgatatccagggagaaagagataggggtgttttggtcttagaaaaaaaataaaattgagcaaaaacatttctgtcaaccaaagagaacgaaaatggcattttggtgaacacctctcagtttaaaatggcattgtagcaaacccgtttgaagtgatggtatttcaacgaaaccactcttttttacaatctccggttgtctatggtacgctgtttaattaagaaggaaggaagctcgttccaaaaggttaaattgtagggttatgaaaatatagtagttctcatcttactatatggtgtccgaaagagacattacatttttttctaccatatattaccaatatatagtcacctcattaatcgaaattgaaggacaggaagaaaaacctttggttttcgcatatgaaccatatatagccttgccctctatttaatgtaataaactatatatgaaccagtggtggacacaactttaaaataaagatgtgacggagaacgaagatgttcactcgataagaacaatcaaacacaacgcatatcgtatttatagtttaatcgcataactgcctcgatcattgcttgcggcatgattgcgttgtgaagagacgaactaatctgttaggcgttacctaattttgatgatccatgactactataagggggtagggtaatcttggaggtgtggagcgacacgggtcgtagctggatcaatcgacccaccctgtataatgggtacgtagatccgccctgtatatatcattggcaaatgaaatctctcaacttcattttaggatgatggcattttgcgaaattcatctcttcggtgagatggcacgatcaatcatatgtactttttcagaactaaaaggtcaggtgtagttcactttaggtagctactcctacctagtatatgtaagttacacagaaagcagaaaaggttctatcctgaaacgcgtgtttgaaattaatttgagacactacagttcgatctaacccccatccaatttaactcttgttcgttcgctatcaaacacagacgaggcacgagagaattgaaatacacacctgctgctgctcattagtccaagtcgatgatcatatatgtctctaacgtctaaagtgcatcctcgatctgcacacggcatctacaaattttttttttcttagggcctgtttggcacagctccagctatacctcttctggagttgctccaccaaaaatagaagtagagctggatggagctctcttacaaaataaactagagaggtggagctgagtttagccagctccacaacctactccaaacccaactcctaaaggtaaatttaggagttggagctcaaccaaacatgtcttaattaatttgtcgatccttctcatctttttcacctaacaagaccgaccgccttaatttttctcgtctagaatcagatgcgatatttgacatatcccgtcatgctagctaaataacctggaggaccccatgattgttgggacgcgtacataatggcgtgtaacatcacttagcctattcggtttggaggagcttcacaggaattctgaagaaattgaactgtattatatgaaaatcctataaaatttctattttctgaaggagcccttatgttatatatactctttttagcttgtcgatcggacatccaacttcatacaacagtttcgaatgcatcgatctgttttatctttaccttttgtaattatgtatttatacaaaataatatactgaattaaatttcaattatcagaataataataaatttttatagtggttattgaaaaataaagttatatattttttcagtaatataagatttatttactgaagttattgaaaaaaaatatttttataatggttgttcaaacaagaggaagaaactatatttttcaatgattggccaaaacccaaaagtaaaggaagatgagatgagagagggcaaggaggaagaagagaaagggactgacagtgagccctcaacaagggtatttcactgtcatttctattttttctaaaagacttacatatgggtttacttttctctttttttttctgactgtagcccatttaatcaccatgtaggcacctcgtcaaatgaagatttgctaattaatgtcccacgcatgacaaaaccgcatcaagcttgaagagcaagatgaatcggttttgagggaggtaacataactttttctccttaatgaaaatattataataaggtttgaaatagggaagaataaaacaagcccgttaatgtggcctatgagcccaacaaacagtcaaatgcttacaagacaaaggaataagttcactttgactccctcaaatataactccaatctaattcaacaccccccccccaactattaaaaccaatacaatttgactcccttagtgattttggagggcgctttcactcgtggcgctttgaattggtccaacctactgagtcatcttatggggcccacccatcactgacccttatctttcttctcttccttctcttttctctcgtaactttcctctccggtggaaacaacagggcacgacggtgatgaggggaagccgtcgtcatgcacatcgctacatgagcttgaacagagacggtggtcaacaacagtggcaacgcgacgacggcctcccctctcaccgacgctagcaagcaggcatgcaaaggtgtcgcgccatgctagtcttctcttctcttctccagttcagcgggcaagcaaccctaaggagggaggcaaagatggcgtgcgtttcacatcccaggaagcgtattgctccctccaaatccaagaccacatcagagaacacctaccagccaccttcgccgctgccgctgcctgagacggagcatgaatatcgatcgccatgtccccgtctacaccgacagcaccttcgatctcttccactttggccacgcccacaccttcgagcaggccaagatgcagtccatcattttatcctcttctcttcctctacctctcttagacagatcaatactacataagtggatccataacttagagtgatccctaaattcgctcgattgtattcaatcgcgggcaccatggatgagcttggcaaaatcggccacgatgggcggcagcagaggggaggtggaggcggtggcgggaaggagggatgagcggcgcgaggaggtagtgcacgatgagacggagtagggtggccgtcggggttgcgacggcaacgtcgctggaggagcaggtctggcagctttccccatgcgcagttgagggtggcagcggaagggaggcgaaggcggtggcgggagggacggcggtgcaacgatggccttccctctcaccaccgccaccatccttactcgtgctccctcctaggggtgggcagaaaaataccaaaccgaaaagactgagaccgagaccgagaaattcggtcctaggcagttaaaggccgaattttgttcggtcaattcggttagtttcctcgggtaaccgaatagaccgaaaagaccgaattaacaaaaaaatgtctaaatgcaacctacaatccactaagttcaataggattaaactctaatgttcacatccctacttcttataggaatgcaacctaataagagtctttactcataattacttatgaattttttttgtgatttttgtattgaaatttccattatttctttgcatatatgaaaatgttgctgaatttcagtcaggaccgagactgaatttatcagtcctgatatttttgtgttgaaattcggtcttcacttttcaaagcccgaaaagaccgaagaccgagaccgaaattttcggtcagaccgaatatccacccctactccctcctccacgacggaggtgagcggaaggggaatgagggggcggcgtcacgatgatggcctcctctcgtcactatcgcgccctgcttcttccgtcggagacgaaagcgagtagaggaaagggaagacagagaagaaagataagggtcactggtaggtgggccccacaggaggactcatcaagttgaaccagtcaaagcaccgtatcagtgaaaccgacctccaaaaccgctgataaagtcaaattatactggttttaatagtttttagggtcaagatatccggtattacggtttagagatataaactaggttggaactatatttgagagagtcaaagtggactcattccgtagagaaaataaggcaggaaactcagtgggccgagagtcatatgggcttgcctccaggtgacaaataaacggaggacaagcaatgaagcaatggttgggagaaaggatgggaaaagcaacgggaggaaatgaaggacatttttttttgttaatttcaaccatactaaaattttgatgatataaaatttagcgaggtaataaactaacatagccttatcgataccatcctatcaaattttaatattttccgaagttttctctcacaaaaactccactaatatttggcaaagcttcaaaccaaacaattcaatgcttccaaaaattggtaatatcaaaatgtgctaaaattacgtagaatttgaccacgaaataaacaagctcaaaatcttgagtcaagtgtagatttctatgctgggcatggatgtactggtgctaaacattgttgcattgctacttaaccagatataaatagtggtaatggttttgagctttctataggctctatggccctttctctatgctagaattttggctcatgtgaattttatattctcatcaccaccagagtaattggcccaggccccaggaggttcttttctttggacatgctataacatatattttaaagagtaaattacacttatggtacaacaacttaatctgtgagcgcattccgatgcaacaacttaaaaattaaatatattggttcaatggcaagatcggtgcatctttgatccaaagggctccacataggaatattttccacgtcactcatccatctcagtaattttgcaaaagcgcctctctcttgttcacattttgtttcttttctcccaacaaatcagtcagcttgaggagttgaggtcgagggtgaggcaaagtggttgcctgcctgacgaatcatcaacgaagtgaggggcgagggagacttggcagtggccggcggaagtgtggctccaactagcaatgtcggcgtggtcaacatacgggtggtaataagccccaatattttagcctacaaaatgtgagggctaggcccaaaacaattggtctaagatttaatagatattttagctaaaactattttaagggctgagattagttatgaaagggcccaggctccctatcccattatcacccctagggcaacgtagtggtgttgcatggagcctacaagcggtcaggaggcgcatgggtggggactagcaggaggccggtggggaggtgccaagtagatagaagcgaccaggtcgctgcgtgcggcatgcctcggtgcctgctttgccaagctagagtccggactatcggagccgaggagctgatcgagtaggcaagctctgaatcttcttttgatttgtgaagtacacattggcccattgggcatgcttacaatataccagaactttacaatttcaattacgcttttagtcggtggcaggtctgtttaagggacaagtggatccttcttatctctcttcctctctctcagcaaacctttccgcttggtccagatgacctcatgttttagctagttggaggcattggtgggcggttcagtggtggcttcatgtctaggcttggcggcatcagatcctgcttagcggcggtcgatgcggtgctaggtctttggtttgtgcaggtattgctggtgtttgatagtggttctgttattttccctgattgtagcctttcaagactgcagtcttgtaattttttcctgctatatcgatttgaaacatcgcacttttttgtgatgttcgtttaaaaaattactctatttggatgattgagattcgcttgtttgtcagatctgaattacagtcagtactaacacacatgatattaatctagaacattacgtgtaaactactgaatttcacctaataatttttttttaagaattagtgttgtttgcctgcagggatcttatatagtgaaagcagcaggttttcttgcacgagaacgtgccttcagaaataaggaaaactagccaaatcctccaaggcatgttcccaagaaaattgacgtccgatatggtgccttctcaaaccaatttcttagattattcttcagataattaatcgaagaaagactctaacactaaccctaacagtgaacaatttatcatctaattaaaataatggaaaagatggtgttcgcgaaaaataaaataatagaaaatagttgaggcattcacaagtaatccttgccttgtgctgtggcctgagactggcacagtggcaggggcgttggtgtctcgcgacgagagggtcgagccaaagtagagatgcggggggccggagacgctgaatccaccggcggcgatggccagatgcgtaagtgcagaggctgccaactgccaagtatcagaggtcgcggacgacagacaaggagacgccgccaatggcagcggacgcgcgttggcgcacggcggctgaggggcagggcctccgtcgccgtcgcggtattgcccgccaccaaaaggacctacggttccctcttaatcggatctgatcggagacccctgctctaaaaaggaggaaacaaaaaaaaatcgacacacctgcagtatattgagtaacttaactttccaacaagttcctcttctagatcacttggttaagctggtaatgttgtgtgcgttaggttgagagctcgagtcctgttttttttgcattgttattttttctcttttaccccatctataaaatatcttataattcctccttttatactacgttgcttttattttttaaagaatatattatattcttccatagaaatgagacatccataagacgtctcaacat

SEQ ID NO: 67781 - DNA, 1738 bp, Oryza sativa
tgatcaattgccggatcaagcagggaagctatccgtgacagaggaggaagttcagaagaatgcagtggttgcagcaaggaggcaacaagatcaatatgtggcagatacttgtgatggtaccgggaaacctccggcttatgagatgattcctgctatcaaggatctatacaagcaaccatcctttggggatgtatcttctgaggagattagtgaagggaatcaaaaaagatcttcggctcagatagagccctagaagctgggaagagttcaacaagctttgctagaatatcaacaaacagagttctagcttggtgtaggtggattcaaggaagtcgcctagagccctgaagagatttcataagacataggtaggaatgggatcggaagctatggaggcaaccggcccaggggccgctggtcaattgacaggacctaagaaggggtcccgtcaggagcaatgagttgtctagcttggaactatcacggtatcgggaacgccatgacagttagtgatctttgtgccttagtgaaagaggcaggttcccaaattgtattcttaagtgaaactagacaaaaggaagaaagagttcgtcgtttgcgtaatagattggggttgagaggttttgtgggggttagtagtgatggcctcggtgggggccttgcattgttttggcatgaatctgttaagatggaaattataggtatgaatgaaagatatatcgatgtgcatgggcgtttgtctttggatgatcctatttggagggtgaccttgtttatggggaacctagagtggaaaatagacaccacatgcggtcattgttaagttctctgaaacaagtgtccaatctcccatggatggtggtgggtgattttaatgaagctctttggcaatttgagcacttttctctgaaaccaaggaatgaatctcagatgcaatccttccaagatgtgctacaaactcgtgatctgcatgatttgggtttttcaagggtgccatacacctgtgataacagaagagaggggagaaacaatgtaagggtacgccctaacagggctttagctgatgaaggatggaggaaaatttttagtaatgctcaagtcctacatctgacatcatccagatcggaccattgcccaatcttggtcaatttatgtcctgaatctattcgccaagagcgcactaagtgcgtgcattatgaaatatactaggagagagaactggctatatcggaaattattaaggactcatgggaaagtgctggagataagagtaccctgggaggcattaagtctgctttgagcaaagtaatgacttctctttgtacctggagcaaaaggaaattcaagaatgtgtcatggaaaatagaaaagatcaggaagaaactcgccttgttgcaggaaagaaatgcagataatatagagatccgtcagacaatggaccaaatgaacacttctgtatcgagaagagatgatgtggttacaacggtctcgcatctcatggctgaaggaaggtgatagaaataccccttttttccacagcaaggctgtttggagagcaaagaaaaataaaattatgaagctccgggatagggagggtactattcatactacgacaaaggagttagaacggatgtcaatagagtatttcaaggagatgtttacagctgaccccaacactgaccactcaaaggttacaaacctaattacagagaaggtgacggtggcaatgaatgaagat

SEQ ID NO: 67782 - DNA, 5839 bp, Oryza sativa
cttggtactaacagcaaactatatgaagatagcaatgggaatttcttaggtttgatagagttctatcaaatggagagcattgcgatagagattggcttgtctattgtaaggaactcagtagagtattttgtttcagttgtaaattatttacaaaaggacatagaaagggtcaattagcgaatgaggggtacaatgataccaatgggaatttcttaggtttgatagagatgttggctgaatttgacccagttatccaagagcatgttcgtcgtattacaagtgaagaaactctacttcattatcttgatccaaagattcagaatgagttgatacacttgcttgcttctgctattaagtctgaaattgtaagtaaaataaagagagcaaagtatttctctgtcattcttgattgtactcctgatgcaagccaccaagaacaaatgtctttaataataagatatgtggattcatcttcatataatatctccatagaagaatcctttctaggatttttagatgtaaatgatacaactggacaaggactttttgatgtgctagagaatgaaataaaatgtcttgatcttgatatagatgatgtgagaggccaaggttatgataatgggtcaaatatgaaaggaaaacatcaaggggtgcaaaagagacttttggatgtaaatcctagagctttctagtctgcttgtggttgccacagccttgatttaacactttgtgatatggccaagacttgtggtagagctaaagacttctttggaatcatccaacgcatttatacaacttttgctaattccactaagaaatggcagattctgaaagataacataacaggattgactctcaagtcagtgtcagctacacgatgggagagctgtgttgaaagtgttaaagttatcagatttcaatgcgctgacattcgagaggctctacttcaggtattttacattgaaatattaataacgatacatttcctctggttgtcctcaaaatttaacttatatttttattttaatttcaggtatctgatgttgataatgatgtaaaaactagcagtgaggctaaaggtttggcaaataatgaacttagagaatatgaatttatagtggcaattgtcatttggtatgaggtactgtatgctattaatttagtaagcaaacatttgcaagcaaaggatatgcttattgatgttgctattgagaaagtgcaagggcttatttctttcttcaaagggtatagagaaactggtttcttacaagcattggaggcagccaaaggaattgcacttgagttggatatcagcacaacatttcgtaaaaagcgagaaattaaaagaaagagacaatttgatgagaacccagatgacacaaatgttgccacacagtccgcggaggaatcatttagaatcaactattttatacctattgttgatcaagctatttcttcgcttacaaggagatttgaacgatatcagcattaccaaaagaattttggtttcttatttactgctgactcattgcgatgattggataatacgagcttgaaatattcctgcgacaatcttgaagcaacgcttaaaagagatgaaaaatctgatattgatgccaatgaactatatacagagttgaggtttctgcaagatttcattccaaaagaaaatatgggtcctcttgaaattcttaagtttctaaagcggcatgattgttttccaaatgcgtctatagcatatagaattttattgaccattcctgtgactgttgcctcagcagagcggagcttttctaagttgaagctattgaagtcatacttgcgttctacaatgacacaagaaagacttaatagtttggctatgatagcacttgagagtggattgctggagaagattaactatgagcatattattgaagattttatttcaaaaaacactaagagaataatgttattcaagtaaagattatgcaaaacaagagttcaaaaggtactattcttggaatatcgcatttactctgccgtacatacattattttagctatatttggtacttgattttggtttcacttagagctttgtacatggcctacaaatttgacggcacggccctagggcgacccggggggagggcgcgacgacgcctgctctggagggcgcaccacgaccgatctgagagtgtgcctcacgccgacggacgccaccgtggccgggcgctgctgcgagggctccgccatggcagccgccgcggccgccgggccaacagccgccgaccagtcccgtggccgggcgcgagggggggacggagacgctgaagccggcgccccgctgaccgggctagagtcagagtcgacggagtcctcgctggagactgacgactcccgcaggtcgcggcccccggaaaaccccgaaaggacggcggcgcggaaatccatctcggaggaggaggaggaagaaacttgcgacatggctgagggtggaggcttagggaccgccgccgccgccggccggcggggtcgggtgaccgccgacgcggggggggaggactcaggactttaccgttctaccaaccagagtggaagtaaccctccatttgtgaatggggagatggggattggattttatataattactaaacgtaaaaagtaaaaaactaatgctaacccaatcgaagcatcctccctcacgcacgtcggcggcagcggcgcgccaccgtacggcagtcgcgagccacggcggcggcggcggcgggcagtgtcgcaatcgcaactcgatcgcaagcagggtgaactgggagagggaaacagagattggggaaagtaccaaccacaggagcgtcaggcggaactcgccgtacgtctggtctcctgccgcgaacaccgcctccctctcgccgccgtcgaggtgaagcagcgggtgcatcgataccacctccctcatcggcgagagctccgccatggcgcgccctctccctcgctggaaaactgagcgcttgactggagaggggaagaggaggaaggcaaaggcgagaagcaaagtccagtctggattttttttattgtaccgttggtttaacgtgggtcgtcgaatggatgagatccaacggtgaaaactccttctagtgcatagcgtgtagtagtagtgtatggcatctatctatctatctattctattctatttttaaaacaactttgaaaggagacaccacgttcactgttggggctagaaattcccacattaatcagagaaaaagaaaaggagagtccaagtaaaaatacaattcaaaaatagctgaaattcggaattaaaaataagcaatattgaaagaagtgtccgtataagaacccaatatgagattaatcaaaattcgaaataaaaataaaataaaatccgaaaatagaaaataaaaagagagtccaagtagaaatataatttaaaaataactgaaatttggaattaaaagtaaggaatattgagaagagtccatataagaacccaatacgatattagttaatattcaaaataaaaaaataaaaaatccaaaattagcaaaaagaaagaaagagttcgagtaggaatacaatttaaaatcaactaaaattcggaattaaaaataagcaatattgaaataagaatccatataagaacacaatacgagattaattaaaattcagaataaaataaaataatatctaaaattagaaaaactaaaagagagttcgagtaggaatacaattttaaaacaactgaaattcaaaatataaaaaataaaaatattaaaagaacactatacggtattaattaaaatttgaaaaaaaaaatctgacattagaaaaagaaaaaatatttcaattaggaatacaatttataaataacaaaaattgatgataaaaaataaaaactattgaaaaaaaagaccatctaaaacacatgacgagataaattaagtaacaggcctataaaagagtaaaatggtggctgtcatggttatggatactacatacctaatagtagttgactaaatctcggtaagacccaccacatatcatgtcctatacggaaacaaccttcggatataggaggagttccgataagaaaagacaaccagagttctacatggaaacgacaaggactactcggattgtatccatattggtttacctagttctacttggacaaggggacacttatgggtataaatacaagccccccttaggaggagaggggcgaatccacagacacccaccagggagaaccaacacaatcaacatacacccaccatgggacacgatcaacacgatcaccacgatcgagacccaccacaatcaacaaccaccacaatatacggaacaacagaagccaatacaagcctacatacgccaagacaagacgccagatatcgacttcagggataggcatagctattcccctacggtgtctccggataccgtcaggagagacgaaagcgctatctctgatctcgccggacacggattcgaggaagaaggctaccctgttgtcgactacgagtcagcccttcagaccgccatgtcgacaacagttagataggctaccccacatattgtactggtgtgattatggtgaataaagagcaacaccggctccggccaacaggatgtagggttattacctgacacttcaggggcccgaacctgtataaaaatccctgtctccgtctcttttacctcagtctcgctatatcctagtaccaacgatccccatactatgcaaataacagaattgcgacatcaaacgtcgacagtggcagttgatacgacatataaaaactgttaataacacacaaaatagaatcctaatgatgattaaaaggagggacgacaagcaggccgtgaagcaaacggacaaggcgattgccgggacttctagaaagtaaaaaaaaaacccattgataatcatattcgatttttaaaatttcaatgacaataaaaaggagaagcagcgtgcggagtatataggagtacagttgtagagccgccgacggttggcgggacttctagaaaataaaaataaataaattccaacaatagttatgtttgatttttagaatcccaatgacaataaagaataggcggcggatggccgtagaggagtacagtggcatcgtttgatgggacttataaaagttataaaaataaaacctaacaagacaataaactctaaaaaatataaggttcaatttttaaaggttcagaacttctaaaaagtaaaaaaaaatgataatcatgttggagtttaaaatctcaatgacaataaaaaggagaggcagcggacaagccataaaggggtacaatggcaaagccactgacggtttggtgggacttatagaaagtaaaaaaatgaacccgaacgataattatgttcgatttataaaatcccaataataataaagggaaaaatacagtggacgggccgtacatgagagtataatggcagcgtttgacgggacttctagaaattataaagaagaaacccaacgagataataaaaacaaaaaactataagatctaatttttaaaagttttaagaagaatgaatagaaatagtggtagaccgagcaatcaaataatgaagaatatgatagaagtaaggagtagtagctgttgtgacttttaaactatataattagaaatacggggatatctatttaataaatcttaagtaaaatcatactgaaaaatatatgattttgtttgggtggtagccacataattgcacgggccacccagctagttcttataaattcacccttagaagagggtgtaatttgtaactgccaataagattacgggctgcagga

SEQ ID NO: 67783 - DNA, 667 bp, Oryza sativa
gcaggttctcctgacgcagctccaggatcttcaggttgttctccaccatgccacgacgcaccatctggtggaagtcgatacgagccgcgtcgtacgcctccaccatgcgtgccagatgcacgacggtagcgtcatcctccgagctggcgtctcggaaggtggcgtggtcgcgggctcctccgcgacgagggtggtagcggtagggcgagtgctgcaactcgtccgggtagcgctggtgaagggtgccgatggcgaggagagcggcgttctggcaagcggcggggaaggagtctccgcccgcggtgactgccagcgaagtccgctcgggagagccggagaggatcactgctgtgacctcccacgcagcgtggggctctgcgtcgtctccctcctgatccggaagcggcctggcctggtaatccactccatgtggataccccaagaccacgcacatgcctcgcagctccaagacgaagccagtcatgtccaaaccacgacgggtaacgctgccggccatctacaaacaaaaacaaaagaaaagcaacattttcgaaggtcagattttgacgataaatgaagcagcaagacaaagagagaatagcgggttttcacaaataataaaggatttttatttttaaaaatatagctaaggcttgggatctacggc

SEQ ID NO: 67784 - DNA, 10701 bp, Oryza sativa
gttgtactcgtgagtaaaattttatactaatatcacactcagcccacgctctccagtacaacgtgtggccaggtggaggggacagctgattgatcgttgtctcctgcaatcgtaattaaattaagttaccctcgtgtcctacaaaaggtcaaggatcttctgtaggagtggctgttactccaaagttgagacatgttttcgaccattgcgtaaaaccatgttcgatcgattggcaccttttcaaacgctgggaaatcttggctccaagcttgtttcattgagtacttcaatttgaccaagatgttaataacattttttagctgaattgtctaaagtttggctagtaaaattgaacatgcaattcacctagaatgacgcaattttatcaaacgtcttacgtcaacgacacacggagtctatacacagtaatgaataaatatttgttacaagtatgacaataaataggtgcctaattaactcgatcgaacctgtctaaccttcagaacattaaggttctatatggacaagtaaaatatattcataagaactcgttgctcaaagttttctaggagaatttttaaaatcaaaacaagccatgtaaataaagtttttttagcaaagttgggcaagccacaatttgtgtggccaacaatttgttagacacacttctggtaagtggaaagaaaacgagactatgataagtggatccaatttcttaaaaatggaacctctcctatcataaaatttgttcagacttttttaaagagaatttctcggtctccatatgcatctttggacaacaaatgtgttttagttgatctattaacgtatttcgatatttaggatgtaatattgtcaacaaaaaaatcatgattcacatgatataatacttcagtcgtttcgaggctttactaattataagcattgcatggtagaaatgattttttttatgtaagtgaatgaaaacaataccttgcggttgcaacacatgactgcttacctcatctccacagaagatcccaactggaacacctggcactggctatttctttttgtaacaatataaagtcaaccggattttggatttttgaagacaagacttaagcatggagcaaagcaacccaagatcttgcttctatggacataaacatatgctcctgccagtaagtttctcctgaacttgtctgcctgttttctggaaaacaaagacggtcatgggttagtttaagacttgaatattctcaaactgctggtacactgttattcttctggaagaaaatacaccaaaccttttattccttttattttccaattcttttttcttctcaccgggatctaaaaaggtctggcctttgctttttttaaaaaaaaaatctacaagatgtggcttttagtactctagtaaataacctagcagcctctgaattggaatgtagccatgttggcgtcgtgtgactgctggacccaaccatcaggcttcagttgtggggcaggacagaaacgaaaatgagtagctttaagcattcagatttgtcctgccctgaaggaatttcagaattcttctcccattaagggcacaaaggatttgttcttttcccaaacaacgcaagcaaaagtggcaaatgaaaacttcaataatattgctggtcaaatcccactctaactaagaaatagcaggcattctgttgttccctcaaaaaagatatatattgttcatcaaacagagagattaagatatggttccagaagggaataactcagtaatcatcaaggagaaaagaaaaacagagcagcaggcatttcctagaagcaaacacaagttgcacggtgcatcttaagtttgctggtttagcaccatcgagcaatataatagtattgtgtcaaattgtagtcttggtccccctaaaacaatcaattcaactctatgctacaacagtaaaggcatccatcattcgatagacacaaggagcagcaaattttcgcatgaaatggacagcgcatttgtcaaaaaggcagtgctcaatttgtagacctcacctagctaaatagcatacatgtaacatcataaacaatgctgaacatggtccaaagagagagcacaaacctatggaaacatccaacttaagacatgtcttcttggctgtacatacattgaaccctatgaagaggctttatcccttgacctactcttttcatagcacaaaccacgtaatctactactacctttatgtgatatgaatggactggagcaaaaacctcaaggtgctcaacccaagtcatcaattttctaattgagaacttcaaagattcccttatcacattatagttttattgactagttaatatttcagtcctcatcgtaggcacaccgatcattcctgtactctaaatcttcctttccccttcttgatgctctttctgtgagaataaatccatgtaaaaagtcctttggacttttaatggctattatttcaatgggctaaggcagagtccaacaaaggaagatcatgctcaagatgctctggatcaagcagatggcgacattagctttgtgtgcctagtgggggataaggaaaagctggaaattagcagcactaacagcatcttagaaggctgggggtgctcataaccacaatctatggatattattagaaggcatcttgtgattgtggcgacttgtgtaattacaaataattaatcaaaggcatgcatcaaaggcagattttggtcagtaactagatacttttttctatttaataaagtaaaacaattttgtaatgaaagggaagcgccatatactgtatcacaagaatcccaaaattcgagttgcttggtcaaaggaaatattgatcaggtttggcttacttgatggccgaggaaacttgaaacaatctggaacaggatctttcaagaaggttacagatgccaagaggataatggtgagacttctactaaaatccttaatttttaatctgccactagaatgatagaatccttcaattaatccgcattactagttagtggactctggtcatggaagatacctcacgtttgcaagctttcattgtctctaacagtgtaagaaggaaccccattgatcacaacgtagcatgtaatttagttgacatttgtcattaacaaataataaaaaagaagacacaaagaaaagctccttaaagtaaaggtaacaggagatcctgaagcctgaaggtacacagtaggtgagcataagtgctagtagagatttctgctactgtcgatgtaccagtgtttaactgaacatatgtgcactaaaataagcaaagaataagtaaaggaggtcacctttaatttggtcctactacatccttcataagtgataattaaattttgatcctttctttggtatagtactttgatttagtataagtgcagaacaaataaatcaataacagccacagatatgttcagcaactgtcaatagaatctaatattttttccaaatgcaatattactaaaaaatttattaaccttgagacatcttctatttgcacctttttcccttatgtcagtactaatggtgttctgctttgcttgaagatgttcagcttctacagagagtaacaacgatgtcagatgaatagaactttgtactttgtaggataagaatgacataagactcatctaatacacccatgaatccaaaagcgaatcttacatgacaaaaaaaatctaatttaaaaatctaagaaaaatggactttcagagactttctatagtttctagtaggttcaacttaggaatttaacagatagagaagttctcttgacacattttcgattctttagtcactgatttctttgatttacgatggcagcaacagcatagtatatgtcccgctcctgaattcctgatgtagattttgcatcatggtgatcaaattaacatattgtcaccgatatcaagtgaatatttgacataaataagaacatggcgtttaaatgaatcatttatgaactatgacatttcttagtccaaaatcaggccaaattgattgcaactatgaattgtaactaaaaaacggtcgactcttcatatgtctatcagacaattacttccccttgtttaacatcacatagcactagatcaactgatagattgcccttttcgtagctgactgaaccaactaaatccatggttgattagtggttctcatccagttgaagtacaagtttttggtggagcacaagttgacaataaccaagaaaagctactaacattggatttttcatgcgcacacgccacagcccattttcaggttgatgcccccagccactatcatcttctcaaaagaacaacagctacgatgctggaaactttgtccaaaagaaagcatgaaaggaaattaaagcatgctttctttgacagtttgaccctgataagttcatggtcccctttgactacaaagagctacacaaaacaatcaaagtcacgtccaaaagcaacacgcaacgatgcctgatgccgtgctatctaaacaaacacaatctgcacgggctatgaattcatacatgcaaccaccgaagaacaactacctgaagtgctcggtccaaggccaattttgactgtacttgacagaaaccaaatttatacacaacaaacaagcaagcaaaaatgttgtcactcaccaaccttagttcttcctgtttgtcatttattctcctatgactcccatctaaaatgcagcactaccatagcaacattccattctcagaataggatcacacacaaggtgacagaacacctggtttttttagagagtacatagacaaaatgtcgtgcaagagcagcagtatgtgcacataattccacgagatttgttccttccgatacacatttttacttctttctagcccaaaaaaaagtaatgggaaaaacgaagataaattttattcaggcaagcaccgcttgggattaaacttttactactaataaattctcgcgatctaaaaacatatcattcttctattcaatgaaattggcggcctcgtcgattcgtcaaaaaaaaacatctcatccgattgaaataataaggggtggattagtttctgggatgatgatcggagagaactgaaaatttttttttggaacaattacacgaacacagcatgatcgaactatgcacgtacgaggagcgaggattggggccatacctaagacggatgcgcctcgccgagcccgcgccttcagcgcggcgggaggagcgatcccgatccagccatcggatcgcgaactccccggcggcggaggcggaggcggaggttttcccggcggcaaaacagagggcggcgcggaggggcactgtgcggcggacaggtgggtcccacacgatgagcgtgaaccgatggttgtgttgtgttttgggccttgttctatggtggcattggaataagttcactttgggtccctctatttgtcgctcagtccgattttcatcctgaaccacgaaaacgggtatgacccgtcccccaacttacgaaaaccggacaggtccctcggcagtatagagggcggttttggccgacgcgacgcctatgtgactaatttgactcagtcttcatctgacgtggcattgacatggcaattcgatgtagaaaaatattaatccacatgggacccacatgttagtttaacgcacaaattaataaaaatgatggggcccacgtaggccccacatgtcattctcacccttctcttcttcctcctccctccctctccacggcgtcacaaggaggtccggcagtggtggccgacgacgcgacaacgacgacacgggagaaggctgggtgtcggcggcgggagcgctggggggaggggctccgcgtggggggcgccgcccgcccctagaagctactcctcgtcttcgtccgcggcgccggcgcagaccccgcgcggagttcagagccgtgcacgtgggcggaggggtgcagcagtagttcggcgccacgcggtggcgccagagatgtcgccactcgccggcgggaggcagcggcgggcggatctccatggcagaagcggcatcgcccatcaacagccggctcgccgcgggccgtcggcggcggcgccgccatggctaaattctcgtcggcgaaatgctgcatgaaatctcggcggccaccagaagcaacctggtgattttggttagctctgttaattaattaccggctaaataaacacatacttttccacttttttccttaaccatcgttcacgagcacggtgacagcccggccacctcagcctaccaccaacggcctcggcggaggagcgcacctcgcctccgcacgccggctgccgggctcttcgcaccggcgcggactccagcgtcatcagagcagctcactgaatgggcgcggagctgcgcgaagggggagcaggcaggcggtgaggtcgtggcgatggtggagggcctctccgccccgctcgtcgcccgctccgccggccggtcgctccggccgccgcccgccacggaggaagacggagaggagagcaacaatgacgatggggagcagtgggggatagagagaaggagagagacgatagagagagggggatagagataaggggtagtgaagatgacaggcggggtccacgtgggccccaccaattttctattattgtgggtgtgaaactgacatgtgggtcccataggatttattattttttgattgaattgccacgtaatcaccacgtcaatgccacgtcagataaagaccgagtcaaattagccacgtaggcgccacctcagctaaaaccggggtcaaatactgccgagagaccttatttaaacggtttcgtaagttggaggacctgtcgtacccggttttgcgatcaagggacgaaaatcggactgggcgacaaatagagggacccaaagtgaacttattccggtggcatttgtgatagcccaggtttgggcttatgtggcccatttgttctttcacggattaaaccacatctaattttccaaaaaaagaaaaggaaaaaatataatcaccgtcaaatttgaagattgttgaaaaaaatcacgttgtttttaaatgcaatagataacatcccggcctttactcaaaggagctacaactttaaaaaaaatagctatatttatggcgccatatttttcactaaaaattagtcaacatgtatttacattgtaaatctctaaattacatatgtaattttagtgtgtttatagtgtaaatatcaaaattacatatgtaaatatcaaaattacatatgtaattagtatgtaattaccgtgtaaatatgatgtaactaacatgtatgctaatcaccgatactcaaatttgtttatatttactcctactagtaacatgcccgtgctaatgctacgctactattaaataggtcgttcctgtttacgctaatcaccgacagcctacgcacgtactactgctacacgaatctcaatggcatcaatggtctagaatccgactgagatgaggaacaaaatatggcgcaacatgtttagcaaatccgtaaaaaaaatcacgtggatgacttcctaattcctacccaccgaacttcgattacgttatatgtttcgtaaaaacaaattagcgttgtagtactatttgaatttatttaattttttatctcgaggcatgtacttcatttgtagtcacacgtaaagcgtgcaggcgtcctctcccgccgccgcatatgccggcgccgcgtgttacgcgtgacggcgcggccgccggcgcacggtaaaaccggtgatcaaaccagtggaatcgtggacgcgcgcgccagctgcacgcacgcacgccagcgagctagcgctcgccgccgaaatgcacgcgccctcgaacaccaacggcgccgtcgtcttcctcgccgccgccgtctcattcctcctcctgctgctgctcggctcgatccggcatgctcgagcgcagcaagaaaccgggtagctttcactctccatcgatcgatcgcttttatattacatgttgcagcagctaagtactagctaattggtgattgaatttgaatactgctcgatcgattgatcgttgcgggcagacgacgagatggagttcagctaccgtcgcggcgacgacgacgggccggagcggtgggggcacatcaggcgggattgggccgcctgctccttcggcttcggccgccgccaatcccccatccgcctctccgcggccgccgccatcgccgccggcggccgcggcggctacgaccgccgccgcctccctcgtcaaccgcggccacgacatcatggtgaggttcgacggcgacgccggcggggtggtggtcgacggcgagacgtacgcgctgcggcagatgcactggcactccccgagcgagcacgccgtcgacggccgccggtacgacctggagctgcacatgctgcaccagagcgagacacgcgacggccgctacgccgtcgtcgcccagctgttcgacatcggccaccgccgcgacgccaccctggacatggtgatcaccctctgttccacatcttctactatctacacgtaggcagggttggaaatttcggacgtcggtcatttcggtcccctccgatacgatattacttcgacggaaatttttcaattttgtcatgaattttggtcatatttgttcaaactcaactaaattttgttcaaaatttcggaccaaaatttccaaaatttcaggatttcggtgacctccgacacgatcggcctaaccgataaagtgaaccctgcacgtaggtcccgttcttttctccaacaagagttgaatgaacattaagattttcgtgacacgcttttcaaactgctaatcgacgcgttttgtgcaaaaattttctatacgacagttgctctaaaatatcatattaatctattttccaagtttgtaaactcaatcaattatacgttaataccacctcgttttgcgtaaaaaacttaatcttcatcttcaggagaaaagaacaccgccgtagaggaagactacgaaaaagtatacagttgtaacggaatagcaaatatataccaatctggtacctttaataccaaatatgatacaccgtataggtatgatgacatcagcatgatacgtaagtagcggatctgagcatgattttactaagtatcatgttgatgttagcatgatactataggtatcagaatctatatcatgttgacgttagctatttcgctataatagtatatcgttctatagtatttctactacacgtaacattgtaacatgtgatcgatgtctgcaatgtactacctccatattttaatgtatgacgccattgacttttttgtctaacgtttgacaatttgtcttatttaaaaaaaattatgtaattatcatttattttaatgtgacttgatttatcattaaatgttctttaagcatgatataaatatttttatatttgcacaaaaaaatttgaataaaacaaatggtcaaacattggtcgaaaagtcaacggcgtcgtatattaaaatacggagggagtagctggagccatacatcaagagggtggccaaaaggaggaaggggcacgaggtggagatcgacgacgacgtggatccgaggtggccggtgaagggaagcggcgtttactacaggtacacgggccgttccggcctgtcacgttttgtaactaaagctctatttttttttaatatattaacgtgtaatatttttttacgtgttaaaaaaaatctacaggtacacgggctccttcaccacgccgccctgcaccgaggggatcacttggactgtgtccacgaaggcaagccacacacatcacagatcagatcattaatttctttcgtgagttagtcgtctgatggcgcaagcaattgcgagcgtatatgcaggtgcggcgcgtgtcgcggcagcagatggagctcctctgcgagaagtcgtccacgatgtaagtaaagcgagtgcagtgcagtgcattgacgtgtgccacgatcgaacgacaattttgcgcttggctttgtcgtgagtaaaaacgtttgttggtttgcttaattgcagggtgacactggaaggcaaagtaacacgaactcatcgaagacggcttgtcaaattttcatgtttatagcataatagtaatgcatgacagatgtgtgacaaatttcaccttgatcaaaattaacagaatcaaaaaacatgctaaaagcaagtcatcagatgacacactacgggataaacaagctgcgacatagtactaggattttgaaacatgaatcggttaacctagctaactagctggaaaatccatggatcgagattgattgattgatttgattattagtattgcctagtcgaggcgacggaggatgccatcgttgccgacgccgcgcttgctctctccgtagtcctccggcctgaggacggacaagtctatctcgtgggcatggtcgcgggcgaacgccgcctcctcctccggcgtcggcaagcgcatgttgaacctggcgtagctctcggccctcgtcgccgccacccacgcggcgagctccctctcctcgcgcagctcctcctcctccctcttctcccgctccctcatctcgccaagcatcctgaacacgctcgccacggccccgatccagtccgacgggtcctcctctgccgccgccgtctccggctccttcctcttcgccgccatgg

SEQ ID NO: 67785 - DNA, 725 bp, Oryza sativa
ttcaaaagtacaaaatttgtgacctcgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaagagttgcgtacgatgtcctttgccataggatttgggactgcccctttttatgcccagattcctcatgatcgtcacgaagagaagtgccgagtcaaagtcaccttgaacagtaatagtgaagatatcccctcagtgatgttcgaagctggaggaagaaactacatccatacatgtcaggaggtggcaaggatcgccataggggagctccgcgatcgctacagtgatcagttggccgacactgagtatcgctaccatcctcgtcaaccactgggaagtgaccgtggcagctaccttgagactaagggaattaagaatgatgctaccacaaggcatttggttaagatgctgtgggtatggatgaaacccgtgcggagactgtgttagcggctcaagatcgtgaagaccggaatcgtggcaagatttgcaagttagaggacaaagtggatcgtttggagaaggaactagctgcattgaagggagaagcaccaccgcagaagg

SEQ ID NO: 67786 - DNA, 18936 bp, Oryza sativa
  unsure (1)..(18936): unsure at all n locations
atactccatacactcctccctcatcctcctccttttcttctcttcttactacagtacaccacacaaatttttttaaaaaaaccaaaagttagaaaaaaattatgtatagaaatactatatataaaaaatttaaattcaaattcaaatttgaatcgggtatgtaaacttttgacttataaattttaggtgtataaactttagatgcataaaaatactatatatagaaaatatttgaattcaaattcaaatttgaataagatataattcaaattcaaatttgaatcgggtatgtaaacttttgacttataaactttggttctataaactttaggtgtataaactttagatgtatagaaatactatatataaaaaaattgaattcaaattcaaatttgaatcggatatataaacttttgacttataaacttttggtctctaaactttagatgtgtaaacttgaggtgtataaactttatgtgtataaatttactaaaatagtaaagtaatgcggtgcaaaaaaagaaaccaggtagagagagagagggagagggggattgatcgctacccccggtcccgggcgatcgatcgccgattaggattttcgagtccaagttctagtacgtggagtagttacgtggcaggagatggaaacaggtctcatgagaggagaattcttgagcacagagacatttacccccagattacaccacagaagccatcgttacgccattctcccttggctcagttggtcagggtaactgcaaaacagtaggcaaattctcagaaaataatcaaggcacgcaaactctgtttcattccctccaaattcacataagaatgcgcattgacatacccagcttcttgtacatctcttcctctttaagcaccaccttccgcaactcatgcgctgcgtattgcatacggcgaaaatgaaactgcaccgatttcttcagggtctccatcctggccagcgccaccctcatttcctctccaccagccgccataccttccatggcatcctgaagttggttctcaaaccttaggcgaaggtaatgagcactgtgctcttcatcgagttcatttagatccatccttttgtaggccagggcttttaggctctacacaaatcagggcaattagtcaatttatcattccgcataaatgaatagatatctaatagaggacacaagagaggatgcatctcaaacattattaatatacagacagaacaaagcaaagagtagttcaaagagccctataacttaagttctgggtaactattccctcttagctcagatcatactgagaaatgaaggtttatcttggtccatcacagtccatacaataagtttaaattgaacatgggtgcaattgcagagcatggattaacataccagaaagaagatactacctccatcagtttaaatggaacatggatgcaactgcagagcatggattaacatactagaaagaagatactacctccatcccataatatacgggatctgcattgccaaaatcccttatatcctggggaggtagtattacagtggaggataacattattggacgatctttggaggcagtacagttcttcctagcaaacaacactgaccacttgagtatttcaattcagcatttatttgcttttttcccaagaataaaggggcaataagcctgtagcattttcacccaataagtttgatgcacagttttgcccgaattgtggcacaagttctagctaatcgccttgcccctagattaaatgagttggtgtcaatgaatcaaattatcttcattcataagagattgattcatgaaaatttcctttatgttcaaaacataatcctactcctctcaagaaaaaaggactcattcactcttctttaaactggatatttcaaaagcttttgaaaatgtattgctggccttatttgctggaggttctacaggttttgatataaaatggaggaactgggagtccaacactccaaccacctagccatgttcacttctagagttttgcctacagtaccaggagatgatatcgtgcatgcaaggggtctgcagaaggtttttgaggtggcaaaagaaatttatttactctctcggtctctcctcttaccaaaacatagcccgtttcagatgatcgctttacacagatgatgatgttcacttcactaaacacaacctaaaggatctagaagtaattggtagcattctatggctgttgctgcagcaaaagacccatgcagctgagaactcgctgaggcgacactggcctcataaccagatttgcagcctttgcaatgaagcttttgacgagatacatgccatttggccaaagaacatctacatatgaaatctggaacaaggtttgtcggatgagattctaaacataccttcacaagcaatttgttagtataggatgaacaggaggagcacaattgcacaactacacatcgattagtttagaacaacacatggaggaggaggaggagcacatagattagtttagaacaacacgaggaggaggagaagggcatgagaggaacttaccatggtgacgaagaggaaggggaacccggcgtacgcctggtcggcgagagcggcgaacttggggtcctcgtcggcgacgtacaccacggtggggacgtcgatcagctccctcaagggagagaggggctcgggggagggaggcgctccgagctccacggggtccgccatggcggatggcggcggctcgatccgcgcttcgccggagagcggcgcggcgatcggcgaggcgaggaagagctcggggtcgcgagacgcggagatggggatgggaggcgagagaacaaaaaaaaatgcagcgtaatctgaatgggttcttcctcgcagatgcttgaagcactcctccttcctgataaaccataatctgagatttgaggcttgcttccatatttatttgagatcacaaattctatgaccaaattctactccctagaatataaatcttcttctttctcaagagagtagatttgggctgttcgagagctccaaaggttgaagaagagctacaggggaccaggagggagatgagtgtgggtcccaccgttggtaccacctcataataaagtagcggaaacgatttctgaccgaacgatctagagagaaacagcatctgagccgttcatcggatttatctgagattctccggagcgtgtgggaccggaggacaaaaggtgggtcacgagagctcagcctgccaactgttgcgtgtcagcctgcgaactcttcgtctccatctccggctcccgcaaccgctcattccgatcagaaaatttaacaaattaattaaaatccttttgaacccttaaatttttgtttctaactagagtatgcagatgatttttttaaaaaaaaaagcttaatttgtcgaattttaagcaatccagttggcttttccttaagtacccgacgctgtagaggaagctgaatgcgaagaggtgcaactggacccaaggggaagaaagtccgggcgaagagtcatgggcctcatggctcagtccaagcaaagggaaaggatttcgtatatctttatggctgaggttggtaaacaaatttaggactaagttaaaagcaaacgtctatacaaatttagaatatagctaagcaccacaggtccatgaagtaattatgtcaagtttgcaaatgtacacacttttggccttagctcatcacaaccaacaacctaatgggtaagcacacagatgaataatggctacattgtttttgatatgctaatcatctgcttctacatatgaaccatgggccataacctacattattgatgatctactgcacaggataaggccaccgtcgccaattctttccttttgcctccatcgctccaagagaagatcgtggctcctccgcaaatgcatgtagtcatcgatgtgaaatgacgatctttgagtgttatcggggcagctgcttcggcgagacgcagcctcctcgaaccttgtcagaagtgtatccttggagccagctgcgctatcatgatctccaggactccaactcccgcggctgctcatagtgcgactgctggtgctgcatgcggtacttgctccctgaaatggtcagttaatcaggcaccacaatgcgatggtatgttgataacaattactaacaaagatgttatatgtagaaaacacataacagagagcatttttttctcaaaatattggcattctacttactgcagttaaaaatgtgttgttaaacaatttcgcagaatatcaataacgacatacaaataagtacaacaagcacaacttagcatagagagaacagagatggttatcgtcacctgtgtctttggtttgcatggagaggtttgaaggtcgttgcttgtttcccattgcagccagggaaggacaaccccgtctgcctcgacgggtgaagcaacttttggaagcgttattggagtttcgatcttggtgttttgtaccacatctcttctgcttgaacttgtatcacttctttctccatcaaaagatgaaaaatcagtatcttcaacatttgacaggaaatcttcgaagtattgctcagcctcttcagtaagacgtcttgacaccctggctctatcattgcttctctggaatatatatacataaagtctgaattcgcagattctcaataacaaaggaagaagtagcaatacagtgaagaaaacttactcttctatatcgtggttgcctttccgaattcatattcttcttaggagtaggtagcaattccttgactatttttgtgagttcatgcccacgttgttcttccgctgccaattgagctaacaattcctgtttccgcatctctgactgaaaaatacattggataaagcaataaagcatattaaatagaaatatgattccttaaaagagaacaagaaaaaaacactcatctactgaatattacctcttccaacttgctagtgtaactcctgcggagctcattaataacctgagttggttgtgcatcagcgcttgttgctttttctgaaggttcagattttgtcacgacctagagaaatgcaatcgaaggcaagatgcatgtaatcatactgtcatttacaatctatgtcaaaacatggcaaaggatttcaaaagtcaactattttagagtcaaaataatgaactagaaaaaatagcttacaactgtgcattgtgcacaggatattaacattttaagtgctataacttttttctaaaaggtttagttccgaacataggcaccaagagaaaattatcacagaccaaggaaactaatcaaaggaatatacggtgaatgtcattaggaacttttgctgctcataagttaccttttcaagctgagtcctgatttcatcaacagcttgccggacttctttacgcatcacgtcatacagtgcattttcatcctcattattactcaggcggtcctatcaaatgccataagcatataaaagggatatctgatatattctagttctaaaaatttaaaagaatatagtgagatcaaccttttcaagggtataaactgcccgaatccccttctgatttctgctatgaaaagagtcccgaaattcatcatcagttattgaagaatggctctgcaaaaatcaaggttaagatgagctcacaatgacacatggaagagccagaacttttatgcacgaaccaatggatggcactaaggcacaagatagcgcaaaaattttaatggtgtacagcactcaactctttcttgtgattttaatcaaattacttaaaattagaattagatgtggcttgacaactcgtgctcaggccaagcaactgacggcactaaagcacagggtaaggcaaaaggtttaatgatatacagcagtcaactctttcttgtgatttaatgaaaattacttcaaattggatgaggcttgatgattcatgctaaagtcactgtggttctctgctctagcaatggagttatggaggcataggtttagggtctgggctcaccaaattacggtttggggcatataaggcagcaagggaggtgatggcccagggatgcaagtgagtaatgcagtcactcccagtcccagatatcattaagcaccaagcaacaggttgcactgtggcacaaacagctacattatgcactatggtttgcatcacatggaacatgtcacaattatattgctattttcacatgcaaggggaaccacccaaataactattccattttctgcatccttagaaagcagaatttcttaagtcatcacaatagcagcaggcaaaagaataatatgtgatgtactcactgagctgctgtctcgtgaatgtaagaaatctttttgacttgtagacttcctcaacgattgatttactttagccgtcttatggaatgatgagttctgcaggctattattgctggatttggtatttattcccctagaaccataccggtgagaaatgtccatatcattctgcagtcataaacataaagcacagatttaaacagaagtagaattgcacatactagacaactagtagcaatgaagtgaaggcatataagttacacgatagcaaacaaaaggaaatacgaaatctaggatgccaaaccttaaaaacaaaggtactagtgggattcacagaccactgcaaagcaaaaataaggaaatagttcacctaattttctgatgaagattaaagataatgtggtaccataaatattaaatggtacattggctaacattatatataagtgaacaattacaatcatctatttatgcatccaagcactcccatactgttgggtaaaatcatgatgtgttgaagctatagatagcattacatttatgatagttattattgaataaacaaataatcaaatatgatagctattgaatgcaagctgatgaggtaaaactacctatggtcatcaagatcaatgttccagttgaaaagcagaaaagcaggtccatttgtgcttttgaggacaagaatactaccccatcacagacaatgcgatataagatcctcttgtcgattacggcagtctactatggtgtgtgtagcaagaaacaagtgatctaacacatttttatacagtcaagcaaatatcgcatagataacaaacatcatccaggaccaacaaactgaacggatacgtgtcatacaaaaacatatgaaagcattgtgtatatttttgttgtattacctagttgcttgattttattattcttataatctcaactcaacacatccataaattgaactaattcacgtttcatgaacaagcatgaataataccatataaacttagcaaccagtagaggtacatgaattacaggcatgaagcatgtatcaaatttccaaacagattttaaacatagcacaatgaacaattaaacaagtctaatatcgttaaatagaatcgtagcgagattttgcattcattgctaatacaaatttatttctaaaatgcccgataggactaactaaaaaatttatgacaatatatgacagcaaatccaaagcatatcacacgcaatccgctaatcccaatgaaattaactcggcataatgcaatcaactcctatacaaaaccgaacaccactattattattattacaactaaaaattgcgagttagattgtgaaatgctggtcacacttacatccgaatcacaccatcggtgccgatccatcgaagcgcgccggtcgacggatgcataccgctgccgccccgcggcagcagccccgccattggcgacagcagtggctccgcctcgcctctcggccggcggccgcgacaccgacctcccgcgctgccgcgacgactccgtctccctggcgtaccgcgcggtggagctccgccgaccgccgcccttctccgctggcgccgggaacctgagccgcccacgcgactcctccccgcgcacgaccaccaccgcctcctcgtcgtcgtcgtcgtcctcggactccgccctggcccggaagaactcgtcggcgaggtcatcgaggctgatctccggcggcaaccccgctccgccccggccgccgcccctgaccttgttgacgaacctcgaggagggcgtggccgcgtcctccggggagggcgatggcggcgggaacctactcaggctcctcgaccgccggagcagcccgccgcttcccccggcggccgcggcccgcccgcgcgtggtggcggagccggcgtcctccgccgccgccgcgaaggcgtccctcctcctccccgccgaccggtacgcccccaccgccgccgccgccatcgccgccggcgaccggagcagagagcagctagggttgcactaatcccctcacctctccaccggataagagacggaaatggcgatggcaactaaaaccttcttcgagtggaccgaacaaaattaattaaaaccaaattaattaattcgttttgaattagtatactaccattagtagtagtaacagttaaattcgttcgactttaaacccgggcccacctgtaggtgaggcggatggaggcgggtaagagtcaggcgggtgtcgtgggttgaaacggtgggcggattggggaaattttgaatttaaaaaaaagtgcgccaggttttgaggggaatttacgagattcgacgcctgacacgttgagctgacacgattttgaatttgtagtacaatttggcaacgggtccaaggctgtgtttagttcagcgcaaagtttagattttggttgaaattaaagataatgtgtctaaaaagttgtgtgtgtatgacaggttgatgtgatggaaaaggactgaagtttggatccaaactttagatctaaacacagcccaagagcatttactagaattacagtgacggagtttgaaattggagctgctgctaataatgtggaggagtattatatcgaaatcatgaatgatcattctgaattttgtttgcgtctttgacaggttcggttggtacaggacaatacgcgtgcaggtacaggaggtggccaaacgcggccacgtgacaggggaactactgtgtctcgtgtctcgtctcgtctcgccgctcgcccgtgacgccacaggccaaaggaggagagccgtcacgatcgcgaggcgtacgtgcgcgtggcggtctccgtcgccgactcgccggcgttgggcctcctcgtcggtgtcatcgtgtactccgccgcggcgccgacaaggtgggcaggcagaacggtcgtattgcttcggtgggaaacggatgggctgcaaaaaactagcgggaaagtttgaaatttgaagggtagaaaaaggagctccacccaatgatgtggggggatggggttgcggtgcgaagaattcagatgagtttgcgcatggccgcggtatttttctggttcgggctctaggcaatagttgtagaaaatgcatagccacttgatctcctaagtgggtgggttcactaggatcccgcacttgggaatccaaacgtgtttgacagctataatgaagaagccggcgacgtcgaccacaggagacgagagagagagaagccatcggcggcggttgcaggtggcgagaggggaagaagtcgggtggcagctgtggcaacaacacttgggcaacgacgacatgccctcgcacatttgaggaggtgatgagcgcatggtggccctcctcgacggtggatctgcgtgcacgcaaggcgggctcttgcgcgtgacatcggatccactcctcgccgtcctcgtcctcttcaataaccatgcaccaccgagcctcccttcatccctcgcttctccctcactgtcataccccccccctccgccgcctcattgtgcgccttcctccgccgttggtgccgccgccgaccaccttgagtggtcgaccacaggaactggatacgaaggaggaagacgacaggtagtcaaggagtcgaatctccccgcacggtcacgtctcaatcttgaccttcaccgtgccattagatagacctccgtaggagctggccattggtgctagcgtgggatcgaccttcgtgggagctaaccgctagacatggcgctagccgtgatgaaagagctagagccgaagctagcaaggggagggcacgcggacgtgaggagggcgaacgacttcgaccatcggcagagaggagagggaagcgaagaaagagatgaaggtgggacccacagtgggcccaccattttggccagttgaggtgctcatttggccagctatataggttggcagtccaagtagcaaggctgttagagggagtttttttgctatgcattggctaaaattttgttgggagagtcatttgccaatgttgttggggatgaggggcttattcgaaatatgggataggaaaagcataggaacatgaaaaaaaaacaataatatgataggattgtaggtgtgaaatagaggattagaaaatatagaaaaacgggtaaagctatcattcggatagtgcaaaggaaaacatagaaactttgattcattactagactagaagtagtaacgtgataaacgtattatgtaatttacaatacccgtggttccgccaggacgtgagctggctgccgacgccaacctcgtcttctctttcctagagaagagcgagagagagaaggaagggagagaagaggggaaacatagagtgatgacgtggccaccttgacatgtgaggtccacgtgggccccacgctaaaggacctagtttgtactagttttgtaagttgggagatgcgttatatccgattttacggttcaaagacgattctgtaactcaatgacaagttgagagaccttcggtgtgccttttccatttgtttttctgctatttcaaccaatgcgttccatcaaacaatttagttggaccaaggcccaagaggccttccaacttacgtggagtaaattcccttaactttaggtggagtctgtctgaggtccctaatccacaataccaaaaatctctacccattaactatcacaaatcgtgaaaaaaaaaattccgagcagtatcaacttaattttcctctggtttcactgacggggcatacggtgggccccacatgtgaggagaaaaaaatgggtctgcatctcttcttttctcttttcttccttctcttttctgaaaaaaaatagaaataaaatttttcgcacgacacataaaaatttcccaaaccttccctttcaaatgggccctaatcacccccattacttcccaaacacgtctttgctgtgatcagacgtctcatccaaccccatcatattggcattaacaaactggacctggtttttcttttgatgaatggccatgtcactcaggagcaggagcagcagttggtggcccgatcaagccgacggatgaggacaaccacggctatggtgagttgtgattcaaattcatttgcacttaataaaggccagcttctgctatccgggggtgcgggggcggagccccagcggtatggatcgtcatcccttttagggttccaccatatatatacatcttgtaagccgccatgcggcgatgtaacctcacctcagatatagtgaagatattttgctagctggcgcccgtggttttcttctctcctgttttgggagggttttccacgttaaatctcgtgtcttctgtgattgatatattgttttttatcgtttgttcgcctatcgtttcctaacagtctactgtctactgaacccaacagtcaggctctcaaaaaaaaaacagtcaagctcacacacactcagggtgtgtgtttatagatccagatgtaaagttttaacatgtcatattgggtattatatagggtgtcacataagatgtttgggcactaatagaaaaactaattatataatccgtcagtaaacagcgaaacaaatttaatatatttaattagttataatatgtataattagttatttttagcctatatttaatattttatacagatattcaaatattcattgtgataccatgtaaaatttttatgtggcaagtaaccagggcctcacactcacaatggaccgcctcctttactgcggctttgtccggtgcgcggccaaaaaaccctgacgagtcgtccaccgaagaagaaaagtccaaagtccaaaacaataatcacgtcgccaccggaaatgaccaaactggcccccgtattgtggtcgatgacatgcgggccccacggagagcatctccggtgagatggacaggctagcagcagcagcggtggtggtacgaggcgctgcctttcgatgtggggcccacgtggcgggtgaatattcggggctttcaggtttcgcacacatctttttctttttcatttttttggcggcctggtggatataccgagctgtccttctcttgattcagaatttcgctggtatagccctgggtagatgtgagttttttcaaacagctccttctcaaaaggtcagcgcctaacatttgattttgaagttcatatctcactgccttggtttgaagttcatatctccagtttttctcagcaaaggttatgtggatcgtcataattttagcagcacactttgttaacttcataaattatgtatcgagacaaacaccaggatttatttcattatcaagaaaaataaaatatatataagttaaggcttcgacttcttttaatataattatgttatcatagtacagtcgtgtcaagcaatattttataaattagctaacagctggatatcataactttacgagtcatatatgtcttcaaaaatatgtgaacgatgtcatacgtgtttcttttaaaatgcttcgtcatgcctagtaagaatgtttatattatgtttatatgctttaagcctttcaacatatctttaaaaaagacctttcaacaaacgggtagaagtatttgttgggcaactaagacaatgattacattgatgatgaactataagtcatgttatatgccaaaaatcattataaacaaaaccatacaatgtcccgtcatatgagatttacaagtcacacaaacatttacgatcccacgatataatgcgaaggcatacaaatgcacaaaacaccacgatttcaaaacccacacaaccgtcacatatgtgaagtattcggtaacttagattaaatgatggcctatgttggatgacgaactatatgatgttatcaactagaaatcatcataaataaaaccacattatgtccaaccatatgagattcacacgccacaacaaatcccacaatacaatacaaaagcatatggatacacaaaacaccacggttttcaaaacccttgcaaccgtcacccgtgtctaagaccctgtttggttccatgggctaatgtttagccctcaccttttagcctcaaattagccctcaaggatccaaacaggtgggctaattttgagctaatgtgaattagcccccctcaaaacattagcctttccaaggggtgctaatggggctaattttgtgtggggaccatcaaaaaacagctctctctctctccttctctctcctctctttctactctctctatacctttaagccttgaattagcccatggatcaaaacataccaccctagactaatgtttagcctaccaattcatgactaaacattagctttcaaaattagccctgtgctaatcttccaaacagggcctaattactcctaccctggtaaaccacgtccccaactcccaaggacccatccgtgcacagtccacaaaataaaaaacattccgaggactaaactacaaaaacgcaaagcaaacaaaatcgaaaaaatcccccccataaaaccgattttattccccttattacacatctcatccgcctcattaacgttctcatttccactctcctcctcctccacctcccccctcgcctcgatccccgcggccaccgcgcctctcctcccgctgccgccggcgggcgccgcggccctcgcccccgccggaatccgccggctcgcggcgagcattccgagctccgggtcgcccgaaacctcgccggatccggcggtgctcgacgcggctcccgcgagagcagctgcctgtttcgccgccgggacgccgcgggcgcggatctgagggtgtttggtgggaatttggtgggggggttgagttgatttggccttgggttggggttgggttgggttaggctggttggcgggggaagctgagggggataggaggaggttggggctttgtggctgcgcctggtacatgagcgccgcgagcatcctacgcggctgcgtcttcgtcggggagcttccggcggcgcgatgatcgagcagttcgtaaattttgtcatccgtccgccgcggtaattgcactgtaaatatttttttcccactgaaatgatgcctcgtgctgtagactatcatgtttcgctgtattagctcggttctgtgatttagacggtcatgcttcctaagccgtggttgagtattaatcttaccacttcaagcattgaaaagctcagtacttgaaatatccaaaagtaggagtttgaggctgttatttattaatccctgctgttgaaattactgtactagcttgtcgaacaattagcggagtgttgtagtcgcaagtgccgcaaagggggcttatgcatttagttagcacatcaacattcattccacagtactctttttcctaaagataactttacttgttttctttaagatgcactaatgtctaataatggagttggaactcggaaccccacaaaatgttgatagtcaactgatgctttttatctttatggtatgaggcagttaattggctatgcatttgcagtgcagagtacaatccagatcagtatctgtgggaaccggagtttactcttgcgggaagaaagtacaaacgaatagatttggaggcaagtaaggggagctttttaaggccttctttctctttcatttgttgaagaaaaaatcacccttttactatatattagccttattctgttacttgtatatggcagcttacgaacggaagagaccagaccttaaaatgcagccactatgttcctgctgtcatcccagacaatactgcccttccttgtgtgatctactgccatggaaataggtatttatcatagttggattatgcttataggttctcaatttcttatattaatatgatcaatcttttggtgggaccaacattctgatcatagtttacactctaattcttggagaccggtcatttatctgttagttacagtctctgagttattgagatgaatcattaattttgttttcttcttgtgcttatcgtattccttacaagctctttctcttaactcaatgcagtggatgcagagcggatgcaaatgaagcagctgtcatacttctcccttcaaatatcaccctctttacacttgactttgcagggtcagggctatcaggtggagagtatgtcagccttggttggcatgaggtacatagtcatcataattttttgaaaacacactcttattgttttgcaattgcactaatctgataaaaatacaatcactctcagaaacaggatctcaaatgcgcggtgtcctttttgcgaaacaataaggaagtttcttgcataggcctttgggggcgatcaatgggtgctgttacaaggtatttggttaaagcgtttgtgtttcccagtttatgaccaattatccaatactttatttctcttaatgatacattattttttaagtctttggatacactagaatctttataatatataattcctgttgattatttgaattgttacttagaagtacccctgtccataaaatattttaaatatttaggttctatttatgtattgaattttggtaagttcttcataacttctgtccaaacttttgacagcctactgtatggagcagaagacccctcaattgccggtctggttttggacagtgctttctctaacctatatgacttaatgatggagcttgtagatgtttacaaaatccgagttcctaagttcacggtatgcttgtcatttttgcagaatagtcttgttcactgttactatgaactgaataaaggaaccattcgctttctggagtttgtatgatataggcacatgctttgatgaactttagcttatgcggtaatccgcaatcggtggtttatggtgcttggttataccgcttgtcaccttgttactgtgcttcagctgactgctgtgtgctgtgtgcatgacaaagaacatgtatctataattagaaaataatgtgtttacatccagaaatagtagtctttagggagctttgtgcggttcaaatgttttacaactctggttgcgcaactgtgcatgacactagctaactggtaggtaatgtataaaaggtaagaaaagttttccaaacttcagttcatgctctataatataataaaattctagtattttctggttatatatcaagtataggaataatctaaagttctagttagcgatgctagtttcatgttaattgtctgctaagttaagtgcctaactgcccactgactgttgcaatacttgcatcatataatgtttgctattatttatattgttcaggttaagatggctgtgcagtacatgcgccgtgtaattcaaagaagagctaagtttgatataatggatcttgatgttgttcaggtgtgctttctaaattaccatttgtcagtttcaatggaaatcaaagctaacattggtgtttgcctaatcacctcttctgtctccttattttacaacagtttgcccccaagacatttattcctgcattatttggacatgcatcaaatgacatgtttattcagccccatcacacggaccgtattcatcaggcatatgcggtaagtctaactcttgcttgctttacaaaggctgaacagttaatggatgcatgctaaatacatttataactcattttcttggtgtatttgtctacagggggacaaaaacttaatcaaatttgatggcgatcacaattcccccaggcctcaattttattatgattctgtttcaatattcttctataatgttctacacccacctcagtttccttcagtatgctcaaataagttagataagtactacaaccttggtgcttttaaggttggagctggaacaaatgaggtgattatcctttttttaatgcctatattatcagaaattttgaggaaattaccaaccaatttgcttgtatttttcagagcttactgtatgaaatcatcaatggtctaagggctgctggtcctgatgcaggcagttcatcggcagctgcagctaacttcacaaatggtgtgagtcagttcccttagtaggttattaaattgatatcatgaattatcattgtgatccctaagtcaattcctttttcattttgttagctacaaaatcagtggttgaattgctgacagagagggtcaatcagttgtctattaaaacagataatgacttggtaagttcatcagtggttggtttgcctcaagtacttgagatcttagctgagtatctccatctgaatgcaggattttcttttggatgaaaatcataacctcactgagatggacactcacactgctgagtctcatttagaggtaaaataaatgaggattttgaagcataaaatagtttttttttgcattgtaatttaacactgtgttctgtaaacatctttacatcaacatatggtatagttcccttaatgtggattaccatatgtttgttgttcctacaaaacaccaaaagcatattttgttgctctgctacatttgattgttccctgagtacagaatattacatagaactgttttgctatctcactgatacaaagtattacttccttttgtaggataaatctcacaggcaaaatgaggagtgctgctcatacacaagttcaaaccgagagagctggggaagatgttcttccttgggggcagcgagtgatggatcatccctaggcgagcgccctgaaattcctagtcataagcataaggtatgtcttctttcttttctcatttttgatgtccatctattgcatgaccatactgtccttttttcatagggtacttaccttagatatttttgttaacacatcttttaaatagatcctcaagtgaatgcatatgtcattttgtttgttacctactgaacctctcaaactagtgacattgctttgtccctgacaacaacggaaattttctattagatctcaatctcatcatttgttctgagaacctggtagagcatagaccgctacgaggcccttagagcaacacccactagagaacggataccgaagggaaatccgctcgctataccaaaggagaggaagaatcgactctatggaagaggctcaaacaggagaggcaagagatgggggagagcctaacccagcgattcaggctgtgcctccaaggccaggctcaacacaagagaaccaagtcatcttaacactgtgaatacacatcttaacacggaaatatccgctaggaacacggatgacacgaaggacaggaaatcacccctgattctgactcttggcgccaactgtacacncntnaaagaancacatcacttactgctcaactaagcctatcangcaatccttgtaattgccattttgtaccttatcattttccacgtttgattatgtaaatctgaaggcatgtactataattctagcgtgtgaccacccctggtctttggggtagtagttctagtagcctggtgcattgtttctaagatctgggtaggcttttgagttgaaactgtattgacaattgacatgagaacgtggttcgctgtggtgttggaacagtggaccgctctcattactgtgcccacagtgtaaaagtgtgaaatgagcatgtcagttgcatgaccatttgaagtagagaagtttcatctgagttctgagtcccttgaaaatgttcaattt

SEQ ID NO: 67787 - DNA, 2239 bp, Oryza sativa
acctcgcaagaaaaaaacaccgtctattaaaaaaacaaatcgctttgaaaatactattagaaaaacgctaaattgatggacgcttgagtcggatagaatccatcaatccagcagcagccgccgccacgctcacccgccaccaccgcgctcgcctgccaccaccgcgctcgcccgccgcccctgcctgcttcgcccgccgcgcgctcgctcgacggggcggcgatggctttatggagacgtgacggcagcaggacggaatgtggggaggcgccgagcgagacggtgttcacagactccgtcgacgggagcagctccagctctggcgccgcatccaccgacgagtggccggtgacgatgtcaccgcccaggcgcccatgaagacggtcagcagcgccgctgcgggttcatcagccactgcgtccttctgcaactggcgtccctagaaacgacgctggcgaggctcgaccgacaagtgatccaagcgagaacatcttgagctgaaggaatggccacccgaaccgtccacgtgggaatggctccggaacggtggggacgtagagcgtgagctcctcggtgaggttggacaggctcgtcatctcgttgacggcgtcgccggatttcctcggatagctcagcagcgaattggcgatgacaatgccgtagttgaaccgcttcgctggaggaactcgccgaccagcttgaccttggtgtagcggacgccaagctcagctgctcaccgccggagacgccgaaccagctccacagctcgatggggtgcaccgtccattggaatgtcagcggcggaaagcggcgctgccgccatcgccgtggggtgatctggcccatcatgatgctgccgtggtgccggggaaggtggtatgtgttaaataaatgaacttctgtcagttgggatttgatcttatactcttatttactttctgttagtttgttagctattttccctcctcccatggttttctgctcgctctgttttgagtcagcgtggccgcgatttgttcggtcaagtggtggagcttgacgagcgggagagtatcgagctgagaaaacgagcagcaccatgaactagcgtcggtgagcaccacctcccttctgctcgagctcggttgagggctgggagcttgacctccgtgcccaccgcccaccgcccaccgccggccgccgtcgcgccgccgtcctcctcctttcccgcctcgccccgtcgatgcccgcgttgttcgcgccttccagctgcccgcgacgcctgcacacgcccgcgcctccctgtcgacgcctgcgcaaggtcgctgcacgcccgcgtcgtggagctccgccgggctaccgtcgggcatccccactgtggccgccgccggcggccgccattgcggcgccgcgctcctcctttcccccctcgctccgccgaccgacctacaggcgcagagagagaggaggaaccaaggaagagaagaaggggaagatagatgactcagcggactcagcctgacatgtaggacccacgtgggtcccatgctaaatcagccgtcacgtaggacaaaactggtgtcaaaaccaccgaaggacctattgtaaccggtttttattagttaagagacgctgaatatctggtttatggttggaggacgattttgtaactccatcacaagttggggaaccttctgtgtactttttcctctttgcaatcaataggtgtcaaagtgtcaactgattttacgtgctgtttcaaaaaggttaggatcactttcattacttcattcatagtacatctctagtacggattattattaattattagattagtagattgaatcgggtgctgccaaataaaatggccgccgcaccattgccactgttcgccaaagctcaagagcatcggttcctctttcctcctggttagttcttctctctaccgcttcttccgtcctgattcttgctcgacatccccgttttgagatggccacgccgcatcagttgaacggcccaacaaaccgcgtggggtgccgctggcattggctgcgagccgtcgataggcaagcttcaacgctcttggagcgcgcgtgcagcgggcgacaatttagtcactggctcaccctctctcttccagtctggctttttagggcccatttgaatagcaggaatggaaaaacgaaggaatatgaccctctctcttctagtctggctttttagggcccatttgaatagcaggaatggaaaaacggaggaa

SEQ ID NO: 67788 - DNA, 1539 bp, Oryza sativa
attttaaaggatagtataggattcaatcctttggttcaaaggcttttataggaattttttccataggattgaaatccttcaaattttctacacttttcctataaatcaaaggggaccttagtctacgtgtccaccttgttgtcggctaattgctctctattgtagctctcagtgctcatgccatggaagctgctaccggcggtcttctgcattatgctgccgctgttagtgatatgccctagaggcaatcatagagatgattgtatcacatactatgtttacatatttttccgattttgttccttgaaatagataaactcattattggttaatgaatatgtgattctttcataagactttttatgttatgtgttgctatttctaaaggatccctgatcaaatatcatatgtggaacaaatatgtttagatgatcaacacatgtattaattgatgatcatgtctcatggatcatggtatagagataccaaattaataatgtggacacatgttagtgaacatgttgttggatagacccaacatgagacactgcaagagccatatgtgttgtgtcatcagttatctcatttagtgttggtgttgaatccttagacctgagattatcatggttcccaacatgtgtagtagcttacttagggactgctaaacgctactccgtaattgggtagttataaaagtagttttcgggtatgttatgaaacatgtagtgggatatgaataatcaagatgggatttgcccatcctatagagagatatctctgggcccctcgatgttgtagattatggaaatgcatgaccatgccaaaggtgattgaggagtcaatcataagttatataatctatcaacaggttcgagtgaatgattgagctattagaggatggcacatatctagccttgagcttaatcgatatcatgaggcaaaagggttcatacaagtatacactagaggttcagccgatctgatctttatgtatgcccggtgggtcaatacgttctgctaggggccgctgttgacgcgtggaccgaaaatgagttttcgggttacagccgagtatatatgaacctacagggttgcacgcttaatgggccggaataagggaattggatagagatccaatatgagcttaatgtggataaggatccgaataggagtcctacgggccttggaggcccgagtgatggatcctatatattcgtgaggggtgtgacaggcggaggcattgcatcacgtgagaaaccctagccgtcacttccctccccgagcaaaaccctagccgcgcgcgggtgctagcacatctgtgcgtggcgttccgtccctgtacgtgtggataccagtaaaggctctgctggtttgcggtgctgatcggcataggagtacagcgaggagaacgcacgaggaggagaaggtcgagccggtgcgatcgactacttcctctacatcgacgcgcgctacttcgcgagagttccttcgacttctcagcgtcttcttccgctgcgcagtgcgtcgagtggtaacgat

SEQ ID NO: 67789 - DNA, 15087 bp, Oryza sativa
ctggaactcatttcaatttaggagttggcttcgttccaggcctgacctatttgaaacatgtgatcggtgcttcccaataaaaatagagcatgcttagtttgttaccattttcaatcatactaaatttgggcatgccaaaatttgacaagcggaaatccaaacatgtcttaggccccgatagtttcctccatataacatcagcagccgccaaaatttgatttttcaactaatttttgaagggttttcatcgaagtttatttttcagtattatcatttaaatcgctaagaatacatatgtaaaacttttacctataaattattagtagtttgctattatccgtatttggccaaacgatgggggccttatatatataaactctggtaatatgctggaaactttttgacataacttcatgcaaaaatatctcgtaaggttaaaactaaaaaacaccgacttacctatcttatcttacccaattttggcattgataagctttacaagttttgtcatattttttccattttgtacaatctaagactcactttcgttaaattcatgtgttcatgagttaaattactggacaattggagagaaaaaacattcacatttgaaaggcttaattttggcccaaaaccaaaagcactccaaatcttgtaataatattaaatagctccatcgtttgctctttagtttatcgatcactgtcgaaacgtgaattttaaatcttaattttagaatcattttgattttttttattttagtttattttagtattggtttttaagtcattgaaatatatacataaaaaaatatttttttaagttgctataagtattaccgtttataattaggttagttgctataagtattaccgtttataattaggtgtaggtgaaactatggaactgtggtggcaaaaactatattagtaagctttggccatgacaatttgtaacctatatcatgttaaaggaaccatatgcgagttgtacacgtgttatgactagagaaaaggaataagaaaaacagagtagctaggagaggacaaatggcatccaagtaccacatcaccctgattttccaaatctacaaatcgtcaatatcgtcatttctgcgctctagatctgatgcaagacctcaggccttagggtgacatctcgacagtaacctttaagccaataattcttttcaaaacctttaagccaataataatctaacagtaagaaaaaataaaaataaaaacaagacaaaattgatgattcatatccatagaatcaaagctttttggggcatcttgtgaagtggatggcaacatgaaagggacctccatttcatcctagagatcagataaagtgaactgggaattgtgatcaaaatcttactgaagatatgtgaataaacaaacaaatcaataagtgtcacatgtttggtctagatgctaggatcagaatttctagcaaaaaaagcaggatatatgtaaaaattcagttgatgcactgctaaagtgctactaatatactatgatttgttcttgatgctttattctggaagtggtgtcaagtgaactgtgcaccttgcacactttatgtagaccagtcatcagtttttcaatcctgtcactggtcatatatatagctgaagataataacatatgtcagttctgcctgtggcaacattggccttctctgattggcctgtacttgatgatattgtgatcttaattggatgactctactaatgcaacgagtttccctcaaaagaatactcgtagcattttaatcactttaagtgtgacatttacaatttccgaagaattaatcttcaccttgcgctgccattgtgcatttgatttgaaatagtgtagtaataaatttaccatttattttacggtaatgctaaacaacgtatttcgctctacctattaagtaccatgccttgcagccacccatccatcccgctcccctccctcctctcctcattcccctcccgatgttaaaacaaaaaaaaaaagttactctcaattttacccaaacgttggttctgtcgttagggctttactctctcctcctgatgtaaaaaaaatactatctatttggtgtagaaaaaactatcccgtcccgtccccttccctcccctccccacaccctctctcttttcttgatgtaaacaagttactcttgatggaaatatggtatatgttttggtaactcttatcccctctaccccctttccttctaatgaaaaaaaaaacactccaggggtattagacaaaaaaaatcttggaaatttatttcactagaacatttattctatgctttcccacttccctcccgatgcaacaagaattattctcaccccttcggaaaagggtacgagcaatttattttacattgtaagaagagagtgggggaggggatagatgaagagcctagcataacaaggtgtaagtaactgtacatgtgggaggcgggaggcgtgaggtgcactattgaagctaaacaatgtgctacactctgtatattagttctagtatatttcgtgcataaatattcataatgtcttatctaggctcaaggccatttgaagggaaagcatatgaatttgataggatttcattgtcataggattttttttttctaaatggatctgaaacaaagaaaggacacaatacctctatacatgcaaattttggagaaaatttaatgagtttcaacctcataaaatgtgtcctttcaatctctatcttttcgtaaactcctatgtttttcgtgcgatctaaccaaacatatactcatgtattttttccatttcgtagaatctaagactcactttcgttaaattcatgtgttcatgagtttaattactggacaattggagagaaacaacattcacattgatttactgtactactgtaggtcccacacaaagcacaataactataataaaaatatactccatccgtcctaaaatataataacttttagcattcaaaatttgtcgcaaaatataaataacttcaccaaccatatttccttctcgacaaaccataaacctccactattcaaattcttcaccaacttttatttcctcgaaaaatcgaaaacttcttccatttaattctactaagtattcttgtgtaaggtggtgtttggattcagggacttaactttagtccctgtatttagacactaatttagagtattaaatatagactacttacaaaactaattacataaatgaaagctaatttgtgagacaaattttttaagcctaattaatccataattagagaatgtttactgtagcatcacataggctaatcatggattaattaggctcaatagattcgtctcgcgaattagtccaagattatggatgggttttattaatagtctacgtttaatatttataattaatatctaaacatccgatatgataggaacttaaatctagttttagtcccatctaaacagagtctaagtctaatacttcttgtattgtacagcgggatgtagccacccacaactagtactaattataattagtattttttatttgtgatgatgtcataaatacaagtggcgccacgctgcaggtggaatacaaacggaacagcacgtgccacgcgtccccgctgccaactcgactcgactcgagtccgaccgagcgagcgagcccgactcgccgcgcgtcgccgacgccggacccgacccaccccacgagccgagccggatttattcccgtttcccgagaagcccatttgctactccacctcccggattcgctggcggcccacaacccaccagccctgctgacgaggcgcccacctgtcagttactcgcagagagggagccagcggatcgggtcgggtcgggtggtgggtccaggcccggatcgcgaggcaggaggaggggtggcccaccgcagcagcgcagagccaaggcacagcacgcacgcacgcacgcgcgcgggaggcccggtcggtcgtcgcggcccaccggctgcggccggtcgctttgcctggctttccggttttaccccccgtaaaaaggaaaaatgttcagaagatcgatatgcacgaaatcaccctggattttcgtgaattcttactttcttctattgcaaatgtacgatcaactacacggtaggagtatagtgccgatcaaatttagtatggaacatgtttttcttttttttttaccatccttcttttgggatagttacatatgacgaggtaaaaatcgatctcaaaagaaacagcttatgaaccaagaatagggtgtgattatgtttgatcatttttcctgtttaaaaaatttagtccaaatataaaaatgaataaatcatatttaaagttcctttaatgataaaaagtcgcaatgaaataaatagtgctaaaatattatagttttttcaataactgatggtcaaacttgagaagttaacaccatcacatgttataattataattaaataagtagaattaataaatatgattaaacatgtggatcggataaattttaaggaattttagagggatataaataattatatgaaaatcctataaaattaaaattcatgaatcccaagggagactttagagctactccttgcagtgaacaaagcttctactgtatgcctactagcatgtcttgtgcgcatttacttttttgcgtggaggtttgtttacttatcatggagatgagctggtaattccatttactccctaattaaaatctgatttcataattttactgcctttagactattcccaaccaagacactagacatagttttcataaactctacatcatcaaaaaactagtactatacattaatctttcaatgcaaacaccactattccatacttaaatttaatgttgcttatctcacatgatgttcttggatgttatgtagaaacaatgtctcttttctcacgcaaagacatggtttccttctcttttctcatttatttacttgtcacatcaatttttatcctatgtggcagcttatttaatgttatggacaccattctaatcattgggttgggaatagccataatactactttgcatgtttatattcttaattgcatgcatgcttcaattcatttgttcctctgtgtggagctgcactttcaggaaaaagtcatcactagatcatctcagttgaaaatcttgttccatcaacgtatcgtctgacagtttggaaaaaatgtagtagcagcttactagctagatttggtcaaaagactttaacgtcacaaaaacaaattaagtcatacaaacagataattaattccactctcctccatatcagttaatcaatgacatttgacactttccagaccatattctttacctaaaacatctaacagttttttttttcatcgagcaatagaaatctatccaccagagtggtttcttagcttcatctcgatcctacaaaaccaaacttaatcttcttttagcacgcattccaaactactaaacgatacgttctgtgtaaaaaattttatatgtaaaagttgttttttgaaatatcaaatatatccctttgtcaactttgtaataattaaaacttaattaatcatgtgttaataactttctcgttttacgtgtgccaacttaatcttcatattcgtccgttccaaacaccaccttaaagccatgaagatatatagcatggaagaaatagtttacttatagaaatcgaggatgctgctagcgctttttaagacaaaatatatataccatttattgtttattatcatctactaggctgtgtttagatccaaactttagatccaaacttgtaacttttttcatcacatcaacctttcatacacacataacttttcagtcacattgtatcaatttcaacctaaacttccaactttggaatgaactaaacacaaccctagttttctgtctgtatttcttttcagatgaagtataccgatcatttccatagtcatctaccgctatgtactaatgaacatgtgctttaaaaagtttagaaagtcaaaagaaagaagctggagtagtcttgttttctcatgaaaccagctaaaattcaatgcaccacccaaacttgaccactttctcccatctcatccaataagcatcaaaaccttttcacctccatcaaaaataaaacccacccttctcacctctttggttcaagcaaaattgtgacaagcctcaacaaaaaattaccttctctcaaggtgcaaagctgtaaaaaaaaactgagtaaaaaccccattttacccttgttcccataaagcaaagagaaggggaaaaaaatgttgtgtgtgtaagtaaagccaagagctcactaaacctagttttgcccaaaaacccagagagaggaggctccaaagcaaaagcctcactccctttccccatctcctccctcctcttcgccatttcgtcgaacaccttctccgatcgcgcgccgccgccgccgatgggggagcctgggggcgccgaggcggccgtctccgcgaggctgctcgagctggcggccgacgacaacgcggcggggctcggggagctcctcgcggcgtggccctccctcgccgacgagcccgcgccgtggtacaccccggcgcggggcgcggagccgctgaccccgctcatggtcgccgccgtgtacggctcggtgggctgcctcgacgcgctcctctcgccgccctacctcgtggaccccaaccgcgcctcggcgtcgtcgctctccaccccgctccacctcgccgccgcgggcgggtccgcctccgcccccgcggcggtctcccgcctcctcgccgccggcgccgacccggccctcctcgaccacctccagcgccgggcgtccgacctcgtcgcgctcccgcccaactcgctcccgctcaagaaccacctcctctccctcctcggcgcccgcaaggagtggcctcccgacccctccctccccgacatcaagaacggcgcctacgcctccgacgacttcaggatgtactcgttcaaggtgcgcgcgtgctcgcgggcctactcccatgactggacggagtgccccttcgtccaccccggcgagaacgcgcggcggcgcgacccgaggaagtaccactacagctgcgtgccgtgcccggagttcaagaagggggccgggtgcaggagaggggacatgtgcgagtacgcgcacggggtgttcgagagctggctccacccggcgcagtaccggacgcgcctctgcaaggacggcgtcggctgcgcccgccgcgtctgcttcttcgcccacacgcccgacgagctccgcccgctctacgtctccacgggctccgccgtgccgtcgccgcgcggggcgttggagatggcggcggcggcggcggcgatggggatggggctgtcgtcgccggggtcgtcgtcgttcacgccgccgctatcgccgtcggccggcgggggcgggggcgggggcgggggcagcggcggcggcggcgcgtggccgcagcagccgagcgtgccggcgctctgcctgcccgggagcgccgggaacctccacctgagccggctgcgcacgtcgctgagcgcgcgcgacatggccgtcgacgagctgctcgccgcggcggcggcggcggcggactacgacggcctcgtcgcctcccccgcctccatccggtccgcgagggggaaggcgcttgtgccgtcaaatctcgacgagctcttctccgctgagctcgccgccgccgcggcgtcgcgctcgccgcgctacgccgaccaaggcggcgccgcgttctccccgacccgcaaggccaccgtgctcaaccaattccagctgcagcagcagcatagcttgctctcgccgcgggcggccgcggtgacaccagagccggtctccccaatgagctcccgcctcctcgccgcgctggcgcagcgggagaagatgcagcagcagacgctgcggagcatgagctcacgggacctcggcaacgccgcgtcgctgctggtcggctcgccggtgagctcgagcatgtccaaatgggggttcccctccggcaacccggactggggcgccgacgacgaggagctcggccgcctcaagcgttgctcctcgttcgagctccggtccggagccgccaatggcaaccatgagcctgacctctcatgggtcaacaccctagtgaaggagccgacaccggagaagatgatgacgacgacatcggcaatggattccattggcatcttgggacagaacacaagccgtgatcacatcgtcggaggcgaggatgacactgccggagtcatcagcagctggcttgaacagctccagctcgatgagatggttgtctagaaacacaaaacacaaacacaaactgaacaagaaatgcgccattcttttagatgtgcttcgccgattgctactactactcactacttgttgctacttgctagcatcaatcttgctattgattaccggtgatacattcttttgggggtgatgagaattatttagcggagaaggtgatgaggaaattcttctaccatttagcattgcccgtatgtaaaagaatcggaggaatcggagcctagtcaaattgtatcaaattgccggcttgcctaggtgaaagatttctcctttgtgtttcttttcgatttatccttgtattaatctttttaatctcttttcgctgtttttcttttctaaaatgtgactgaggatcatgaattatgttatctatttgcccccatcctttggttgtgaaggagttggaggggagggtatttacatcaaatgttgcttagtcctaacaaagctcatcattgatgtaatgccctacaaattgtacccatgattcatgattgatgtaaaattcctattgtagtaccaagattgattaatctcccctgtttcctgcatttcttttcttttcttcagaaagcatcatatacatgtgccctttatcctgtgagaattacattatcgcatactccctccgtcccaaaatataagaagttttggttggatgtgacacattctagcactacgaagctggacatgctgcctgtccagattgtccagatttatagtactattaggatatgttatatccaaccaaaactcttaatattttgggagggagggagtatcatttcacctgagatggcattagttttaaaatcacatggattgtgttcagttgctgttctgatggttgcctgatgacaacagctgttggcatgggcttagtttgtgcagtgcttgactctgtggatgtggtcatgatcacaggtcggcagatcggcattgaaaaagattggcttggcctggattgcttcccttctcctggaggcattttgaaagggatttggatattaagatggttaacatcatcgatcaatgcgaggttaatgtttaatgtgttctagatgacctggtccctcactgatgcaccctgtcagaataaaacaacttggggacggtggctcggtaagctcgcctcttgtctttgttcacagtgctgacttgtactgtgacctggaagaaacatgggttggctactattttcatgtatattgtgtagcgtaaaatttccacgaaattgctatggtctaagtaaaattcagattgttgcatatttttattctagtgaagtgtgaatgcttgatgctattgtgatcctggttaaggtagctcttttaatagtataacactgagtttcttggtctttctgtttctttttttagccattcttagttcctaatttctacaaaaaaggaagttgtcttagatgttacagggtagtttctggatgtttaatgatgcattcagatggtgacagtattgaaactggatggaatattgcaatggatgtttggtttgcatttcatctacttttgatatatttggatacaaggccagatatgtggctttattattcatcatgtgagttgttattaaatgatgtaaatattttttttaagaaacagttaggtccataatggctatgattagaatatgggttgggttagggaacctacctctctctgctgacattcaggtgcatctacttaagctaggtcccaacaattaatactcttttttgtaaaattgtcatctcaagcataaattggtgcatagtaattgcatcgcaccatccctactcttgatctattaaatttgccatatgattagatatgtctggaggcaattgatatcggcacatgcctgtcaagctataatagtacatcaatataaaatggtaaaataattaatttgtctttgaagaaatgtttcatggggcccttgagcaagtggatctcgttctattttccacaataaaatttagtgagcaagctaataggcattatgcatatatagaaaattatccaatgaaatgcagccttcctttctctttttcaaatgtggtttggttgggacttggagaatggggattggagggtggtacacaagtgacctcattcagatgttgatttctccattctgagataactaatgttgctatttagagttgatgtgacatcaatataatgtattattaaaaactaaaggggcaccaatctattggtgcaaaattgacgggtaggagggtctgcatcagattttgcatctcctttgcctacatagtttgtatctatacatgatggtgatgtgctcttctgtatataaaatgtttttttctcacaggtatataatagcattctttgtcctactagcactggtagaaatttgttctgaattgctattgtaaatctattcaatatttatgttggacaatatcatcttcggcgaaaaacatttcaggtggctagaactaatttctgcaccaaggaatgtagtatttctatttccgattttgccttttgattaagactttctaggggataacaaaagaaaataagataaaaacaaatgtcatgtatcatgtgtgtcatggtgttggcttcttttttgacatttgttcgtcttgtgcggaatgctttttcgcaagttgcgtccttttggttttggggttgtggatgtggaatttgtcgttatgcggtgtctaatttatttctttgttttaggtattgaatcataggttcattaaagaactatatacatagcataagtagcaaagtctaattgtatgatgcatgaatgcaacaaaaaaaatgtctacataaattatcctatgccactaaaaattttacacaattccttattttcagactagtttttgggtgactaaatatattataagtggcaaaatttgctgcaagacattcaaaaaacttgtaggggacactgcaagaatacgtatctattgtggggacaccgtaaaaaactagtaatgatacatggtgtcggagctatatgcgagccgcacatggcaggcatgagcaaaattgtactttcacgattatttctctctctatttgcgctagatataataaaataaagtcgtgggtgtccaataactaattaccattttttgtggtgtcccaagatgaagggatagacgagtagctcgtcatgccactatcactggtaaaccctcgtttccacattcccctctcttcttgccttccccggtttcctctctaatggacagggggtaggcgactcaatctaatggacagggagtaggtgattgcgatttgccgcctaaaatctagagccccatcggttgccctaataagccgaagacaaaaatttaaattttcaaacttaaaatttgaaaattaattttaagatattttaatgtagtttcttttttagcattgacttttaaatcgttaggaacacatatataaattatttttacttataagttaatttttatttcctaataagccaaaatatgagcaactgatgactcccctagtagcatttttccatttaccattcatttcactgaaatatgcgcttgagcccacataattgaggctgttgctgaaggtttctgtgattcatcaaggtttctgtgattgcagactggatggcacagcaagtcaggaacagagtagcttggcccctggctcctggctggcctgatcaatcttgcagggatccgatggccacgtggcagaatcctgaccctcaacacgtacgggcatgagctcgatctgcaccactatactccaaacatctgcacgcgttgctgcaggcaataacttctttgtctcgatggaatttactaccgtcagaggaattcagtaaatgaacagtaaattcacatttttctcattggcatttttattgcagtagaaaccaaaaggttcagataagtttgttgggttaaacaagaagagagatgtccataagcttattgatgtttttaaataaaaaaactagtagtgttatcttgagctttatcatggccaaaatgatggtgaatcttgacctttttttgcagctgaaaagttgaaataaatttattggattaaacaagaagggagtgtacttttgttccttctttaattaaactatttcagtgaccttgagctttaacatgataagaagagaaggatagtccatattgatatgtgggtccaaatgtccaatacatgccacaagtcggtcaattagcttctagatgcattacaaatgtcttacaaattcctatttgtaagactagaatactagaccttcaagtctatgaatgacaaacagttcattctacagtatttttttcttaaaaaaaaatcattcagtttgaaactagcagttgatgaaatttccatacaatagaatatgctagaggtgccaacaacacatgatccacaaaattcttcacccaaacagtatgagaggcaggaccactacatgagaaaatgtttctgcagttcagtccaaccagtagacaggctactgaaatgctgccaaaattgaatggcagcttttagccttttatggtttgtttgggatgcaaaaaattcatataataccagagaggaaaccttgctgcaaatattttgataagacccataaatctacagtatatcagtatgctttgaattatcagtagaaattagtatcagtattaattaactggagaagaaaatgattgccggtggaatacaatttcgcgcatattttctaggaaaagcttgggattgcttgcaacactggaaagagtacagtggtgagaccaggagatagtacaatcctattttctttagattgatcacttccccatctcaatctatcatgttcagtgagaaaaccaatcattttcatctgatatagagtatcatgcttagtgagaaaatcagcatggcagcaccatttccttcatctgtcattttcagttggaaaaaccagtcagttagaggcaccaacccatgtgcatacaatcactctctgaaaatctagacaaggtatattttccctctcagctgatcaatcaactgaagaaaattcagaacacagccattgtcaccaggtagcaagtgcatcacagaattaaccccatgtatgaggatctagtcaagtaggtttagaaattaatcttcgtgtgaatgaatcagcaggcaactaagcaggaaacaatgcaatgaataggagcagatgagcaggaagattcagagattgcagcgtagggtgactgaacctgaaaggagtaatgtgtctgaatcactgatttttcagaaaacacagggatgctcttgaagaagggttcatgcttggcttgtgtcattttccatgagaacagacacatggctttgtagttctgttggatatggacattgagaaggactactctctggattttgagctggatgcagccatgctttctaggataggttaacaatctgctttgctttgaggcttggatcgaaaggagtttgttctaatagggactaaactttaggaaggataaatgcttcatggaagatatggaggcaagttggctgtaactgtgatctagattactgtgttcttgataagtcatgcaaaagcagatagcatctctctctccctccctcttgaagagaagaacaaaaataaaatagaatccatttacagtgtttatgctgttggagaatgactccatcctcgtagcttgaaaggcccacaatagtctcaaagaaacaagaacaaaaataaatgcctgaaatacactgttccaggccctgttctattattcctcaactagtacaaaagtttcgggttccctcaagttggatatatttatcatctgcactctgcaggacatatcattagcaaaacttattcagacaaaaggagaaccgcatcctatcttaccataaagttatcccccactaacttcttaaatttaacatgcaaagataccacatcatcatccactaacaagatgccacatcatcatccactaattaacaagataccacatcatcatccactaacaatcatcacatttaaacatcatgcaaacatgctatatctttatagttttataatttaagagcttatcaaatacaaacatgttaaattatcatccaacataattcacataatgtttcaatgtatatctttcaatgtaattcaaagtatgaattaccccccacccgaattatcgcggtcgtctgagttacccccctgaaccacaaaaccggacattcttcacccccaactatacaaaccagacgaattacccccctcgacccaatccacggtggttttggtatatgtggcgtacacgtggtagtccagtcagcgttgttttaattaaaaaattgtgggacccacatgtcatacactaatactctctctctcacccttttctctcccgcgcaacgcgcacggtgaggaccagcgcggggggcgaagcgtggaagcggagcgcggcggcgcggacgtcggcgctcaggacttcggcgcggaggcggcggaaaagtgtggcggcgaaggcgggcggaggagcgtggcggcggagcgcggggaactgagccagttgtgggtggcggaggcggcggaggagtgtggcgcgcccccgccgaagaggacgcccgccgcccacggtgcgttcccgtgagcccacgacgaggatgaggaagccgccgcccaccgcgcgtccctgcgcgcccggttggcctccgcctccatcgcaggccgtcatcg

SEQ ID NO: 67790 - DNA, 884 bp, Oryza sativa
ttttgagaaatcagaaatggacatgcaaaacacatggagaaatccgagggcgcctagatggaaaaaaactagcaaagttgcgtagttctctctgttttttaagacttaacgagaacaatatgaaaaaactacaactaattcgaaaggccagatacgtgtatttggcatggccatgcaatggtggggtgcaaacaaattgattaaaacaaataatctggttgtcggacaagttggagattccctcaacgttcagcgctatcacttgcaagttgcaagttggatagattgtcgctacttttgtgagggaggggctggaacggaaggatatactggggaataatgagcaaaattatattgaaattttcttttatttctaaaattcattttctttctaggggcgcttttaaaatatagttaaaaatattgaactaagttgaattaatttatttagaatgttggagtgtcataaatgtgggactgcattaataaaagagaaattctatgattttcggttgacaatcgattgattctacgaactaccttctattcctttaattttaccatgagttaacctattttagctctttactttttttataatatccaaaatattctcaagaggtttgcaagaactattgctattttactgtcaatcggaaataatgcaattaaatcaatgcgagttaaaaaagtggaattaaatctccggatgcttagtaaggttacatttgcatatactctcttcatttctttttattgacgttggttatttcatacattatgggatgggatagtattacatcttacgggcaaaatagtctattttttaggggttaacaatgtcagtcaactaacggcagtaaggaaagaaaaaaaaaactatg

SEQ ID NO: 67791 - DNA, 2843 bp, Oryza sativa
  unsure (1)..(2843): unsure at all n locations
ctgcgggaaattcggatttgttttgttttggaaacattccgaaaaatccggtgcgtgaaaacggcgtggagttcagataagtttgcgacttatctggttcggttacgcggagtggagatcgtgcgggcgccctgatcaagcgacctatctctatataaaccgagccgccgccttcacgcaacacacgcgaaatcaatctagggtttgcctcctactctgtgctgctccgtcgctcgtagactacttcgaaacctctgccttcgacgtcctgcaccgggagaaggtagcaataaggtttttgggacctctccctgttcgtcgcgacggcttgccttcctctccgctcgcgtgctgcgtgccttcgtcaacgcccgcaactgcgagtagttcctgccgagcaaccggtctttccgccacctcggtacgtgttcgacatattgcgaatatttgatatgttcatgttttactgcttagtttacatgtgtagatctaatgatgcgttcatgctagtttacatttacaatgtcatgatttatttatggaataaattaaatcattatgtgcttataacttcaacaattcaaaaaccttactataggcgctgtgattttactatggctggttttgccgatgtactgaggccggataaattcaccggtgtgcactttaagagatggcagatcagggtcactctgtggctggcagcgatgaaatgcttctgggtgagtactggcaaacctgaaggaattcttactgctgatcagcagaagcaattcgagacagccactactctctttgtgggatacattcttagcattcttggcgatcgtctggtcaaggtgtatacatgaccgacgctaaggagttatgggatgcactgaatactaaattcggtgctactgatgctagcaatgatctgtacatcatggagcagtttcatgactacaggatggctgacaaccgttctgtagtcgaacaagctcatgagatacaaaccatggctaaggaactcgaactccttaagtgtgtcgtacccgacaaatttgtggccgggtgcattattgcaaaactacctccatcttggagaagtttcggtactgcactcaaacacaagagacaggaatactctgttgaggggttgatagcgtctcttgatgttgagaagaaagctcgggaaaaagatgctgcgtctaagggcgatggtgggcaatccagtgccaatgttgtgcacaaggcccataacaagagcaaagggaaatacaaagctcaacagaccaccaacttcaagaagcagaagaagaagaagaacaatcctaatcaggatgagaggacttgctttgtgtgtggccaacctggtcatctggccaggaagtgtccacaacgcaacgggatgaaggcacctgcagggcagacttctaagtctgctaatgtgaccattggcaacactagagatggaagcgggtatggtaatttacctaatgtttttttagttaatcagtctactaattggtgggttgatactggggccaatgtacatgtttgtgctgacatctcattgtttnttttttatcaagtcgcacggggttccaccgtcctaatggggaatgggtcacatgcttctgttcatggtgttggcacggtagatctgaagtttacttcgggaaagatcgtgcagctgaagaacgtgcagcatgtccctactatagacatgaatcttgttagtggctcccgtctgactagagacggatttaagttggtttttgagtctaataaagtagtcgtgtcaaaacatggatattttattggtaaaggttatgagtgcggaggcctgttctgtttttccctttctgatttctgcaataagtctgtgaaccatatttgtggcagtgtggataggggtgggaaaaataagaccgaaccgaagaaccgaaccgaaaagaccgagaccgagaccgaaaagaccgagatcgagaccgaaaagaccgagaccgagaaattcgggtagtaattcggtctcagcatgtcaaagaccgaaatttgttcgggtaattcggttattgggctcggttaaccgaattaaccgagaaaaccgaattgtggcccaataggtccaggaggcccaataagctcaatacaccactaaaccctagagggccaccctcatccatccaggctgcatccccatcccatccctctcgcgccgccctcccttccatcgcgccgcactaccgccgctgcctccatcgcgccgcactaccgccgcctccacatcgccggcgccgtctctgccctccgcctccactccacctcgccggatccatcgcgccgggctgccggccgccggatccatcacgccacaacaccacctccgccctccgccctccacatcgccagtgccgtctccgcctccatgccgcctcgccggtcgcgcgggccgccggccgccgggtccatcgtgccgcaccgccacctccgccctccgcctctacgccgcctcgccggtcgcgtgggccgccggccgccggatccatcgggccgcacctccacctccgcccttcgcctccacatcgccggcgtcgtctccgccctccgcctccacgccgcctcgccggtcgcgcgggccaccggccgccggatccatcgcgccgcgccgccgcctccaccctccgcctccacatctcgccggcatcatctccgcactacgcctcggctcctccaaattcggtctaaccgagaccgagaccgaaaaaaccgagactgaattcctcggtcctgatttttttgggatgaaactcggtcctgacttttcaaaaaccgaaatgaccgaaaaacgggctgcagga

SEQ ID NO: 67792 - DNA, 4614 bp, Oryza sativa
ctccaccacgctccgctgccacgctcgtccgccgcctccgctcgtccgccgcctccgctgccacgctcctccgccgcctccgctcgtccgccgcctccgctgccacgctcctccgccgtctccgctcctctgctgccttcgctcctccgccacgctcctccgccgcgctttgccgccacgctccttggccgcctccaccgcctccgctcgtccgccgcctccgctctggcgccacgctcctccgccgtgctccgccgccacgctccgccccccgcgcttgtcctcgccgtgcgcgctgcgcgagagaaaagggtagagagagaatagagagagagtatttagtgtatgacatgcgggtcccacaattttttaattaaaaaaacgctgattggactgccacgtgtacgccacgtagaccaaaaccaccgtggattgggtcaaggggggtaattcgtccggtttgcataattgggggtgaagaatgtccggttttgtggttcagggggggtaattcagacgatcgcgatggttcgttgggggggggttaattcatactttttcctttatgatatcctatatacttatatagttcatcctcacttagtgcttaaatgattaatctatggtccaaattatctttctccttttttcctctaattaagtcatatcacatcgctgtaaaaaaaagtcatatcacatcaattgtttttagcctttagatgattaatctacggtccaaactatctccctacttttcttcttctataaagtcataccacattactttttacgaatcaccattctacatactatttaaatttaaattatcataaaccacattaatttacttaatttgatgttatctagctatcttacacgttatatttttattgttatcatactaaattcccgcagcaatgcgtgaggtttcacctaattagtttagtttttgggctctctgagactagtgaaatcgtcattaaaacagacaaaatggcatagattgtgttgagattatgatcacactctgctacaaaatataaatattgctgcacgtttccgaaataaaatgtttatattttaaaacggaaatataagtatttctgcacgttttccgaaataaaaatgcttatatattttaaaacagaaacggaaggagtactataacagaagccagttaaaagagcgatagagtttaagaaaaagatgggcgattcatttggtgtgagccaaacattgatatactaacaatttgcttgtattagcttaccgattactaatagacaattagcttgagaatcaggatggacgcacagcataatccagcaaatggattaactattaatgtttataggactacatgaattcttttacttcactgataaaggagccctcattgtactccgttcaacgaacaaaaaaacctctcaagaacaatgaagcaaacaattcctcaatgatacggtacaattcctcactatgatttcacctagttcaggtatgatgaacctagtagctgatgcctctccggcaaacaaataacaaatggaaatgaattccatgttttttttatttcctttgtcctagggtgtttctgaatctgttatctcaagcaggttgatcaaaagtttctcgtcagtgcttctgcaatgccatcagcaacaatgttttgagttatctagttaaccggggatatcttgaggccccttgttcgtccaggagcacctcctgagagagacaagtcgagcgataacctgtaggaatacaaatagagaggatcgtggaatcaactatcattagcttgaaaataaggtgaatcagctatcattaccatacataaaattagggggaaatggcttacaagtttgtggttcctttctctgcttcgttagtctcagattgcaacaaaatttctgagtttgttttggacaggattgagtaacatgcagtttctttcccgtccttgatgactgatcccataatgaaagttactatcagatttatgatgaaacactaataataataaaatggaaggaaaaatgtaaaagctcatgtttcttacaagaatcatttgaatcttcgtggtcatcatccaaagaaagcaacttctgcaggtcacaggtaaaaattaaggaacagaacagcgtattgcaataagcatctctcacaaggaaagtttatgcagccaaggcacaaggttaattaccttcaaattttcataacaagcttcaaggtcatcatttaccaaaagatgatcgaaaagacctggtgaattggactggtcaagctctgcacgagcattcctcagtcgcttctggatttgctcctctgtttcagttcccctacatagccagtgcataaatcaaaaagtttatttcatatggtcaggaattgaataatcaagtacatgagcttaggctatcactgcattttgtaaactacaaatataccgtgcccgaaggcgcttctctagttcctcgaacgatggagggcatacaaagatgaatattgcttcaagagaagaagccctcacagaacgagctccttggacatcaatgtcgagaatacacctcttcaatgaaaaagcaatggaaagatgtagcaattcacctttcagaagttttcatgaaaaaagagtaataactttaccttcccctcatcagtaacagattcaactgcttcaacgctagtgccatagacatttccatgaacatgagcaaactcaagaaatttgccctcacttatctcttcctcaatcttgcttcgttctgtgaagtggtaatgaactccatctatttctttctcccttggagctcttgtggtgtggctaacagaaaatccaaactttgatggatattctttcattaattttgcaattaatgtccctttaccaacaccagaaggcccgctaatcacaattggcttttggccctcaccaattactcccttgctccatgcaacaacaactgtgcccttaattttgctctgctgcttaacaaaaggagtgtctacctaaaataaacaaagcagaagaaaccatgccatctcagtaaggtgaatattggaaaagcaaaagaaaaggagataagtatactgatcaagtgcactgagaatacaatatactcctaggcctctagacagaaagcacacagaaaacatgaaacacaaatagaccccttgtgctggcatctagtgaaagagaaaccatgctttcaggtcaatgcagaaaatatgaaacacaaaaagacccctgagctagcatcttgtgaacgaaaaatatacactttcagattaacaaactggcataatgcaccacaccagcagattaacataataatgttatgacatgaataaaagaatagacttctagcttacaagtaatacaagagacggaagtagcattattatataccatatattatataactatagaacaatcaatatgcatgagagtctacaggaacagcaagaaaattattttcttgttaagtttgtatgaaaggaaaccataagagtatgcagtttccttggtgctaactaaaaactaattactttccgtaaattaaaagagaacagaagtaaagaaaagaagagcgcttgcatcaattttccagctttacctcaaggaaccagatagaatcattcaagggaacacccttctcaataatcagtatcttctcattgtttacgagaaccgctgagtgtgagctggttggatttggaggtgccccaagtactgtaggtacaaccctgcataaacacaatgggagtgactaactaccaaaatgaaagcacagtaaatagagatcgcaaaccaaaatgacagaacacgtaccaagtctgagttagtttgtccaaaattttgatggtaatcgatgacttggggtcatctgatctgctgataacatactgcaaaaagcaagaacatgctgttacaatataaatttagagtactccctagtaagattaacaccgattgacaatacacaggggagtatgctttacttacgttaaatactgtcaatagtactagctggtccaactaagaatgagcaaagacagatataaacttgacttgatattaggaacattatcagtcatgttcaaaagaaaaggcaacactatcagcatagttaattttaatgaatagtggcgctatttatcagtggtgacagattgctacgaacacgttttcttaaactcaagcaacataacacaaagtgacagcacacagcctagcatctcaaacaaggaggacaaccatcatgggtatgtaaaatcaaaccaaagttacagtacataaatgaacctattaattcaacttaccgtcttatcgcctatatctatggcattctgcaggcagtccttggattccaaggcgacgctctcgacacgaaactccggagcctcttcaccctgtggccaaatcaaaaccagagcaagttaagcatgcgggtccccttaacaaactcttcttggcatccacacataataagcagcacattggcaagcccctgaaatatccaccacagctaaactcaccataaaatgcgccgtgatcagggcagacgcgcctccaatcctatatacagaaataaaacaaccgaccaatta

SEQ ID NO: 67793 - DNA, 2212 bp, Oryza sativa
cgccgcggcggctttatacgactttttcttctcttctctctctctttttttttcttttttttttgtgggcttttttttattttgttttttttaattacggattcggtggatctggtcgtcgtttgtaaaagggaggggggaggatgcggaattgccgactccactccaaaagcggctttttccctgtttgcacatcactccaaacctaaaacgtaaaacgtaaagtggcttttctttatggaataaatagttgacctatctcgtttattatgggtatttagaaaaatttgtaaaggttggcttgtgttgttattagtgttactggtatagttttcggtgattctttaaagtcatttgattgtaaattttatcagaaaatgcttctaacaaaaggtaaaaaatcgagcgttgcacttaatgccctcgctccacttgctcctcgaggcaagtgatgtaggtgtggtagagccactactagatctcatgcttctctagcatagtgaggttcttgttacgtgaccgagacgctctggaaaggtgctcgtaggagaggggatgccgagaaagggcctatctaccagtatgagttttggataaggatgggtcctattaggtgatggagagaccagagcaggagactatgatggtgacaggtggccgtcgtgaagggtaagcagagctcgaggatcagtacctggaggaggcggtggggtgggatccacatggatttaaaggtggacacaattcatctttgatcgactggaacaacttgactgctaattttattttgtcggattagacgcacaatgttagtcacgcctactttgttcgatagctaagctattatagatcgagtcatatatgtttatgagtgccaattggtctatttcatgagtttttcttatatataatataaaaagattgaaacctgaatacaaattacatcatgatgatgaaagtgccaaggctaaaaattaccctaattaaataggtagtgatgtgacaaaacaagtgttgaagatgtatgtgtatgtgtcatgtgtgagggtgtgtttagttcacgctaaaattgaaattgaaacaatatgacgaaaatgttggaagtttgtgtgtagaaaagttttgatgtgatggaaaagttgaaagtttgaagaaaaagttgggaactaaatcaaggttgagtgacttgcaagatatgtttacctcgctagcacaacttcctcacacatctacacctaactgacgaacaaaaagattttacaaaattccatgccacacatgcatatggctggaaccacacacttacagctcaacccaactaaacaattcgaagatggtgatttctttttctatcacattaaaagttcggacaaatactagtgtgttgtttggaagtattgtatcatggtcacacatcatagtgtaaagtagacttctactccacaacgtagaatgatcattcgaaagagaaaagggaaatgatttggtcaatgaagatgacgtagaggcaaatcttgagtcgtttctccgaaggtgccacacaactacacaagactaattagttaattaggcatcaatgaagatgtcttaatcatcttctctaacatgtagttacgtgtgcatacgtacgaaggtatgatgacactttccttcttttcttaaaaaaaataaaaacgagccacgtaagagattgcgtgattttatatgatatagcaggaaaaaaaatcataagaccatatccctggtctttcagagtgggcagccaaatggaagaaaacaaaacatgattatttgggaataaaaacgtaacaatgatggagttgttctagattaattggatcgtacaaaacaaaagaacaaaaaaaaacccaccaatcactggtggagaaaccatctttgatcggtcggccaaatttcacaatagtcccggttctaataaaaaccgggactaaaaagcatctttagacccggttggtgttaccaaccgagactaaagttcatttttagtcccggttcaagaagttgaggggttcaagacagatcccgattatttttactctcggttggtataaacaaccaggactaaaaacagatctttagtcccggttatttataccaaacaggagtaaagagtaccccgaaccgcgcgccagatattatccgcgcgccacaaaaataattgtttataccaattatttttactcccggttgg

SEQ ID NO: 67794 - DNA, 2260 bp, Oryza sativa
atgggttctccggaaagcggcggtgaagcgagcccaagttatcggttgcccctctggctgcgtagcctggaagtggtcccaccatagagatgcgggtccctgcagctggtgggcggcgaagacgactttctcttcgtcgctgcactgcaccgtgtctagcttcttccccacggcatgcaaccaatccaacgcatctacgggattgttggagctagagaaggtgggtgggcggatgcggaggaattcggcgagtttggagtgttggggaggtggtggtggagcattctgttgtggcgggttttggaggtggtggaggaaagcattcatcatgttggcttgttgggcgaggatttgggtgagaatggcgttggtgtctggcggtggtggtggaggtggattgccttgggggttggggttgctgctcttgggttggctgccttcaccggtgttaacatttctcctggtcgtcaccatctgaaaactccacacagaaccagcaagcagagaaggagagctgacgattaaaactaaccacccacgactactattattcttaaatttatcactgctattaaattggttcattaaggttcaagttgcttaggcaaacaaataaagacaggctccgacatagttacaccacacaccggcgtaaccatgccccacacaactcaagaagataaacgaggaaaaacacacgcgcaagcctactaactgctcgtctaccgctgcgacgggccagggcggaaggtgagcaacagcgcaccctccgagctaccaacgccggaggcttccccctcctggggaaccacgggcgcaggctcggcacgaggggtctcgacgaagcaagtccacgccagggactgacgaacaagctcgggccgggaggtgctcttgcgggcggtgatcttctggctgcggcagacgcggcgacgcttgggacggctgatctctccctgggcgaccttgagctggtgcagctgcgcctccagcgcgtcgaggtccttcttgagctgcaggttctcctgacgcagctccaggatcttcatgttgttctccaccatgccacgacgcaccatttggtggaagtcgatacgagccgcgtcgtacgcctccaccatgcgtgccagatgcacgacggtagcgtcatcctccgagctagcgtctcggaaggtggcgtagtcgcgggctcctccgcgacgagggtggtagcggtagggcgagtgctgcaactcgtccgggtagcgctggtgcagggtgccgatggcgaggagagcggcgttctggcaagcggctgggaaggagtccccacccgctgtgactgccagcgaagtccgctcgggagagccggagaggatcaccgcagtgacctcccaaccagcgtgaggctctgcatcctcaccctcctgatccgggagcggcctggcctggtaatccactccgtgtggataccccaagaccacgcacatgcctcgcagctccaagacgaagccagtcatgtgcaaaccacgacgggtaacgctgccggccatctacaagcaaaaacaaaaagaaaagcaacattttcaaaggatcagattttgacgataaatgaagcagcaagacagagagagaatagcggttttcacaaataacaaaggatttttatttttgaaaatattgctaaggcttgggatctacggctcgtcctagggtcaagggaggctctgataccaacttgtcacgaccggaaatcacccaacgggcgttcctgacgtgcgtgtattattccttgtcccaggaggcaaggtacaccaaaagttgatacattacagagtttaacaagcggaagcgtatataaaattattacatgggcgacgaaggcccagcacactcaaagacaacgaaaaacagcggaagactagggcgacgaccacaggcacttgacggcaggcacgagctagacaccgaagccttcatcttcaaggaactcctcatctgggcttgggaaaattaagcaagactgagtacaaccaccgtactcaacaagacacacccacaaatgcagaataaatgcaagggagtacaagggaattataatataaagggttaggtttgcagtacacatttaaagacatttagttgctcaagggtattttggtaacccggttttaagaattacccaatattattaatcaaggccgtgaaccggcacgaacctgccttaacccaaggcctacgatgattcggaccgaactggcaacccgagggctgcaggaat

SEQ ID NO: 67795 - DNA, 4825 bp, Oryza sativa
aaccgggagtaaagagtaccccgaaccgcgcgccactcatttattatccacgcactcctctcgatctcctcccctctcattactccttctccatcccttcctctcccccttcatccccttcctctcccctttcccctcccgttcctccccttcccctctttgagcggcggccgagcgggagtagcggcgcccggcgggagcggcggcggccggccgtctgggtgcggcagaagggcgggcgggcgcggcagctggccgggcgagctcgcgcggaggccgcaaggacggtggccgggaggccggcagcgccctcctctctgctaccgattttttttgaatttttgattcattggatttgatctgtgatgtatgtgatattggatctaatctgggaattgtgatgtatttcttttaggatttgtgatgtattttttgtttgagattttgtgatgtgatgtattgtgatttgtgatgcatttctttccaatatgtgatgtatttctttccagatctgtgatgctactttgatttggggatgatttgggaatatgatcggggatatttagggagcagatcgatttgagaaaaaaaaaataaccgggactgctcgtaccaactgggactaaagatagatttttagtcccggttattttacccaggactaaagatgggtatctttagtcccggattcgtagtcccggttgtataaccgggactataggggggttttcaaccgggagtaaagcccctttcttcatcagtgaataatatataagcaccgtagaagtgttggtccattggaatttctttgaactttgagggaataaatgatcagttgcaatgtggagccacaggttcattgcatgaaggcaatatatagattcattgattctgatgtcggcatcaatttttttctgtttctgctacatgtaacactcatggaagcaaggccaacctttaccaacatttgtctctggccaagaaattgcctcttagattctcaagtattttttttttaaaaaaaactgaacagtttgataggcatgagtgatgaagaaggcaaagaaagtgacctacaaggcaactgcaaccactacatatataactgatagtgacatctatttaattatatagtatacttttgtaaatagctttgattttatttttccaagccaatatatgtaactaacttatttctagaaacagacattcatggaattccaaggtttattttttgcaaggctggaatgtatgctcatggttgtctgcatcgcaacaatattcatttggcaataaggttacattgttacgaataacggttattatgcatgtttatttttgaagataaaatgcctcttcgatttgtatgaaaaatatagtagttttagaggatttcaatcctatgaaaaagtttcctgtaaaagccttaacaaaggattgaatcatatcctatcctttaatattcttatagaatgggtaattatagattgtagagaaaagttggcaagaggtccaacctattgaaaaaatttctttggatacatctctctcatccgattcatatgtttttcctgtggtccaatcaaatggtcacttatgtgtttttttactatgttttgtaattctctattttacactagtattcatgttggaattacatggtttagagaaacgcttggggtcttccggctagctccacaaggtggtgggctagacgatctgggttcgaagtctcaccctttctaattatttgatattaggttcttttctaatattcgtgtcttttataattacttggtttcccttttctcgtgcaatatgtttgatacgggacaatttccagttgccaactagtccatattctctgctagccagagccgtgctgcatcaaaaatctgatctgatcagagagaatttggttcaaattcaagttcattgcagccactcttaatgcatacccagattccattccagtcaacatttattgcataaaaagattcacctatcactttgccatatatgtatgtatgtgtgtgtatatatatatataggtaaattattgctacatggagtatgggctccaagattcaaattgtatatacccaatttgaatgagtatgaaatttttttaaatgtttatatatgaacattaacttctttactaacaagttcaaataagtttaaactgagtttgaacatttttttgttagattttggttctaggtatataacactcaaacatataattcgttaggtatgtaataatgaattgtgaaataaagttgagtttgagttgtttcgttgttaggtatatgtatgaattaaattcatatacctaggtatatactcacaatttgaaaatttttcaaaatttgagagaatttgtgtgttttataccttggagcccgggcaacatggagtcccatatggatatcatatatatatatatgtatatatatatatatgtatatatatatatatatatatatatatatatatattcttgtctaattacttatttcagagctcaggatactattttagcctaggaaattattttcctaaggatttgtttggttaattcctcctcataggaatggaagtctatgcggagagacgtgaaatcaaacgtcccttcccctaaaaataaattccttcctgtaggaatttactgaacaagccctaagggatgcccatgaaagaattatccatgagtcatatcaaataactcacattgtattaactatataaccaggttaaattattatctagtgtaaatgttactccctccgtcccgtcccaaaatataagcatttttagcatagtgtgaaatcaaacatttttaacattaactattagtagaaaaaaaattaaaaagaacaataatgtaaaattaatgttactagatttatcattaaacaaactatcataatatacaactcttttttatttaaaacatcttactttcatagattttgttggtcaaaatagtatctcaaagaccatgtcgaagtctaaaatgcttatattttgggacaaatggagtactaattaaacaagacccacgagactatgatgcatatgctagctagttgatcataggaacaaattagcacacatctgtgaaagatatgggtaccggggtactgatacatgggtaccggggtactgatacagcctacatatccaactacagataggccatgggggctacatccatgtaataaaacatagagtagcactcagttgccatgttgtcttatgttgcgaggcagggtatagagtctcggctgaatactactttatatagattaggaaacagaagccgtatctggttaggtttctcttctcgcaatcctgcttcccaacctatataaggtgagcatgaagccccctcaagggaaccagattgaccagacaaaagatccatgaggacaacacaaccaagatcaccatgatcaatcaatatagctgatccaatccaccaaacaagagtttgatgttatctctcatcaaggaggcttgaaacatgtctaaactcttgtctacttgcatccatccactttaggtctcatatgctaccccctttattatcgttgataaatacatcgatagctggtgcagcaggtaggggtgacgctgagtttcccgtcgagaagtgcgattgaatcaatcttaggaatcgttggattcatcttcgccccaaggcaaaccttcgctttggaagtttcgtcttctttaacgatgactttggaaatcactcctctccgactcggattcaaaccagtctggaaggctcagaccactttgatctcatttggtctcccaaacaccgcgaaggcctgttccaagcttgttctctccgacacaggctcaatctcgtcagggagatcaaccttggcgagtttgatgattaaatctccgatgtcgctgcgtttttttcccttccaatttatcattgtttattagattgatttctaatcatggatgaatctattggtgttttttttattgttcatatataattccacggcactactgatgtgagtgctagcgattgtcgactcgtggtgtcactatgtagtcaaccggccatggggtcttccctggcatgcgtactctgtttgacctcgctttcacggctgctcgactccgccgctactgatggacaacctcgtattcaccgctggcttccttcactaccacagaccgctaacctcacaccttcacggttggcctactaaatcaccattgatgggcgacctcgtcttcaccgctggctgcctccacagccgtcaattggtaacctcaccttcacggttggcctactacgccgccattgacgggtgacctcatcttcaccattagccacctcctgccgtcaacgggtgatatcgcttccatggctgaccagcttcgctgttgctgatagacgaccttgttttcaccgccggttgtgtccactgtcgtcgaccggtgaccttgccttcacagttgtcctattaccccaatgctgatgggcaacctcatcttcaccgccggttgactctgtcgtcgccgacttgtgacctcgccttcacggctggccaactttgccgctgctgatgggcgacctcatcatcatcgcctattgatgcctcgcccctacgccggttgacttcgctacacactgatgggcaactttgtctttaccattggccgccttcgctacctccactttgccgaccctggcatctcctagaattccgacatccctacatgcgccgccagacacgatgccgtactaatctactacaacaggtggtgccctaatcttttagcttta

SEQ ID NO: 67796 - DNA, 12930 bp, Oryza sativa
ctaaaggagttgctgtggaccccgagacagtgaccgccgtcaccgattggaagcaacccaagacagtcactcagattcgcagtttcttgggtttggcaggatactgtcgcgtcccaaatcgactctaaaatctatcctcgaaattgtccaaagaataattaaaaatcaatgtgaaagcctccaacaattaaaatgtgcaaagataaaagtcaaatgaggcttggaggatttttgtatatttcctaaaagcctaaaatgcttaaataaattttagtggaattttcagagcacaaataataatagaaaagaaataaacaaagttaaaaaggtttataaaaagaaaatcctaaaagaagtctgttttcccccccccttccctcttgggccggctcggcccattccctccctctctctctcttcccccgcggcccatcggctccccgcgcgcgcgtgccgctgacaggcgggcccgcccgccactctcgctgacgtgggacccacctgtcatccccctcctctcgccgcgcccgccgccaacgcccgtgccctagcgccgccgccgccgcgaatcccgccgctcccgtccgccccgcgtgcattcaagaggggggaattattccccgtaatcccctcccccgtttccccctcttttccctctctctctccctcggattcgttcgaatcaagcccgtaatcgtcgccggcgaaatcaatggagtccgaatcctccgcgcgcgattcctctctctccggccgctctttccttcccccggcgctatttaaaccctccccgagctccgctctttcgtttccgccgctcgccgctcactctcgccgtcgaaatcgtgctcgcgccgtgctccttctccccgccgtcgccgccgtgcttcggttagccgccgccgtcgctccgctcttcctcccgactcggcgacccctccgtcggcttcgccgcatcgtcgccgaccccgtccgccgctccgcttcgcccgtcgaccgccggagcaccgtcgtcatcgtcatcccgaaccgcgccgccgccttcttcctctccgtccgccgttctcgtcgtcgccgttgtctcggggtgagccgaagaccgtcccgttcgtttccccctttcctcctctctctcgggtgccactccgccgcgccgttggtcgccggcggcgaccatcggggcgcgggtgcgcgcttttcccgtcggccgcgccggcgaggccgccctcgggcgcgccctcgcggctgccaagtgggcccggccgtcagccgcccgcgcccgcgggtgaggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattattaccttgttcaccctagacaaacaaaacctcaactagtggacactctactcatggtatccctagtatgattttaggtagatgcttcgcaatctaattaggtaaccctaggtggttttacaactttagacttgggaaattctcatatcacctggatactttggaattgttggtttattgtggaattggcttcacaccgccccctctattcaaaatcccctaaaatggttttaggctgggctcggggtgcatggttttgatggtagcacctcggccgtataaggaccggtcttcgggcctctgttgcaaagcactaccgtacttccacatgtctagtgggtaaggcttagtttgtggctcagtctagtcataaacaaaagtacacggattggagatggatgaagtcggggtcggtggacattctccaggacaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttagaaactatgtcacgtcttccgtccgtataccgtggtggtatgtggcacgtggcaacacgtgaggaagatgtgtcttgtgggtaaagatgtacacctctgatcagagtataatctattcgaatagccgagccctcggatatgggcaagccgagcaatgtacccaagttagtgttttaattcttaaaacctgcttaacaactaaaatatggaatggttggcctgggttggcttgggacgagctgggacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaagttggtatcagagccttccttgaccctaggacgagccgtagatcccaagccttagcaatattttcaaaaataaaaatcctttattatttgtgaaaacccgctattctctctttgtcttgctgcttcatttatcgtcaaaatctgatcttttaaatgttgcttttcttttgtttttgtttgtagatggccggcagcattacccgtcgtggtttggacatgactggcttcgtcttggagctgcgaggcatgtgcgtggtcttggggtatccacatggagtggattaccaggccaggccgcttccggatcaggagggagacgacgcagagccccacgctgcgtgggaggtcacagcagtgatcctctccggctctcccgagcggacttcgctggcagtcaccgcgggcggagactccttccccgccgcttgccagaacgccgctctcctcgccatcggcacccttcaccagcgctacccggacgagttgcagcactcgccctaccgctaccaccctcgtcgcggaggagcccgcgaccacgccaccttccgagacgccagctcggaggatgacgctaccgtcgtgcatctggcacgcatggtggaggcgtacgacgcggctcgtatcgacttccaccagatggtgcgtcgtggcatggtggagaacaacctgaagatcctggagctgcgtcaggagaacctgcagctcaagaaggacctcgacgcgttggaggcgcagctgcaccagctcaagatcgcccagggagaggacagccgtcccaagcgtcgccgcgtctgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcagtagacgagcagttagtaggcttgcgcgtgtgtttttcctcgtttgtcttttttgagttgtgtggggcatggttacgccggtgtgtggtgtaactatgtcggagcctgtcttattttgtttgcctaagcaacttgaacattaatgaaccaatttaatagcagtgataaatttaagaataatagtagtcgtgggtggttagttttaatcgtcagctccttctctgtttgctggttctgtgtggggttttcagatggtgacgaccaggagaaatgttaacaccggtgaaggcaaccaacccgagggcagcaaccccaacccccaaggcaacccacctccaccaccaccaccagacaccaacgccattctcacccaaatcctcgctcagcaagccaacatgatgactgctttcctccaccacctccaaaatccgccacaacagaatgctccaccaccccctccccaacactccaaactcgccgaattcctccgcatccgcccacccaccttctctagctccaacaatcccgtagatgcgttggattggttgcatgccgtggggaagaagctagacacggtgcagtgcagcgacgaagagaaagtcatcttcgccgcccaccagctgcaggggcccgcatctctatggtgggaccacttccaggctacgcagccagaggggcaaccgatcacttgggctcgcttcaccgccgctttccggagaacccatgtgcccgccggagtcgtggctctcaagaagagggaattccgggagttgaagcaaggcaaccgctccgtgatggagtatttgcatgagttcaacaatctagcccgttatgccccggaggatgtgcgggaagatgaggagaagcaggagaagttcttggcaggaatggaccccgagctgtccgttcgtctagtctctggagactacccggacttccaacgtctggtggacaagagcatccgcttggaagccaagcacaaggagctggaatcgcacaagcgccgcttggcgaacttccgcaatcagcagggtgctaaccagagggtccgctacaccaatccctacccagggggatcctcctcgcagcagcagcagcagcaacctcgctccgcgcctcgacctcaattcgtggtgcgcgtcccacagccgcagcagcagcagaatcaacaagggactcgtgcgccccgtcctcctacgccagctgtgcagcccgttcaaggccgcagggacgcttcaggtccgcagcgtctgtgtttcaactgcttcgagcccgggcactttgcggataaatgcccgaagccaaggcgtcagcaaggccaagcgcctccccgctccaacaacggtggcaaggacgtcatccgtggtcgtgtgaatcacgtgacggccgaggacgtgctgacaactcccgacgtcatcgttggtacgttcctcgtccattccatccctgctacaattttgttcgactctggagcttcccactcgtttatatctgtgccattcgtggggaaaaatcagttgggggtagaaaggcttagaaaccctctgctcatcaccacccctggaggggttatgacagcaaagtactatagcccagccgtccctatagaaattcaggggattccttttccctcggatctgattctgctagacaccaagaacttggatgtgatccttgggatgaattggttggcccaattccaaggagtagtggattgcgcgagacgcactgtcactctgtaccgaggaccagaacaaccggttgttttctttgcacccccaacctctgtcagaagttcagaactgcatcagataggtctgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcaactcaaaggtgccactgtattctccaagattgatctccgttccggatatcaccaattacgtattcgtgaagaagatattccgaagaccgcattcactacgcgatatggactgtatgaattcacggtgatgtcgttcggcttgaccaatgctcctgccttcttcatgaacttaatgaacaaagcgttcatggaatacttggataagttcgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatactatcggagattcatcgagaacttctccaaaatcgctcgacccatgacgcagttgttgaagaaagaagagaagtttgtgtggagcccgcaatgcgagaaggcgttccaaactctcaaagaaaagctggtttcctcgccagtgttaatcttgccggatactcgcaaggacttcatggtgtattgtgatgcttcgcgccaaggattggggtgcgtgctcatgcaggacggtcatgtggtagcctatgcttcacgccagctacgtcctcatgaaggcaactaccctacgcatgacttggagttagcagcagtggttcatgctctaaaaatctggcggcactatctcattgggaaccgctgtgaaatatataccgatcataagagtttgaaatacatcttcacacagtcagatctgaatcttcggcaaaggagatggttagaactcatcaaggactatgatgtgggaatacactatcatcctggtaaggccaacgtggttgccgacgctctaagtcgaaagagccattgcaacactttcaacgtccgtagcattccgcccgagcttagtcaacagatggaagccctgaacctaaacatagttggtcgcggatttttggccgcgttggaagccaagcccaccttgctcgatcaaatccgcgaggctcagaagaatgatccggacatgcatggactcctcaagaatatgaaacagggtaaagccgctggtttcacagaggatgaacacggaaccttatggaacggaaaacgagtatgcgtaccagatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctcttcaagtaccagaatggaagtgggatgaaattgggatggatttcatcaccggacttccaaaaacccaaggcggatatgattctatatgggtaattgtggatcgactaacaaaggtagctcgatttattcctgtgaagaccacttatggagggaacaaactagcggagctctacttcgctaggatcgtgagtctccatggtattcccaagaaaatcgtatctgataggggaagccaattcacctctcacttttggaagaagctccaagaagagctgggtactcgattgaacttcagcaccgcgtatcacccgcagacagatggacagaccgagcgtctaaatcagatcttagaagatatgcttcgcgcatgtgtcctagatttcgggaagacctgggataagagtctcccctatgccgagttctcctacaataacagctaccaagccagcatacaaatggcaccatatgaagcattgtatgggcgcaaatgccggacaccgctattgtgggaccaagttggagaaagccaagtgttcgggactgatatcctgagagaagctgaagctaaagtcagaatcattcgggataatctaaaggtggcacagtcccggcagaaaagttatgcagataaccgtcgtcgtgacctggaattcgcagtggatgactttgtgtatcttcgggtcacgccattgcgaggtgtgcacaggtttcagacaaaagggaagctcgcacctcggtatgtgggtcccttccgtatcatcgctcgacgtggagaagttgcttaccagctggagttgcccgcctccttgggcaacgtgcatgatgtgttccatgtgtcgcaactcaagaaatgtctccgagtgccatccgagcaggccaactcagagcaaattgaagttcgcgaagacctgacctacgtggagaggccagtgaaaatcctggacaccatggagcgcaggaccaggaaccgagtaatccgtttttgcaaggtccagtggagcaaccacgccgaagaagaagctacttgggagcgcgaaaacgagctgaaggcagcccatcccgatctcttcgccaattcttccgaatctcggggtcgagattccgtttaaggggggtaggtttgtcgcgtcccaaatcgactctaaaattcatcctcgaaattgtgcaaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaacaaacaaagttaaaaaggttttataaaaagaaaaccctaaaagaagtcctctttcccccccccccttccttcttgggccggctcggcccagtccctccctctctctctctcttcccccgcggcccatcggcctccccgcgcgcgcgcgccgctgacaggcgggcccgcccgccgctctcgctgacgggtgggacccacctgtcatcgccttcctcccgccgcgtcctccgccgcgcccgtgccctagcgccgccgccgccgcggattgcgccgcatcccgccgtccccgcgcgcattaaagagaggggaatcattccccgcgatcccctctcccgtttcccccgatttcccctctctctctccctcggatccgtccggattcatcccgtaatcctcgccggcgacatctatggagcccgagatccccgcgcccgtttccttcctctccggccgcgttctccccctctcggtgctatataattgctccccgagctccgctcttccgtttccgccgctcgccgctcgctctcgccgtcggcatcgtgctcgcgccgtgctcctctctctccgccgtcgctgccgagctccgttccgccgccgccgccgctccggtcttcctccttactcggcgacacctccatccgcttcgccgagtggttgccgaccccgtccgccgctccgcttcgcccgccgaccgccggagcaccgtcgtcatcgtcatcccgagccacgccgccgctttcctccactccggccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtggacccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagacccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattactaccttgttcaccctagtcaaacaaaacctcaactagtggacactctactcatggtatccctagtataattttaggtagatgcttcgcaatctaattaggtaaccttaggtggttttacaactctagacttgggaaattctcatatcacctggatactttggaattgttggtttattgtggaattggcctcacaccgccccctctattcaaaatccccctaaaatggttttaggctgggctcggggtgcatggttttgatggtagcacctcggccgtttaaggaccggtcttcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaagactacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacgtcttccgcccgtataccgtggtggtatgtggcacgtggtaacacgtgaggaagatgtgtcttgtgggtaaagatgtacacctctgatcagagtaaatctattcgaatagccgagccctcggatatgggcaagccgagcaatgtacccaagttagcgttttaattcttaaaacctgcttaacaactaaaatgcggaatggttggcctgggttggcttaggacgagctgggacccagggtcgggttgccagttcggtctgaatcatcataggccttgggttaaggcaggttcgtgtgggttcacggccttgattaataactttgtagcgttctaggatcgcgtttacaaagtagctttgagcaactaaatgtctttaaatgctgtttactgcaaccctaaccctttatattataattcccttgtactcccttgcatttattctgcatttgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataagttaactatttacgcttccgcttgttaaactctgatttgtatcaacttttggtgtaccttgcctcctgggacaaggattaatgcacgcacgtcaggaaagcccgttgggttatttccggtcgtgacactatatcacttccaaaatgtgaatcaaaatatttgaagacgttgatgaccaaagtttaagcacgttgattgcatgtatttccaaacatcactattttttactggacgggtagttaatcttcttcaatgcgataagtagcctaatgccacatgcgacagctaatacgcgcgcgcgcgttgccggcgcgcgttttagcccatgaggcccatgcaagcgcgcgcttctctcttttttctttttttggacgctgctgtttttttcttcttcttctatctgttgttcctgccgtacggataggataattagtttaaattagtttccaatttttactaatgattagtttactagtaatttttaaatcttaactttaaaattttcatatttggatatgaaaattttcaaatctcgagttgaaaattttcaaatcttaagttgaaagttttcaatattttcaaatctggacttgaaagttttcgaatcgagtcgaaagtttttaaatctcgagttgaaaatgttcaaatctcaagttgaaagttttcaaaattttcaaatcttgacttgaaagtttttaaatacgagttgaaagttttccaatctcaagttgaaagttttcaaaattttcaaatctggacttaaagtttttgactctgagttgaaagttttcaaatctcgagttgaaagttttcaaatctgagttgaatgttttcaaaatttgacttcaaaatttaaatattaaatcgaaagtttctaaatctaacttaaaatttttttcaa

SEQ ID NO: 67797 - DNA, 525 bp, Oryza sativa
agggcgaattcgagctcggtacccagcttggtctgcgcgactcgcttcggctcgcactgaatccatcccgcaattagttttgtcccacctggctgattttgcgacagagcgaccgctttataaactctggttgattctgttgtgttgcctccccggagacacccacaccgactagatacagcggtaagatccccaccgtggccacggtttggcggacaccttctgctgtaaaaattaaaaatggagcagtcataaggtcccctcccgttacggggcacggcaggcgcctgccggttaggctgcatccatataaatacgttaagatgtcaaatacggcatacatacagtcgggtctcccgtggaggcagcgctagacattagcgctttgctttttgaaattttgtatgatcaaattattatttttctgttgattaattacaacagcagcaatggaggcctgcatttgaaccccctatgcgtttgaattccaatatcctttgcatttgtatttgaataccatactta

SEQ ID NO: 67798 - DNA, 20796 bp, Oryza sativa
aggggccccttttttttggccctacctggaatggtggtcttcgttgttctgttgttattgttgttgttattcttcacagtgatatgtcattcaccgcaccttatattgttcccttatcctttatagggtgtccttttggattctttcttgagtaatcttctgaatttcttctatttcttttattcttcttccacgcccaaattattgatattctattatcaatatatattgaaaaacatatttagcttaaagaattctattcatctggctgcccatgaccaccaagatccatacttatctggaatagtgtagattccttatcttgaatagtgatctttgtcggggatgacaagatctttattcattatcttcgttgattatcattggtgctgattgcaccgtgtcaatctctgatgggtctgatctctgaaaccactgggccaagcgtttgtcgaactcttcttggagcattcatttccaaaatacagtttaattatgcgccctgctcccttgcagtattcataactatggctgtagaatttgctgataaaaatccttgtgatcttgttttggaaaaccagctgatattcataatctgtggtgatagcttcttcaatttctgcagcttcagaaaataatctccaattttcatgattagcaactgttgtatatatttcttcctcttcatccaatagtttgctaggaccgtcttcttgaaaattaaattgtcccttcatgatatatatataatgaattgctggacgaacaggtggtgtgaattttggtggtattgaggagaagataatcctgtatcttccatgtccaagtctcctgcatacatctttcacagcgtttcctaaatcagattgaaggatctgatcgagggttgcatatatggaattcacaagaccatgatctataatggtttggagagatatttcttcatggttgtatgtgggtaggttccggaatctttgaagatttatctcagctttgagaaccaggaatctataggatgggtcagaaattgcctgttcatctagtcttaagagagggagcatatatatgattactcgtatggctgggtttctttctctcccttctaagagatcaaagaaataatcttggagtccaaggaatattttcatttgtctctccttaaacttttgccaaacaagatcgaggatgtcttgcccaaagcaggataaagtttgttccgttttgaagcttaatctgggttggagattttcgtatgtagtactcatgggattttggcttttaagtttctttttgcaagaatctttgtaggcacaagatctacatggtgcttttggctgggtccggagtatatattgtggaaggaataaattaggatgattatgcagtatgtatggtgtttggggaatggtatcatgcctttttgtggatgatgatggtttattatgtggaaaagattgcaataggttattgatatttatgtggaaagcaaccatgctcgaagcaggatctgctgagatcaaaatcttatctgagaataccttggtattcttatctgttgccatagattgttcaacttccatgggaagtatatcttggccatcacgggatttctcctcgcgataatctagtaacctttcctcatgatgagggatatcttgtattttagcccttttttctgttatcttttgatctgagggcacgaaatttttgaaataatatgccaggccatttaaggcatgagctttttcttttttgttttttgtttgccacaagaggtttaataacccttgttgtagctctgttattctgaaaattgtgattaaatcgttctccatggcctctgggcagttggggcagtctccatgaactcatatttgtgagccattcagacttctgtgaagccatttccctgcatatatattcaaaatctttagtagctttaataaatatctatcttcccatgatgtcttacctggcaattccatagaattttggaagatatgatgagaaagaatagttgtctatattctcactaagctcatattcattaattctttcttcagactcaagattaggtacttctaagttgtcgagtttgggggagactccaccacactttcgtacctctgagatatatggaacattattttgatatgggataaaagtaattccttgctcatgtattactgtgggttgtactgattgttgaaggaaccttaggccaattatcatgtcatcattaatcattgacaaatctcttattgtaatctcatctattatatatttagttgcattaatgtaaacctccatattataagctaactgattatgaattttctttattccggacatgtctgtggaaacttctgccttattgtcgtcaattgtgtgaactatttcaggacatcttgtgaaatatttgtcatgaataatattctttgtacacccagtgtctactagtgctaatattttataagatactttgggtgtcaattttactttaacagggattcttatacctaatatttctttgaaaggcaatcttactatatatttatttccaaaattagttatggcatctcttagttgaattattttagcagtattactgtcttttagtgttatcaattgctctttaaattcggtgttttgtatgtccttattttctggtaatgctttaatatcacaattattttttaggttctctaattctatttctaatttatttagtctattttctaacactcgtactctactagataaaatcttttcatctgattctaattctatttcttttctccatttttgtttatttgcttttatacattcagcacaagcttgttttagacatatactacaagtcactctattttcttgactagggtaatatatgcaaaaagcacatttgatattatagtcaccctttcctctaatccaatcatgttcacaatttaattgatccatcatttcaacctttagacctgctaattcgtcaattaaatctaactcttcatcggatgattcatattcttcgttgatagtttcaacttcgtctgtttctatgatagaatatattgactcgtcatcttttatttcatcatcacatactaatatgttttcatttacgctatctataattagaaccctctcttgttcttcatatttactagaatatctcttttgatctttatttgggcatgttctacttaaatgatctggcgagttgcatataaaacatctgcatgttttgtcataggttttctttggattatatcttcttacatttcttttatgtaagaatggtgctctattatctgatcttcttaagaaataccttttctttgttctaatattattatggtttctattttgatgtttataaatccttttacttctaggcttgtcttctccatatgacaagggtatttgaactattttattgcagaaattgtaatccgagtgtttcatagatctttgggcttggatacccgtgcatatttttcttagttgcttaaacacaaaagttatggcttgagagatattgatttcagctccttcagtttcctttttatattcttcaaatatcatacttgctagtgggtcaggtaatttattgaagtaacgttcaactattcccctgttatatccttgtttagcagttgtagcattatataaataatgttgggagaattcttttatgcctttccaacttgttaacgttaatttttctatttcttttaacctttcattttgcaaagttgtataacctaattccggatcttcagctataataatgttagatataacatttgcaaaattatgcggattgctaccagctcttttcaattcttcataattattaggattcttttcaacccattgttcccatagaaccttagcagattcacctaaaaatgtttctaagtaggttatcatatcttcaactttacttcctatattgtgctggttttgtatatatttttgaactattaaacctttccaaatactaataatatataggccagtctatgggatcatgtgctgctagatttagtatagccccatcacttttttgattttgaaattttattggtttctcaaaatctcttcttttagtgcccatgtgcctatactgtcctgggatataatgatatgaatattcttctttttctggaggccatcttcctgctgccctggctggtctttctctttctccttcattttttacagaaccctctccgtatcttttcctttttcctgttcccaaatctacttccatagcttccattgcattatctagattatgcaaaccttcctcatccaatgagtctataaaatcattatattgttctgcattatcttcttcttctatattctctatttcctctatcaggttattttcttcttcataactctctagtaataatttctcatttacttcccattgctcttcctcacttaataccttatctaacttttggatttcttctcttggttcttctgactttatttgttctattttaatttcctgggttctgggggtttctatggccaagcttttctcttttttttgtttcttaatcctggatagttctctatagaaataaagtttcttgtctctaattttaggccactcacttttcatagagttattatattcatctgctatatctcttaatttatcttcataatattttatttcactttcatggtctaatttttccatcaattcagatatactatgtcttctgttatctataatatctctgtcagatgattctgcatccaaatcatccgaagctctggttttataatttgtaaatctaatactaacattccctttgctgtcttggtaacttatgaagttttcaggctgactcaaggttttattttttataaattcactaattggccatttttctcctgctctttcttcagagtctattattaaagggctcatgaattttattcctttagaatgcattttttctatcacatcatttacattgattttgtatttggaggcacttctattagtcaatcttcctataaattctatacttattaataaatttgttcccttaaactcttcgtatccttttgtttggaaaccaaaactcattttatctatgaattcatttacaggcatcattaaatcaggcgctatataggttatcaacatatttccattcatatctccttctagatagcctaaagatgctttgtttattgtgtcccatcttttatctaataaggttattagcactttagctcctaatttctttcttgtcattcctttgattcctattatgtacataccttggtgaatatacttatatcctgaatattttaaactattttcaaattctttagctactatttttaattctactggctttgttagaacacttaattctacttctctagatattctataaagcccattcttattctcaaaaaatcccatgcagtatacttgttgaggccttattgcccttaaagtatctcgttgatatctttcgagctgcttatctacttgtgcaacatctttcagctcatctatgtcatcatatttgcctttttgtttatcagaacagttatcatctctgcttgctattcttctaaagagactcctagatatgtccatttttcagaattaatggcttgtgaagatgagactatgccagatgaagccaaaactatttccttacctttactagagttgattttgtctagtaattctttaatataatcactattctgtgaaattttattttgccttatcttataatcttctaataattctaatgtagtatttagcttattattaagaaaagaatattgttctacaaattgcttttgttctttatatatatcttctaacttttgctctaaatcttcttgtctcttactccaatttatatagaaattatatattaaatctacaattaaatttagttggctattattagagtgccaactatgttcttcagtatggcttagtctacaccttatgttgatattatctttggtatttattaactttccaatattagcttctaaatttagcttctctatgattaccaggctctgataccactttataattaattcacaaattaattcataactattcactactatttttagtgctgaattcacttattatgagtacagaattacttcaataaacttcaataaatactcggagataataaatacctattctgtaccccctcccgcgccaaaccaccgcgccacccgaccatccaccgaaccggtgccaccccaccatccaccgaacgcgggcccaccacccagtcggttttttccgcaccccgccgacaaaatcaggattgctcatcctcctccgcctcctccgtatccacgcgccgccgcctccatcctttccacgtgccgctgccctcggctccgtcctcaaccgacggtggccgacggcggtccggtgcgcctcctcccccgcctctcctgcctcctccgcccctctcagtgcctcccccgacccccttccccccgcgcctcctctagggcttgcgtcaacagggaggggcgtgagaggccggcaacagggatactggcgacggcggccaacggtggattggctgcggcgcctcccgccggaccccgtcctcccctctcagcgcctcccgccatcccccttcccctcttctagggttttggggcagcggcaggggcaagggcagccggcagggctgcagctgaaggcgcggtagcggctggtggttcggagcacggcgtgggcgtcttccctgctagctggacaggtttctaacccatctttttttttctgttaactgaaatgctacttgtgctaagtatagttcagaaatccttcctaggaatgtattttgataatgctaaagtgaaacatgagacagattcttgctgctatattcttagtcagaccaaacatgtcaatgtgttatgcttgattggttattgaattaaaaaaaagttgaacgttcatgtgtacagatatatatgtgttatagtatttaagttctctcagaattttaatgtgtacagcatctaattatgtttgcttcaaattttcagttatcaattcttggaaagttggattgcctttttgtctgtttaatagtcccaatgagtgaacataatattgtctcgaggcattctttgaaaagtacagccgggtttttttttatctccatcacaaattcacaatgcttcaagctttgcaggatagatgctcattttgcttctgtcatcctctagcagtgataattgataatgctaaagttaaaaacacagattgtatactacaatttttttcttataccttttgatttgtgtcacagtggcgtttattaggaggaacctgtgagcaacttttgtatcaagtctacttctcgtgagaagagggtcgacaatgaaatgtcagtcttttatgcagtaatcgtgctttatatgacagtaatatatttttatagacatgcatggtttccgatacacattaaatgttttttctgttagtgcacggtgcctgattttatgttttcttagtaagatggttactcagtttacagttacatgtctttgtccctgcagtaacacaaaccttactttgcagtaacatattttattttttgcagtaactcatctatgtgctttatccttttttcatgcagtgggttcagttgttaaagacggcaaggcctagaaagttgcaaaggttgtatacagagatggtgatcataacttggaggtatcttttgacccaactcaaacccaacctagtgtaccggcaacgggaggggtagaagagggtgagccagtagcagcagcgatgggagggggagggggaggggagagtgaggtagcgacagtggcgactggagggcaagaggagaggcaaccaccgccagtagtgaaggctcaaaacaaatcacagcttcctatgcgtcagaagaggaagaaagtttttacaagagtaagagtccaagatcaagaagaagacaatgactttatggaaccagcttgtcaggtgcctataagttttcttttttttcagcctatgatttgtttttccccaacaactatgacatatttttgctaaatgtttgttttacttactttttcctgttacaggttaagagtaaggtagctgagaaagcaacacaagatcatacaaagcataagcttagtgagcagggaaccagaggatgaagtggaagaggaagatgaggatgaatatgaagatgatgttgaggatgaagatgaagaagtagaagaggatgacgacaatgatttcatggaaccagccctcaaggtacatgcaagtttctttttcctttttagtagcacatcatgttttttctttctttgcatgacatgcacatcatgttaactttgtttttctcttatccttttgccataggtcaagcggaaggttcctcagaataggaagacagaagcaatgcaaggttctaaaaagaaggttgcttcaaagcaaaagttgactaaggatgtgccggtcaggaagcgtgatcatttctctgtgaacaccagatgccagcctaatgccatccttgaaatggttggttcgttgaacaaacctcagagggatagattgcatgctttgggatttgattgggttttcaagtttcggatgaatggccttcgatctagggaactcattgaatatctaatagattgtcttgaccctgattctatgtgccttgatcttggtggtcgtgggaagttaccagtgacacctgatgttgtgcactgtgtgttggggctgcagaatggccacttggatccaccagtagtgtctgacactactccattggatcctatcagggaagaattaggtcttggaaaaaaggagaaaatatctagttcatccattctggataggattaagatggggggcactgacgatttcacaatgcagtgcattctgatgatcttgtttagcaagttgctggccccagactctagcaccgacatcacagggaatatagtcaacatggtgagcaaaaacttggagcagtacaaagacatggccctctacaagtttgttgttgatcatttgagatggtcagctgagaagtggaaaagtggcaagaggagtacagtctacggctgcacagctttacttgtggtaattctcatcatcttttgtttgcatcttcaatgtttatttatttgcagtatcacatctgttagtttgcagtaacatccacctttatttgcagtaacacatctattcagcttgcagtaacagtgtagtaatgcttttagatatgttctgcagtaacagttagtttactttgtagtaacatccacctttatttgcagtatcacatctattagccaacagtaacagtgtagtaatactttagatatgctttttttttcattttgtaggtgtattaccttgacaaccttctttgcaaggccatgatctcaaacaccaatacaccacgctcacaatttttcaactccagtcttattgacaaaattgagaatctcacaaaatcaacaaagaaggatggctctacctcttttgggaaattaaatgtaagtttgttttttccccactctctctttctttttttggttggatagtggttggttgtggcactaaccctttttttatctatacttctcatgcagctgaggtgtagggaaagcacttgctactttgtttcaaaggagaaggtgaagagaaaggttggagctgctagtgggagtactagaaagaggaaacacattgatgaattagcagctcaagaagcaactgtagcaagatccaaagaagcgcctcgttttggtggtgacttcccaagtcttcgtagtaagctaggaccacttattgagtcacttgggagtacccgcaagcaaattgggttggatgctcttgagcaatatgacaaggaggtcgagcagattatgggtaacctacacaaggctcaagaccgcctagtggatgttctaacttcgctttgctcgacaagtgatcctaagatagcttacacacggaaaagcaaaaagagaagagatggcctcccccctctagattctaatgcagtaaccgacaaaacatctggcagtaagttctcatcctagtgcagtaacatgtctttttttttgtaatcaaatctttttttcattcatgtggttttactttttcaggtggcaatgagaacacaacccaagcttctatcggcacacctcccactcaggccaatgatgttttaggagatgagcaaagtagaggcaatgtggagagctctcccccaatgcatgtcgaggacccaaaagatgcagaagctggacaaccttgcgagccagcaaaagatgcacataatgacagtaagattcttctttctttgtattaactttctttctttgttgatatcttttgccattgcccctctgtgaacaagtagcctttttttatagatgatgctgagttgtctaacttggtggacaaaatctgtacaaatgttgaaggcttagtggacaaaatatgtacacatgttgaaagtactcctatgctggccattgccccatctcttgctgcgaacctgtcgcctgcgatcatgcctattgagatggaaaagaggaggccgttggcaaaccccaagtacatatcccctttcaagtgtgtttccattgaaccactatgggatgacactggagacattgccatggaagtgtacaaaattgtatggaacggtcaactccctgatgttgaaaggtgaacatctttgcccttcactcctcttttttttttttaattttcctaagtgaaatgcgcatgtgcattgaatttttttgtcaacactacagtaataacgtacatacagtaaaatatatctaattgtgcagtaacatataatgtatcatgcagtaatattacttctcttttgtctttgtttttggttgtacaatttttagtgcgtatctcatcgaccaaatggaaggcgccattgtatggaagggcgatgaattgaggaattgtttttcagagggtggaaagttgacaaatgatataatgctcttctggtcaacatgtttgatttttgatgatgccaactatcggaaagacagcattggctacagagttatcattcccaccagcgccattatatgctaaagattattttcatgcatttctttttttatctgcatggtccttttgaaaatagttctctagctcaaccttttttttcttcttttttgttaatgacaggaagtgctgaattctgaaaaccacaatcttacattctcatttgatgctgccgtcaacataatctctcgtgaatgcaagagttttaacctacctaatgcaaaactggttagtaagattgtcatgatgtgtgtttagtaagattgtcatgatgtgtgttactatatgtgttgacatgcagtaccaaatcatttttttactatggggtagatatgtatttgtgttgcagattaatgtttaatactaccattgaagatgcatatcaactctgtagtaacgtcatcatagtttttgtagacatagttagtctgttactgtacttttgcactagtgttactgcaatatagttactctgttactgtacttttgcactagtgttactgcatatgcttcatatttctaatttttttactgcttgacgattgaaatgcttcttttgccaattggtcagagttttcttccaacgattaacaatgaccattggactattttctgcttcaacttcaaccacaaacgaatcgatatacttgattcattaggacatgacagagacgagaaagctctaaaggctatgaaagacagagtggtacgccccatttttttcctttttgtttttttttgtcctttttctggttttgtgttctcatcattagttagcatggtatttcccttgttttcagttgggagtaatattctgtagtaaccattctcttattttgtagtaacatgcctattagtttgcagtaattgttcttagcatgggatttttcagactgtgtttctaaactataatcttattatcttgtctctatttctaccctgcttttttctgctacaggttggtaggttccttgatgttcttgatgtgatgttcccaaagaagttcacagatgttaggaagtggaaatgctatcatgcttgtaaccaaaagcaagtcttgacaaatgattgtggctttttagcgatgaaatacattcagttctgggatggcaaagtttttgtgaagaaagtttgccctgtaagtgcatgcacatttgcattttttttataacattgcctacttgtgattcattccatcatattgtttctaatacaacaattgcatgcccccctctattgcagaaggatggaacaaaatatcgtgcggaggtcctctattacatactcttccacccactgaacgaggcgaagctccctgcggctattgagcgatataggcctaagattaggaagatctccaagtagttcagctctgttcttttttccaagttgtcttttggaactttgtacctaaatgattgcagtaacatacttagatgctggtagtaacataattagttggtggcagtaacaggagactgttaggaacattgccacgttttttaagtaatgaaggtgtacagtggcagtaacgtacttggatgctggtagtaaaaatacttagttggtggcagtaacaggagactgttaggaacattgccacatttttgcagtaacgaattatatagtggcaggaacataccatatattataagtcttttgtgtaattccctgttaactctgggttgtttcacatgtcacaacatttacatcatctcttgaatgttttgaaccatgttttctattcggtttgatagcagtaacggtgctaattatttgtagtaactcatatgtacagtgacagtaacacacctgattttgtatttattgttggtaccacaaatgcaacagtacgcccgtgtttataattaccaaagttgacaggaagacataatgacattgcagcaatctgcattacgtcgtgtatctatagttcacgacagcaaaacaagtttatattgttcttactttcctgctgtaacagattactaaatttacagtaacatacatgtatcatggtagtaaacaaataggtaacatgtaatttcaactggcatcatgacaaaccatttaaaatatagcagttctagaatcatgtcatatagcagtgatgctctgccctaactgatgggaggataacattttttagtaaccaatatgctaaatgacagtaacagttgggcactatggcagtaacatattacaaatgtccaagtcagcagccatgtactatgacagccaagtcagtagcctcacttactcttcttcctcttcttcctcttcttcctcacttactcttctacctattcttcctcgtcttcctcgtcttcctcgtcataatcatctcttgcttggcgggtggttgttttttgtcttttgcttctactagggcatgtcctagcattgtgcccttcaatcttgtgacatacactacacctcctgctgtggtctttcctctgcttgctctctgtttgtttcgatactagtttttctttgtctttcttccttccttttgttgttgaaattggtggcgccgtcaaaggtgcttgcactggatctgtttccatctctccaatattattttcttcattattcaataattgttcacatggaattccatcaatctcaatatccaactccttaaatacctccatggctctgtcgtagcattgcgttgattttgatgcctttttggcaactttcgtagcctcatttatcaacactgtgtggcggtaaatctcacttgtgctgtcaaggccaaatctccgatagtcatggtcatcaaagacacccccttccttggcacttcttgtgtacctcttcaatatatatctgggcagtattttttctacctggagatggctgagcaccctcacaatatgtgggcagaaaagacctgcagcaatatggtacatagaagttgcagtaacagagagtggaagttgcagtaacagagagtggaagttgcagtaacagggaatataatagaagtaacagagtataacagcagtaacagagagtgcaatttgcagtaactgagagtggaagttgcagtaacagagtataatagcagtaacagtgagtataacaatagtaacagagagtatagcagcagtaacagagagtatagcaacagtaacaggactaaacatttgaagtaacaaatcgagacctagcaacacacctgtgtgtatccacgttttgcactcgcattcatacagcccagactccacatcagcagtaacttggaaagcgtgttgcgaccacgggttctttcgaattgtcttaccatgggtcaccacgtaggctcccatggcgttggaaacctcattcacaagaaacgccgtgctatcgaacagtgtttccttgaataaggtgaagaccgcccttgtgtacaatttgctcagttgttcctcgaacgcatatcttgtgctcaacacgggctcacactgcagttgcagtaacaagcattgtttattgcagtgaagagacaattctggcagtaacagtaacaaatagaccacacaacagtaacatgcagtacaacaggcggtaaaatattgatggaaatgcagtaacagtgagtataacaatagtaacagagagtatagcagcagtaacagagagtatagcaacagtaacaggactaaacatttgaagtaacaaatctagacctagcaacacacctgtgtgtatccacgttttgcactcgcattcatacagcccagactccacatcagcagtaacttggaaagcgtgttgcgaccacgggttctttcgaattgtcttaccatgggtcaccacgtaggctcccatggcgttggaaacctcattgacaagaaacgccgtgctatcgaacagtgtttccttgaataaggtgaagaccgcccttgtgtacaatttgctcagttgttcctcgaacgcatatcttgtgctcaacacgggctcacactgcagttgcagtaacaagcatagtttattgcagtgaagagacaattctggcagtaacagtaacagatagaccacacaacagtaacatgcagtataacaggcggtaaaataatgatggaaatgcagtaacagaatagttgaaatgctagtttattgcagtggagacaattctggtaataacagtaacagtaacagatagaccagatagcagtaacatgcagtataccaggcagtaaaataatgaaggtaatgcagtaacagaatagttgaaatgcaataacaaaatggtgattcctacggcaaatgcactctcaaacaagctcacatgcagtcaatcagatagtaaaataataaaggaaatacagtgagtacctcttgagcattagtttctcagtcctccttttgtttcctcatctggatgcatctattcatctcagctgcaactctgtggagtgcagtgagctctttgagatagcctgttttaaccatatggttcacactctcgctccgttgagtggatgtcattcttgcgtagtagatctgtttgaagtaagcaggaatccattcggcacgcaagttataaaggttttccatcacctcacaaccttgaagttcaaactcttcaacaagatctttccatgcagccacaaattcacttggtgtcagcggatggttgatcacaaagtgcagcttctctttgaaatttctatgcttgaacatttcatagagcacacctaactgttttttgtacttctttagtacatgccatcggcagagcctatgaatggtgttctttagcacctcccttatagctgatgccatagctgggtcctcgtctgcatttatattggtagaacagtagccaagtgttaattaggcagtaacatataaacaaaaaagaggtaacaaaatgtaagcaaggtaggcatctgagatatttttatagttcaacgcacctgtgagaatacacatgggagctttgccccccatgcacttcagaaaagttttaaacaaccactcaaatgattcagctctttcatccctaaggagagcaacactcagaatcacactttgcatgtggtgattgcatccaacgaacaccgccaatggcatgttaaacatgttcgttcggtatgttgtgtcaaatgtgatgcaatcaccaaaatggtggtaggctgccctactacttgcattgcaccaaaatatgttctggatagcatctttctcatcagcttggatatcaaaatagaagttgttgttcttgactttcatttctttgaaaaacattagcagcttgtttacatcatctgagttctcctccaccttgttctcagccttcttgcagtaacacgctaactaaaattcagtaacatgatgtatactaaccagtaactcacaacacggcagtaaaaggaagcaaccatgttttagcagttacatgtaaactaaaatccagtaacaagatgtatactaaccagtaactcacaacacagcagtaaaaggaagcaactatgtattagcagtaacatgttaactaaaatccagtaacaacattgctaccccgtggaagtaatgcacatcaacaatgctaaaaacaaacaagtatagcagcagtaacatgcatttgggtagtaaaatacagcagcaatgaaaatagtcgaatagtgcagatttatcaaataagacagaaggcccaaatacctattcgcaaggtccttgttagtgaaaggaatgttctgggggccaccatgcatttttgatagtaaggacattattgcaccgtgagatacgtggcattcctgaagttgtctaacaaattgcatgattgatggatcataatttttgtgggactgttggaaaaccgccattgatggggagacatacagatgatgggtgtgatccagttgtgctcttgtgatttcccaaatgtcaccatcttgcttcacccttatcaatgctttgcacccaactcgttttgttgtctagtttcttaccctatttacctcctcgcctttgtaagtgtgattgccttggcgcgtgcaatgcagaaagcgtgcacgacgggcattgtcaaacttgcctttcttaatcccaaaacctgcataccgtgcatatctattgtaaaagctgtaagcagcatcttctgattcaaacatcgtgccaatcaaagggacaacatcttcaggaatatcttggccctataattgaaggaaaaaagtacataaaattcattatttgttatgcgtaggacaatactcatggcagagtagtaaccaacacaaaatatgcagtaacatactcacatgtgtgaatgtaaggttactgtcaggggtgatgcatgcctctggattgatagggggaggtggggtgataactgttctgtgcagtaagggatctatgaaagtttgatgcagtgatggtggtggggggctcactgctattggtaagacatcaagcacatcatcaattgctggcggcgaagggggcggtatgtcacctctgaggtgcacacccgaataagtagatgttgatgccatcttcttttgcacccgcctatcatatcgacatgcaatatcttagatagcggcagtaattttcatacgcaatacgtacagcaatgagcagtaaaaaaatacttgccataacagtaacagatagaccagtcagcagtaacatgcaggaaaacagacagtaaaataattaaagaaatgcagtaacagaacagttgaaatacagtaacaaaatggtgattccgacggcttcaagctctttcgaacaagctcacatgtagtaaatcagacagtaaaataatacaggaaatacagtaacaaaacagtagaaaagcagtaacaaaagctttcttttaagacaaaactcacatgcagtaaaccggacagtaacagggaggtctatagacagtaacaacacagtaaccacagatttttctgcataaagctcgcatgcagtaaaccaaacagtaacatcgcgatctataaatagtaaaaacgctgtaaccaaataattctatatgacaaaacttgcatgcagtaaaccagacagtaacatagtgatctatagacagtaacaacaagatttttttagggcaaagctcacctcaaggaaaaggaagggattcgtgggcggcgccgaaaggacgagctgagagggatgcttcgccggggttccccacgacggcccggcgcactggaaggtatgagagttattgggagagatggaggaaaggagggaggctggtagggaagcagagggagggagggaagctgggaaagaggagagggagggggacggagggaggagagggatggggaacgaggccggagggagcctccgcgcggcggcgcccgaggttggcgcgtgactccctcctctcggcggcagatgcaggagttttttctctcttttttttttcttttttcgtatttctttttgtttctctctatcttttcgctattttttttggtgggccggtggggcggctgcgcgagggcggatcgctggatgtttaggcgggatggcgggatggcgcctgggagtgggagagggggggagggggcgtatagaatagttattctataccccaggtgtagagtagtctcaccctatacatatatatatatatacacacacacacacatatatatatatatacatacatatatatatatatacatacatatatatatacatatacatacatatatatatacatatacatatatatatatatatacatatacatctatatacatacatatacatatatatacatacatatacatatatatacatatatacacatacggtagcgctagacagcgctagacacaggcgctccgcgccaggaaagtacgtggcgtgagacacagggataatccccccctcccagggcaagcaaccaactgcggagttaaaacttaactcgcgacaaacagggagtgttccgcagtcccggtgctagaaccgactgcggagttaaaacttaagtcgcgagtcgcgacacacaaggattgttccctactcccggtgccaactttccattgcggagttaaaatttaactcgcgacacacaggtagagttccccactcctggtgcgcacataccgatttaggagttaaaacttaacttgcatgcagttggtgcctaggttacgatgccttacagattcagttaacattggtgatatgttgatgctggttcctatgtttgatctgtttactcgtacacatttttggcgtgggattcgattgaagatgtacttcagttaaaatttaacgcataggtcttgtagcatgcaaagattcgatagatgtgtttgtttttttaccgcaatataaaaacggtggctctattttatttcattatatccaaccacaaatctcgggtatgtattcattagaaaccctttttcatatacatcatatgcttggtatccttattgagtaaaaaattaacttggtatgacaacaaaattttgactcaacatatacatcctcataatatatagcataagttaaatttttgttggttcttgctccagacatcgacggcggcgtgtcattaacgtggccgccgctgctcctccatatccatcaaagtccgagttcgccgccgcagaggtcacgccgtgggcgtgggggcggagcggtggcctgatccgccgccgccttgcctcctgcccatagtgacctgtcacagccgcgcccgccgtcacctgtgcaagatccacgcaggatctgcgcgcttggggcgcggagtggcgaccggatgcgccgcctcctcacctcccacccgtagtcgaccatcaccgccgcgcccgcagccgtgctgtgctggaaccgccgacgtcgcgcccgcccccgatcagcgatggaggtggatccgtcgcgcctccagcccgctgtcacccgtcgtcgccgggcccacaaccgtgctgtgccggatccgccgacgtcgcgcccgccaccgctcggcagtaaaggtggagacgtcgcgcctcctgcccgccaacgctgcgcccgcagttgcccgtcgccaccacgctcatagccatgccatgccggatccacctcccgcccgccatggatgcgacgccatcatgcctagcctgccactgctatggaagacgatgggagaagggatgatgttgcggttgcttctggtcgtggcggccgccggtggtgatagatccgacggcgtccctatcgacgacaaccatgccgccgttgctcctccccaccaggtcgccctgtcaccggccaccactcgggatggcctctctgcgcggtagccaccgccgtaccgtcgccagatccatgtaaatcgggataaaaaaatgaaagtgagaaaaagtaggatcgggatatgtggttggttacaagatgggggaacaacacatgtatatatatgctaaaagttgggtaacatcaagttaaaaatttactagaactatgagcatgggggagggggcgcaggggtggggtactatgagttaaattttaactgcgttatgtggacggggggggggggggaggcaggttgcacgagggtggtggcactgtgtgtcgctccacctagttaggtagcgcctatagcgctgtatagtagttctctatacacatatatatacatatacatatatatatatatatatagatgtatatatatatatatgtatatg

SEQ ID NO: 67799 - DNA, 27765 bp, Oryza sativa
agaggcccgggagagaggagaagatgggccgagagaaattcggcccatcgaccccgggggaggcaaaataaacttttacagaggaatttgatttggagggatttggattcggaattgaactcgatgatagatcggggatttgagatcttgagatggcacggacactagacaagaagcgaagaaacaaatttcgcaattagggtttttaagagatagttttcccgctaggcgccacgacggaacgggcgctacagaccaaccccctaacaagaatctcgaccccgagattcagcacctaagggagcagctccgggaactctgcgcggagaagatcttctcgctcccaggttgcctcatcttcagaatggttgctccattggactttgtagaacttgatggtcttccttcgagtctgacgttctgcctcttcaagaaccttgatcggtctttccttgtaggtcaaattcttttccagctcgatattacccaggggaacttgctgttctggaactcgaagacatttctttaactgggatacgtggaacacgttgtgcacatctgcgagactttccggtaactcaagctgataagccacttcgccacgtctggcggttatgaggtaggggccgatgtagcggggtgctaacttgccggacatcccaaacctcctcataccacggaggggtaatacccgcaggtatacatgatctcctttttcgaactcaaggtcacgcctccgattgtcagcgtaatttttctgacggttctgcgctgtctttaatcgttctcggatcagcttaacttgttcttctgctgacttgagtatgtcaggaccgaatatcagcgcttcgcccacctcattccagcacaagggagtgcggcactttctttcgaacattgcctcattcggcgacatctgaatgctggcctgataactgttgttgtatgagaactcagcatacggcaaacaacgatcccaagtgccttcgaaatccagggcacatgcacgtagcatgtcttctaggatttggtttaccctttctgtctgaccatcggtctgcggatggtaggccgtactaaaatttagatcggttccgaaggcttcatgcaactgtttccagaaccttgaggtgaactgagtgcctcggtctaacacaatcttcttgggacagccaaatctacatacgacatgggtcatgtagagttctgctagtttcttcccatcaaaggtggttttcactggcatgaaatgagctgatttcgtgagtcggtccacgattacccagatggagtcgtacccgctaggggttcttggcaaaccggtgatgaaatccattccgatttcttcccatttccactcgggaattggtaggggctgtagcagaccagctggcctctggtgctctgtcttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgatcgtctatggagaaattggtgtctttcttctcctgtattctttttattaactcttttatcccttcgtcgtccttctgagcctcccggatttgcgactctagggtaggctgtactgtcaagctggcagggacgcctgactataccacggtcagccttaacttctccagttttcccgctaggtgccacgacggaacgggcgctacaggtaatcagtaactctagagaacatcaaccaaacaaaaaagtttattgatcttttcgtactcaattgatgtgaagatacgtcgtgtccttaataaattataacataatgtgtaggatcgaattacaagaattaagctactagaggaggtgaatggtaggatatcatcaaaaaccgaaaatgtttaaggaaattgaaagttactctcaaacctgatgaagttgtgctggttgcaagatcaatgtcagtaagaccatatagaagcctatggtcaaaccagagtgttgtcgacggatacaacgccttgctcctacatgcctgttgcgcactgccgccgctgatctgaccacttgcctaacgccggttagaccactggctggttataccgctcgcgtaatgccggtctgactgttgggatctagagaaacaccaaacaacaaaaagcctcgaagtaaaccctaaatttctctgccaaaaagttgatatcttctagccgcaactcccatacttgcttccaatatggcttatttatgatcaatcaaacaccattcataatctggaagagatttaacaaaaacagattgcatcgtgattgatttcctgagcacgatgtcttacaaaactgcttttatatgctcaggttatgtgctatcaccgaggcctgatgcatgcttcaaggttgtatctcctagcgatggaagatgtgactgaattttccttgccataaatgtggccttcttaattacattttctacagctttgctaccatgattaatattacatatgaacctgggattgtatttggaatgtgtctagatttggctgttacctggttgtaagatttgtgttatattggatgtttgtcgggttgtgctatatgggttgttattgtgtttgattgttgggcttatatgggcttagcccacttgttatttgatattaatataaatgaatataatatgacgggctgaaaatggtgtggtacatgtttgggcctatatgggcttttacaatggacttgacccatttattatttgatattaaagcaaattgatacaatagaattgggctgaaaatatgctacaacatagatgggccaggctaaactttagtcgggcttgccattgggctaagcctataaatagggtgctcaatacatggattttaatgggccatcagatattttatgacgttttttagctagataatgacgaatatgagagtcacaaagttatgacgacagaatgatcgtcactagattaatgaggaaaaataaggtttcatcgttgaacgccattagagacgcataataagtgacgaatgaattttcgtcacgcgagcgtcacagattacgaaacgtgacgaaaaatttaatgtttacgacgtaaatgaagcatcatctatcataagatctcttgtagtgataccatagtgaaaaatcatatagccctttattgcaaaattttggtggcataatctacagctaccgtgagatatgctagaagggattaaatgtcttttaagcagtatggcggcagcaacatgcgcttcttcaacatagaaaaaccaccaagttcgtcttggttgttcattcagtgcttgaactctgcttgcacttatgagattaaaaaaaatgctgtggtacttaatttattgttcctcaggaaatggaaaattttcaccaagttaattccgagccgctccacgctcgaatttaacttggtgaggggacattttgttcgatgatattttgtacaccttttctctaattttaattttgttagaaatagggtgcatcaaaatattaatctcgggaacaacagtataataataaattagtgattaattatcactaatggtacaatctagcatacacgagcgtatatgtatgaatgttatgtgacacgtgccaatatctgctccagtgcctagaatacagacgtgtatatgctcatggtattgcttgaatttttctttttattaatctaaatggaagcatgccaccgagcatcgtcattagagaggatgctaatcacgtgatttgccggcagtggatcgcttggattgcttgcatggaaaaccatgtgcgtgcttgcatagaaactcaagaaatataaaggcaatgtagctctgtctagagaatcccttgccatatgcagtgtgtacgcgtatacgaatacaaggaattaatcgctctgcatcacgccggttcggaaagtggatcgtcccggtataatttggatggaatcatattgagtatgatcctcgctaattggaagaaatcataacatatggaaggaattgcaaatcgtagaatcaactgattggcttgccatccatatgtgagccatgcatgcactgggcagtgaactgcattcccttcacgctataacagaaccagccatttcacagagcaagggggacgggggagactcacgagagaaagaggaagagaggaggacacccacagcaacacacacaatgcacgcagcacatgctctgcagccatattgctgagagcaaatccatatacagagaagaaggtgaacatcgtcatcggcagcacatggcagtggtgctattacttgccatgggtaatgctatatgtttctttgtctcttgttttctctgtttcagttagcaggcaagcaagggcgatggattcatcggtgatgatgaggatcggtggtccgttgggagacatccatggcatcactgtcgccggtcatcacacccgcacggtcaaggcgtcttcactcctgccgtcaccaccggtgatgtgctcgcgcatcgtcgacctcctgtgttcacttcatggctgacactgatgatgagcttgaccccgtcatcgtcgccggcgccaaccgtgcgttcaccgacaacggtcgcaagcttgcagtcggcgctggtgtcatcatcaatcatcatcgtttatcctcacggctgccaccgatggcgaatctgatcctggtcatcgttgtcggcgccgaccgtctctccactgccgacacgctcaagcttggagctgtcatcggtgttgtcatcaaccatcggcgtctatcctcccggctgccaccaatggcgaacctgtccctggtcatcgtcctggcgccagtcgtttctctgccgatgacaagctcggccttgtcatcgttgccagtgccaatcgcgcattcgtcgtcaacgtgcaagtttggatccgccgactgttgtcaccaacgtgcttggcgtcttcgctggctaatgacgacctcgcgtccgtcgtcactaccggagtcatcctcacgtcaacgacgatggcgtcacgctcgccaacctcatctgttcgatgacgaaaccgttatatatgtatgccctgccaccgttcgtctactgccggcgaagtcctccgattcgttgctgccgccggcgtcatcctcacatgaatcctcacctcaccgtctagtgatcacgagctcggcatccccaccggtgcctgtcactccgcagcgcccatacacatgacggcttcttcgtgcccgccatcggcgcactcccgagtcaagccactacgatcggaggtggctcaacatcatttgagttcggccccgattgtcggcgcatatacaagaggaccacccagttcctggaacgcgtatcatcgttcccaggctaggctacgcccctaacatcccctaaaaccactcaatactaaatatgtgctgtagcgatcagaagtgactcctgtaccatgacgatggtcggccaatgccgtgcagactagaagggcgattctaccccatcaccagtgaccacaagcttggcatctctaccgacgaggctgtggaccgttgtcggcgcccacacacatctacaccaccatcaccgtcatgcatgggagaacgtgaagcgaagaccgatgacaacgaccagcgtagcttaatgagaggtttctcaggagtttaactcatgagagtaattaatcgggtgttttccgagaccccaggaaccaggagaacacaatcgccaattcagatccaccttgcctacaggccatggagcgcatttgatcaaggattttgtatttttgtaattctttgagaattataataaatgcattttccttcatctattttatttgtgtacttagtacactggcacgcccgcgcatcttattttattttatttccctaggcagagggacggaaaatttaatttttctctccaaacattcatgaacttatattttaagttatacagtttcgactcattggtgcaacaaaagtaaaatacctgcggaaacattttgctcttatctatggaacacataattttaattatccgagtatatgtttttctttttatcaaaatataaccaaatatcaatagtagaaaaatattttttcatggtgtcgcactataattttcactggtggttatatgctaaaaccgccagtaaaaacatcaagaggggtgggggttataggaccgccagcgaaaacctatttttcctggcggccatgttaagacgtccaccataaaaaatactctatttttcgaggcggacctcttaaatgtccgccagcgaaaaccaatattttttattggcggttactaaacagttccgccagcgaaaaaaacagttccacctgcgaaaaaacagagcccgctaaaaaaaatcgacgtcatttaaaatcacgcgcgctgagatattcccttcaaccacccactgcctctgtctcctctatctcctctccacccacccacctccctctccacccacccactgcctctctctctcctctatctcctctccacccacccacctccctctcctcctcctcccccactgagacccctcctcttccctgtgcggctgcgcccccagcctcctactcctaggacgggcgcggcgctgacgacggcgaccacgacggcgggaggggcgcggcgcggatgtgcacggcgacgacggcaactggcgacggtgacgacggtgagcacgacggaagcggcgacgacggcgaccatgaaggaagctgcgacgacggcaaccacgaaggaagcggtgacgacggcgaccacgaccatcctgtgcgtgctgtccttcactgactcgctatcgtacctcgggttccatgtcaggagcgtcgacaagaggcagatcagccgtaactacctctactggggcgccgcgccctcccatcccatcctctcccctctcccagatttgtctgtggggaggaggatgggcaatgggaggacggatccgccccggcggtggcgcgggtagcacggccgcggggcctcgggaggtggagcgcgaccgtcggccttgacctcgtcacgaccgacgccgccgggccgtgggcggtggtgctcagatttcaatggatttctgtggatttgtgtgcatttgtgtagatttatgtggcttgtgaatggaaaatatgtgttgatttgtgtggatttgttttgattgtgaatggaaaattttgactgtttttattgtaaattgttggtgtaaatttatgtgaatttgtgaatcaaggagtggatttaggaataatttgaattggtgttgacagaggtgaatggagcggtgttgctccgttatttttttttatcttgtgctactattttcacaggcggctggtataacacaaccgccagcgaaaatcaattttcactggcagctgataaccgctagcgaagattttgatcttcactggcctttactttgtggcggttgcaaaaaccgccagcgaaaacctaaaatagccgccacgaaaaatggttttcgtagtagtgtatggtcttgttgtgaagacataattctaacaagtacaataatgtaattagattataaatccgataggtaacttttaatgaaaaataattttaagttgttgtatctgaaaagttattagaaggtggtagtacataatggattcgtcacatacagggcaaagcatggaaactgttttaaacactcaggtggacgttcacccttttttgcatgccatataaatggttatgaaaaattttcaaaaaaaattgagatgacaggttaatatgtaatatatcacttcataaacatgcaagatcaaattcgacttctatatgttgtaacaaaaattacaaatttgactgtgaatatacatataccagttagagtttttttttgttacaatttgtagaagtcgaatttgaacttgcatgtttatgaagtgatatattacatactaatctatcttgcaaatttgtttggaattttttcataatcatttaagtgacatataaaaaatgggttggacgtacaccctgagagattagaatccatcttcggcacagcatgcatagtaacagaagcatgtgccgcagggtgaagggcaccccattttcccgtagctatttatgttatgctgtcacgtaacgtaagaaacgaataggatcccaacaactacgagaggaactcaaagtggacgtttttccttttctgttttgtcccaagttgggcctggcccccaaggttggatcccaaaaccggaaggactttatcttgggcctaccggtaccagaaacgagtccgagtccgactagatgaatgctagggttcgctgagcccctagtaataaataaagaacagaaatcagaaatcacaacgaacgaaccgtctgtgtgaggaaggcatcgagaaaaccagcgacaagaagaagaagaagaagaaatcctcccgtcgagcgccgagatggccggcgagaaggtccagatgccaacggaggcggcggcaccttccctgtctccggcgccggtcgaggggaagccgagggaagccgccgttggtgagaagaggaaggccacggaagagccggctccggcggagagcgacttattatccgatgcttctgaatcagcggcggcggcggcgaccattgctgacgatgggggcaagccagcttctgaagcggcggttgctgaagatgagctgccgtacgacgagtggaaaatacagcgcagagcgcttctggatcggctgtgggaggagaccatgtctaaggtcaagcttccagatgatcccaatctctactacgactactccgatgatcccgatggtctcctcctagattatgattctgaaactgacattgagatggactaatgtatctatctaactcggtttatgtccacatttatcttggcctagctatagtggagaactagttaatttaattagctcttctatgttatctggtctaaccatatctgaggctctaagcactgcacttatccttttgattgcattccaatataaaaaagttctatcttttatgtgtatatactattagtactgtactccatcaaagattactctagcactgtactccttaactatccgagctatttgtatatgtccttgtttatccatgttttctgcaattttgattttgggagcatatggaatctcctgtctcgcccatcaaagaggaggtagctgctctgagttctaaccgacatgcagaatgccaagttatccttgagactctcagtttaggattcactttgtcgatctgtctatacatctctgtacgcatttatgggagtggatcctaatccctcgaggggatatcccctcgtatacctttttctttcaaattcgatgcaaatagttgtgaaaaattctgaaaaaaatatacaatatagagtataatgatacctacaagtccaccaaaattcatgtttaaattcgatctacacatcgagaaacaaaaaagacaaatttagatataaacagtacgctactattcatacgctgaatttgtcttttttatatctcgacgtgtgagttgagtttggacttaagattttgtggagttgcatatatgtgttgtatggatgttgtcaaatttctccagaatttttcataactgtttagatgttctttaagcaaacgagggaacatcccctcgagggattagaatagtttccccgcatttatctatctttgtaagcagttatggcttggtgttggttggtcaatgatatgatctttgttttcatccatccatatctatatggcgccatgatctgtgttgctaattgctacgaattaagtttggaagcgatgaagagcatgattggtactgacgaactagtaagtgtgcagtaatttgacatcataaatcattgcactcttctttcattgaaaatttcatgtgtatgtttagcttttatttgttttcataaggttttatatttgtcatggcaattcctggttgcctgattagattggatggttcttgactactgccaatccaaaatatccacttggcatctgtgaagctctattcacttaaacaatgtgtttttcgttgttcctgtctcttgctgtttattgatgatttttttgaaaaattttgtccatgattcgtttgagatcattgttttttatttgtgagtaccagatcatatgggttctgtcaaacaggctcattgaaatgggcagtacatgataccaggcagcagaatgcttttcatcttgaaatactaagtttatagggttttatttttcttagtttctatagtgtgataattgtacggatctgtctttgtatcccttattaccctttacaatctgatgtatgcatcatttttcctgtatataatgctgtaaacataagtttttgtgtgttgagagcttacagttgctttgtcctttccgatgctgtttcagagcttgtaattggcttttttttggtaacctgatgcaagggttctgcaaagcagagtaacacatgctgtattgaccttgtatgcagttgtgagcaagatatactattgcactattttacaaggtttgctttctcctctactttcttcagctacctttctgcttctttaatttcctaaatttgaataatgcattgacatggcttcagagatgtatgtgcctttctaagctgttttgattgctcatcctgatgcagagtttcatgttcaggttgctgtctgtttgtctttatatgatttagaacttcagaacaaaaaaaaaaaaacaatctgttggcattgttgttcctcttgaaattgtcacgtctgtaccatcactttaattatttgaatccttcttgaccagccggttccatttttcactgaaaaattgacagggtttgaagtgtgtcttgatcatgtctctgaaggtaagaaacccccctgaagtacttgttgttctccaggcaggacattttcttgacagtttggatacttacccggagcagcatacccggtgcagccttgttttgcaatggatttctgccttcccaaacttttggaagatatctacgaggctctgttactctccaaacagacaatgagacaattgcaccagaaattgttgtgtttattgtcagatcctaaacctggagtgtggctgctatcatgttgtgctgattcttcatatattatatactccatccattctaaaatatagcaatatccagacaaatagttacaagttactatattaatactattggagtatgtgcctagaaacatagttacgagttgctatattttgggacataggtagtactttcttcacaacgtaagcattcgtaaatatttggtcctaccatgtcagagcttttgttgttttcgcaccaggaaatctcctagatatataggcctgttcagattgtagccaaaattttggcaagttggcaatattgttaaaattttagcatgatttcttttgtatttaccaaagtttggcaacaaactaaacgtagacactttttttataactatgataaaattggtatcgctaaaaatggcatcaatctgaatagttcctatattggatctctttcactgaataaacgtgattacaattatgatgatgatgaacatgtgaaagctgaaataaatgctgctccaaccctttggtaggtactctattaagataaaacgatttcgacgcagaagataccctactaagagcagaggggtaccctactgtagagatcagtgaccactgttctccgaccaggcccaaaccagtcaaaggtgagggtttactgtcgtcagaggtgacctgatctggtgtagcgaatgtttctctgcacaaaatattatgggggtatgtggatatgatcgtgcagcatatctgtaatcttgtgcctgtttctaggtgtgactccccccctctgtcagtttgtagatgggttccacaaccgataggtaccgtatcgatcaatacagatgctgcaatattccggtcagagaccagaacttcatctgtttatttgcatgcaatgagcttgtctcagggatcagtgccagaagttgctgaggcagtggcagtgcgccaaaccctgttcttagcaaaggaagaaggattccacaggatcatcctagattcagatcgcctttctgtcatccaacgaatcacgttggttgtgtgcaactgctcgagggtaggctgtataatcgatgatatcaagaaagatccaggccgaattcctgctctctttcattcatgtgaatcggtttgctaatgttgcagaacatattttagcccgtcagtctgtgctaagtccatgttcttctaatcgcagtgtaaccctggagtgcatctaggatactctatgcattgatgttaattaattagtcagtgaagtgctgcgattaactcaaaaaatatgactgaatcaaaatttcattcagctttgatggactgctctgactgaatcgacactagaggtgcccgaactcaagaaacatgtccttttcatctagtgccgacgatcgacccactacccacccactacctactgtacagcagtacatgtctctatttagacaccttctactctcatgtgtatatccattcatctacaagattcctttgaaacacttctccccttctaaccccccaaactatttctcttctttaggaaaacaaaacaagtacacaatcacaaattagaactggaaatgagcgacatcaggagtggaagtcttaggttgatgtacagggagagttgatatcagtttgcagtatctttaccaaggtctggtactgcccaagatggttttagatgttgcctcctgatcatgtacagcggaaacaaaacacaatcagagtgtggagtgtgcttgcaggatatgccgcgcgcgttacattttgagaatctgcgagtgagcggctgtcctggtatgctgattcagttcagtgcatggttgtagtctcggaagttactacttatcttgcctgagttaaaaggagaatatgtatggtggttgatagtctttttttttttcgttttgcaaaatcaatccgtcagatcctttcatcctatatcgatcattcttttgtaatatttaaatcgctaccatttgtagtgatccatctttagtgacattttatggtcagatgatagttgatggttcagcgcattcaaatgagaagtccatagacagtagggagtctaaggaacatacaaatttgcaacggtacatgagtatatatgattgtgacaaagatagttacaggtgtacatgagaagtctaaggaacaaagatagttacaggtgtacagcttgcttagttgttacccaaatattttgaagcatcggatatgattgtgaaacggttcttctccccttaactaacatcacatttttgtaaataacctgccggtataagctcattaattaatttctggtttccaattcctcctggtttttatagagtattgcgctatgggtcaaagaacatggtgagtggatcgatcccttcaaagtttttatcaaagagtgcagtgcaatagactagcccatgtgtttttatcaaagagagttgcatgtgggatctaattcatagtacaccagtggtccacccaagtagtgcggcacatcagtacaacacaattgcaaaaaacaaaacagaccagtcaatagaactatagtcaagtgtggctaaactttatgtcgttttctagtaaaagaaacatcataaatcgatgatgtcatcaacaaagctcatcaaatgtaattactctccatgcccgacacagatggggttgccgcccaattgagatgtgggtgcccgttgtagtgcaatattcaaaatttcttaggatcccccaatacatgccccttgggttctatttataggcttagtacttagctcatgtaccctagggttactaaatacaaaggaatttatatgactactcttatgataaagacatttatgagggtaattgtaacaattcacccaacgcttcatcttgggccaccaggtgggcctccattggtcggttggtcacttcggtccctcagccctttttggtctggggcaaaggtcctcggctagggggcaaacatccttggcttcccctagccattcgtgctgagcgttcgtctttgtgacaatcggcactttgccaccatgctttgccctggcggttgtgaactagtttcggcaagctcggtcgaaggtcctcgtgacatacctccaacagtagtgatcccattcaattcctgaacaaagtactaagtagttttagttgtagtagtagcacaaattgtaggtatgtgcaagggttggagtaatttgagtactggtgtagtcatgtttacttacttgcaccacagtacacgttttcagttatagtgaatctttactgctgtctcctcttgctgttccacaacactgttgcccatgaccgtgtcctttatcatcctgtctacgttggttcgtctcatttgaacattgagatgatcggggagatgattgtttgcaatggcattcttcgcagcaacctctgtagcctccacttgttctgccctcgcctccctacagtctacctcaatgacaagattcttgaggcaagccatgttctggaggccttcatagaagttgctgtctagagatcctagtgttcgtgcccacacgttgaaccgaaacttttcgagctttggcatagccccaacctcaaacaataaaggacctaagacatcttgccatgaatggaagtcaaattctttcagacattggaacccattgctgccgaagactagcctttcagatacaattgtttttgtcgtaattgaaagagataagagagaaggcaagtccccaaggatccgaagaacatccttccccacagaagtaacattgatgtccaggaatgcgacgttaaaaagcgtggccatccactctggaattatggggaaacagtagtaagtgatcatctgaaaattgtaaagcgggtaaggagggtgagaccaagaatccagcatgaaatccagagatgaatcatcacatccaagttgtaggtaccgaagcttgaatgtacacagctcgtcgatgcaagaaacaaagctatctgtgtatgttttcttgtcagggtatgcatcactaacacaccatattatatacagacatctcaggtcattcagaccacccagttcacgcaaacaatccactgggatgctgatatcaactttcacccctataagtttctgcaaagctctcatatttccaattccttctggtagagttatgccatcagcaaccaaaaacactaaatttttcagccgaactatgctcttgggtaattcttttatgcgggtacgttggagctctagtgtctgaagttcttgtagctcgcctatttcttcaggaagctcacttatgcctacttctctcagcctcaagcattttaactgaaataatctccctatatccctgagataacaatttttcagtttatcattgctttctatggcaattgtgcgcagaacatggaaggctgaaataagtggaatgtgttcggtggacccatacacaacaagtgatcgagcactcgaaagaaccatggttgctggaagtatagcatctcgctctcggcagtcgagggaaagtcgacgaattaccttgtcttgacatcccaataaataattatgagaaaatgaagtgatgaaattttcaacaactgatttagatataataagatctagaatcatatcatgcattcggcaagcatgagcttgcccgtcgtattggatttcgtccggttgtatcatgctcctattgattagttcattaaaatagcactctccgacttcctctaaagttcgtccaccttcaccttgtgcagtgacgaacccttcggctatccatcttcttaccaatggatcccataatatcagcacatcctctggaaatgtacttagatatagcaagcatgtcttcaaatagtggggcaggtcattataactaagagatagaatcctctgcatgttgcttacactgggaacgttctcagttgctgagcaaacagaatttctgtacctcccccattgttcttttgtgcgtggtttggtagccaataagctagctagagaaataattgccaatggtaaaccaccacatcttctcaagatgtcaatatatatgtctttcaaataagcaggacattgatcttcagagccaaaaatccttttgatgaacaatttttcagcataaacatcactcaggggtttcatttcataaatatttttgcagtcagccgagcaacatgtttcagctacagaaatgatacgtgttgtacacaatattttactgccacggtaattttcacagaaagcgcatctgattgttgtccaaactgttgtgctccagatatcatcaattacgacaaagtacctatataattaacaaatgataatcccacacataggcacatatacatgcgtgagacatgcgaaaattagtaattcatccggtcataattaaaatatgcctttttagagttggcgtagtaaaactaggctaacttttatttcgatgtatgaaagcatagccaaatttaatttgttattattaactaaaactttcgtaattgtgtacctgcgtaactattgtttggatattttacgaaaaataattaagcggtcataattatgtgttattaactttgaaatgcttaaataatagtattcttttttgtctggaggattaattactagtaaaccaccaaaaaaatgcacctataaaccttattattttatttaggcacgaagaggaattggagaaacaagagagaagtaattttgagtgaaatgtcatggttcgttatccattaattaatatcttcgaaaaagtacagggagtagttagtcggtgcattaacatgcaaatgttgaaaagagagctagatagttacatgtagagaaatgagaaaaaaaggttatttaccctttatacaagcctttagaatactagtgattcagggtagtagctcatggtcgacgtaacttttttgcctcgttgtgtcacaagttgagttagttgtatatgagctatatagtcgagtaaaatgaaattagttaattggataaatcatccatagtgaatggcaccactagaatagatttttacacgtgggcaaaacaggttttcatataattatatgcggctagctggctagccagcttatgattaggggatatgaaaaaggaaattttcactcgctagctggcgatcccacatgtgaaaatccattttcacaagtaggcgtattaggatggtcttatgtaagaacaattttcgcatacgaccgcactggtaggagaaacagatcaagatatttttataaacgagtcaccccttgatagtttttgcggccaaggtctatcccggtgtttagggatagggtcctggctgcctgtttggtatgagaggtatgagagggatggcatggttttgttctttttttcctatgttctactattagaaatatatgttcttgtcaggggcggatctacgggccggcaaacccaggcagccactcgggctggtcggtggttaatccattaaaatttcatgtaattagaaaattagaaatagaatttatgtagtaaatattagctatagtgaagtttgcccgagctccaaaatatttctagatgtgctactggttcttgcagtaacaaaatgctcatgggtgaagaaactcattcatctaagcgttttaggctattttctctttgaaaataatttgcaatgaccacctaatattttgaggaggcggttgtacatgtacattgataagagtaggggtaatgaaataaataattatcgattagggtaatagtacgaagttaaaaatagaagtgcgtaccttttatcgttgagaaattctctgagtttattgatgagccgctcctcatcccatgcatctatagctccgtaatcgagctctgttatattgatcagtatatttttgaatattttccttatgtcgggtttttgagaaactgatacaaatgcttggcaatcaaactgcccactaatttttccataaacttgacgggcaagagttgtctttcctagtccaccaattccaacaatagacaccacctgcagtttttgcagcaatttatcatccccttcggtcaaaaacctgatgagctctactcttggtgtatcaatgcccactaggttttcttcttctacatagagtgctggtaatcgaggatcgatcggcaccacaccaattgaacttgacaaggtctcatcaaagttgtacctcttgcgacgttcactcgccatgtcaacacgagcctttaactttattatttgatcagccatcttgtcgcgtgctcgaagcatccgcagttgtcgaatgctcttctgcaagaaacctttcatgctttcacgcctgtgggcatcaccatctacctggaacatgaaataatcaattctatcctcaatatcatacgacaactcccggatctggtccctccactccttcacttggatatcgaggtcatcgatgtcctctagcttcaggagtagagcgttcatactacttagctcatccttcagggagaggatctcactatctactcccttcagcctgttgtacttcatctgcaatagagtagagagtttcccaatcacagggcacaggacccctgtggcaacgctcaccatggtgtgtgccatggctgaagcgtgctgaaaaattaaccgctacaacttcttgcagatgctacaaaggattaggaactaaatataagctagagcagaagtattgtgtacacagagatgactatatatgcaatctggccgagggtaagctgagtggtgggctctatattaattaagcctgatgactgtccgatagttacaatgtactccctccgtccttaggattttgacattttgcttgcactgtttgaccattcgtcttattaaaaaaaattagaattattatttattttatttgtgacttactttattatccaaaatagtttaagcataactttttgttttttatatttacacaattttttttttgcataagacgaatggtcaaacagtataagtaaaatgtcaaaatccttatattaatggacggaaggaagtagaaagccgatacacatttagtactagtactgttattgggttgcaagttggatataattagcttcaagtttacacaataagagatttcaaggtaattattgtacggtatcccattaattcaaaccaaataatagcagacaagtaccagatctggtaccctattggtactagttgatacccatcgatactggatctactatccatcggtaccacgtgagacccctcgatacaagccgatacctattgtatattgttgatggtcgttatgtagcaatttcaactgtcaattagctcaacaaataaaagaggctagcatttcttacacacatattacttacaaataatgtagttccacttattcttcgataatacattgaatgcatggattatacaataaagtgaagtagaaaatatgatggcatgcaaaaaatcacaactccgaggaatcacgtgaaagcatgtatggattgaagggctcacaagtcagaccaaaccaacttaattttgctcaatccaccgtgcaccgccataggggtccacatagcagcctttgggacaaagtcggtggagagaggggtggcatagaggttggctgaaccgttatcttcccccctcatatccaccttctacgtggatgtcattgattgcctcctaatgacggttgtgagcgttaaccgacattggcaaccgtcataagcagctactagtttatacctcacgctttgcggcgggatgtgtggatgaatgcatattatacattgtagaaatgatagatatatatatttaaataatgtgaaaaagatatggagataatgatttaacattgcttgtatgacctgtaaaaatataacaaaattctaaatgatatgttatgtttgcatgatattcaaaatactatagataattattgctggtggataatgatgtggtacacttgtatgtgatttaaaatattctaattaataattgttagtgggtgatgacgtggcacacttacatgatgagctttaggagttagtggacatcatctatacatatagtacagataaaggagggaaactctcacttcacaacactcaagaagcaataatagaatagattagtggagtttaggcttagaatagttcttatgtttactagtcttcttaaatattcaggtatgtatttgtaagactacgagctcaataatagaattatcttctttatttaattgtgctcagggattttatgctcggttgtcgatctatgctgcaacattggtccgatgatgttaacgggtcatactagttcttacttgtccatatgtagagtgcgagtcctgaggaaattagtgatattatttagcaatgtaagcatagtgcatagattgattaaatatcgttcgatgtgggtgtgccccacaaaaagtgagataggcggcaggtggtgacagccttgtccgtcctttgtattcctccacatttaggtatgatgtaagatttggtaaatgccataaccatactagcagaccaacaggggatggtctctcggtagtgtctgggtgcatagaactatgtcctagctatatatatgtatatgattgttgtattgactaaacatgataaatatagaagtacatatgaaaccatagctattcattttgtctttctccaatcgctagtttacttattgaggtggttcttctgtgtgtcacgctacctaactattgtcatgattatcatttacccatattagaccatagtatattaactatagcatgattttgaatatatcggcctattcttcatattgttgtcttccctacggaaaaacaaataatgatactaaaaaggtcacttaggcctagagggagggtgaataggctagtttaaaaacataggtaaatgtggaagcaatactttttgaatatatccgaaagtattttcggatattcccaataatcacagagcaaatgaaagtcaaagagaactggatctagctagtcacaagaaagatgagcaagcacaaacaacaactagactagaagcggcacaagcaagcaaatctagagaaaggagtcagagggatatcaccgatgttcttgcaatatgaggtgttcctgaagttcgaatcctgaagggtattctagtctatgttgaggagctcacaaagagtcggatcttcgccaaccctttcctcaagaggttgcacaaagcactcattttttcactagtggtatctcttccctttccgaggtgagattcaactttcacaaacttctccccgccaaccacaagtagatcagtggcttaagaccgatgcctagccctctaggaggcctcaacccctaagagtaaaagtagaagcaagattctcttggggacgaatcaagtcctcagacaaatcttcatgaagtcaacaccaagcacgcacgcaaactcaaatccaacactctctcacacaaatgaaatctaaacatgaagatcggtggagaggaagaagcaaggctgaaagtagatctcaaagagttgcaagctgttggtatttcttgtggtcgccggaaaatccgcaagcgcacggataccgcagtagcatttcacccaagagaattcaaagggtatcgtatttatatttccgtagggaagcggtggtgtaaaggtagagttcatatatccttaatcaagctatatgagtagtgtgacgcacaagagattcatctctaataaagatacactaagcaggggagaaggactaaagagagctaaggttcatatgtacttccatactagtaatgtctagtatacacttaacacatacgtgtttacaaggctaggattttgttcccaggtacctaggtacatatgtgtttacaaggctaggattttgttcctaggtacccaggtacatacgtgttcacaaggctaggatttaattttccgtcatagccggatgtgaagaaatataaaggatggacatggctgtcaccacctgccacccccctcactttccgtgggtcatactcacatctaacaacatttaactaacctaagaaccatgcttatgttaataactaatgttactaattcccaggagactcccaactgtttcgccgaatcatcagtaccacctctctcaaccacatttcactgaggactgatatgtgggcccctaaggcggtgcccggtgatttagtcccactttaggtcggttcaagctaacttttgggcccatcaatccgtctgctcacacgtgaatcgcttgaggtgtgtttctttgggtgtcggctcatttctccttcactttagtttataatctctgcatacatagtatttatccaatacaagttgaactatattatttaattctaatatatgtgcaagaaatgttagttctccgtttgtttattatggcagttcacgatcgaaattggtacttaacgaccatcaccaacaccaccaagctaaacctttgctcatcctcgagtaaaggtaaaacttaggttgttcattaggagttgctactatgttttattccacaatagcactatgcctacaacatatcgttttacctagaatttgaataagttgacaatagtaattttacctctcttaccttactccccatggggcttttagcttatcctcgtcttaggtagttaagagatagaacggatcgtagagtatagatcacttactctttggtttactttatcagtaatgtcggaggaggttaacttttctcaggagaatgatatttgcgcttacatttggggaaatcttaagtactcttctcaaaagttttatgccccaaactttcaggccatgcaaccacctattcatttccattggttatggaagagaaaggccacctcgaaggttaaagtttgatggacaggttgaacacaaaatatatgttgaaccataaacattgcggcccccatgattgtgatatcagttgtgttctttgcccagctcaccccctttagaatctactgcatctctttttttaatgtccctttgcaaagtcatgctgagctgttctaggtatctcttgggacacatctttgagcttggacaacatgttggtgcactgaagaaactgttaccaaggccactgtttcatgtaaaaatttctttatggggattggaatatttggaggcaaaggaatggtttcatcttatgatcataaacccccttccttggcttcatggagacagctatttaagggtgatttccttgtgttgttgcttcgggtgaatgagaaagacaaagatgtagttcttaaatggatctctttgttgtaatttcccttttttatatactttttcttttctaataaaatccttttaacaacaggggctgtgttcctttatttattttctagtcgaagcacctattatttattttctttggaaattttcacatcagcgctccacagcctcttatgagcgtcagattggtgaaaagcactccggtgacaattagaatatgggagcaattgacttttggttgaacaagcttgggagaaaattctttcccacatgtgaaggtctcgggggctgctatggagattatggataccccatacacactcggcctgcttatccaatagattaggacttgggtgtagtgttgccttgtttgctacggcatggcctgtagtcctagttagatacaattaagtaatagttaaggaaattgatgtcgtattcggctaggtttttcctctttgtaactttgcctcctaacctatataaggtggcagagagcccctccaacgatataacacaacttgatcatcagatcaatacaatagccgacggatttaatccttaaaacaagagtagggtattacccctcgtcgagagggctgaacttatctaaatctttgtctcctttactgatccactttagatgtcgtgtactaccgtttttcctatttccgatctagaaaattgacaagtatccgtaaaatcacacggtgtttaactttgttgaggttcatggctaattgtccccctatgtatagtagtgctccctccatctcaaaaatactcaacttaggataacaaatctgaactaccctttgtcgagatttgtctagattcgttgtcggagaggatcacatcttgagttttttttacggagagagtacgtatagtagggggtgttttatatgcaagcaataattgaatggacttgtccatttaaatatcgatgtgacatatgtatgtaaagtcaagagagatgcgtaatcatctgaccaaaagcaaatactacatggttatatatatactttctccgttcataaatataaaccttttttcttacagatttagattgaaagggaaagacttcaatgtgtcccccattaaagagaatgaactaacttctaattggctgaattgacagaaatacttatttacacaaatattatcaaaattaaataatagtggttgggtttgtggaagtagtactgcagaaatattaatatttatgtacaaactttaaacgtcatacatgcttatatctgagggcacgcagaaaatatttaacatgtaatttcttggtgaaccccacgacctagtgtactgagcacaagctggctttgatcagaggcagcacctgtattgtactatagttctctgtcaaacttgcatcacggttatggaataatttgcacatagccgagaggattctgcctgatggagctcggcagttgggcaagcaaggtcgccgccaagtggaggaggctgacactgatgagagctgttgtggtggtacttgaccagatgtcgacgttgggggcgccgggcgataatcgggttggggaaaaggaagcgtggcaagggcgccattgcagatttgcagatataggtttgtaaagtcaagagagtgtaggatcgaatcataagaactaagctaaccagagggggggtgaatggttggcatacccaaaaaccaaaaaattttagcggaaataaaagttaccctcgaaatcgatggagatcggtctgaccgagattgatctgccggtctgaccgagtagatgccgccggtctgaccgcccgtacgctgccggttggaccgccgaaactcggtgaaacacaaatcgaataactcttaaagtggatgacgactttattacttctctctgtgtttacaaagtgcaccaacagcactccttacaaaaattttgactaaactcgaaaccctagctcaaaactcaactctattgctctctaaagcgataccgggaagcctcacgctcccccctctatttatacatgaggtaggcagcctaaagccacgaaccaaactcatactaggagtcctaaacaccttaggaaaccctctagtacaagaaagaaactttacataaccaaacgtaccaaatttggactccttccaaattcgaccccgcatcccatacgcacacaataactccatcgtatgccatatggaatctccatcaaccacgtgcatcaactctagcctaagtatcccgcatgatctctgaccaccacggacatcgtcttatccccaagccgactcccgatccatcacggcaaatactctcccgagacatcgagtcacctacacatggaacaaacaaagaaaccatattccgagaccaagctatctccaacttgactcattagcagcaaacaacagtattacatacgtatagtatccatctagaagtcataatcatgaaataaactcggatatccaaataaacaacccgaaaccgaaactgacacagtgtcggccggtcagaccgcgggccgcgccggtctgaccgcgcaatacacgccggtctgaccggccgcaccggcccggtctaaccggtccacataaattgataaacctgcgattcacctgtgaaatctccaatgcccaattgttcatcacagaataataatcaaaaacacctttgattttacaatctcccccttgatgaacacattggcaaattcataaaaagttttggtgtttggaaaaataaaaaacaaaagtggtaaaaagcacacttcgtacaaatgtacacatcgtgctcaaaaattcaaaagaaaacttctccccctttttaaaagaaagaaattcccaattgaaccaaaaacatgctcttctcaacaactctccaaaaattcatctcgcttctcccaaaaatccaaaaaatttcacattacttctcccccttttgacaatgatttcatcaagcataggaattatgttcattaatgtgaaagagcatagcatacatatagcatctcaagtcacgtgttgcaataaaaagaagatgaacccatctataacagaacaaccatgcattcaagtataaccatgaaccaaagattttacaattaagcttaaatcaacaatcaaaattcatgatttcatgtgatttataatgcaacatcttaacaagcacataggttgaagaataaacactaaacatatatacctattgcatttatcactctttctcaaataacctttagcacaaaataaccaagagaattttttaaccttttcttttcttgagcctttttgctcatatttttctcttttattccgggtacgtccctgtcgtcaagactgtttccagggattcggcacctattattttgctcacattgaatacgtccttgtcgtcaagactgtttccaaggattcggtattcattttttttatattttttattttctttttcacaatgagcaattaaatctatttgaggaataacaagtcaataaagcatatatatagagcatttatagatcaaaccatatgctagcatcaacattgcacattttcttaattcaagtataaaatttaagtgtcatgcatcatctcccttaaaagcaaaaattaaatctcatgaaaagactagaacacatacaagctatgctagagacaaataaaccttcaaagtattgctagcatgcacaagaaaataccatatgcataaacaaagctctcttttatcaattttttcattatcatattattgcttgataaaaccatgaggtacaaactccccctcaaaccatgccaaaaggatgaattacgcccaattcaccacgaagaaaagcaaagcgattagaatccaaaggtttagtgaaaatatcagcaatttgcaacttggtgtccaaaaacagcaactcaacatctcctttctcaacatgatccctcaaaaagtgaaaacgaatatcaatgtgttttgtgcgtgaatgttgaataggattcttagcaatattgatagcactagtattgtcacaaaagaaagttactttctctaaagtaagaccataatctttcaaagtagataaaagccaaagaatctgtgaacaacaactagcagcagcaacagattcagattcagcagttgattgagcaacactagattgtttcctagaagacgatgcaatcaatgatgtaccaagaaaatgacatgttccactagtacttttcataccaattctacaacctccaaaatcagcatcggaatatccactttagcatatagaagatgaa

SEQ ID NO: 67800 - DNA, 8224 bp, Oryza sativa
ctgcagccctctgctctctatagtttgacttagtatgggtttgagcttaccgagttcgggcctagggaggttggagtcatcaaccaatcaatttagttcgattactaggacggcaactactctcctccacgtgaaacatcattaatcgctacaacaccaagttctactgccaccgatatgaagaaagatgcgatgcatcaatcttcgtaacccgcgcgctagaatcaagaaaattactcgagcttggacatcttctcaatagttcattggactattgtcactgatgtcaccgcaggcacctttcccattggtacaaccttcatctctggccaactattgccaaccatgttctttgcttcgggatgagtgacttcgtcttcaccaccggctgcctgctgccaccaacttgtgacctcgccttcacggttggcctactccacgccgcttatgggagacttcgtctccaccaccaattgactctattgccccactgactggtggctttgcctccacgccggttgactccatcgctccactaatgggtgacctcgccttcgccacacaaggtcaacctcaaccgtgacagaaggacaagcgacatgctctggggctcaccagctcaaacatgaggatcacacattcaatcttgacttgttctagatacgtgcaatagtaattcatacccatgagcctatttcctatgcttaaggtatggaccagtcattacaccccacgagggccaccgactgagtacttgtgccagttgagactcagataccacctttatttcactatgccccatgagagataaagataaaccattcggatcagaagacactcagatgagatgcacttggtccatatcaccgaagagatatgtcattcgagagctgacgaaaggagcgatacacgtgtcattttatcttgattttatcgggcatggtgggcctagaggctagtgtgttcgtgacccaataactaccatgcattgtgaattaagcatgtcctactattcattaggtggtgttgttccaacaacccacgtgctatttaccgctttttataaaactcagatgttgattggaaaagacccgattatataatcaatatatcactcgagtcatgttactctagtattcacatcgtatatactgcatcaaggtttaagccactcggctagcgggggtattacatagtcgggagctacaccttttaggttcatctattcgatgcacttgtttattcatttatcgacggagccctccacagtctctttgcaagatatcaaaaaagagaactcaagaaagaagcacttaagaagccttcatagcaaatatgcagtactcagtattggtcataaaccatggaaaaactacaattcgactgtgaaggtctcggggacaaccgtagaagatatgggtactaggtacccacacagcctgtatatccgactacagataagaagtgaactgcatccatgtaataagatatagaataggactcaatcgtcatgctaccttatgccataaggcagggtatagaatcccatctgaatactaccttatatagattaggaaactgaagacttgtctggctaggttttcctctttgtaaccctagcctccaacttaaataaggtgggcagggagccccctcaggggttgaccagacaaaagatccatgagatcaacacaaccaagatcaccatgatcaatacaatccgaaatatccaatccatcaaacataaataaagtattatctctcattgagggggttaatttgaacgtgtctaaactctcgtgtgctacccctttattctccacaacatcgatctttctccacaagcatatatatcgggttaaacatattctccaaagaagaaaataaagccatataatcttatatatatatatatatcttcaggacatattctctacaccatagtgatagactagtttccacactataaaagcacggcaaatatcaccaccatgaactcaaagagccaatagcgccaccaacaaattattgacactacatttgagacaaaaaaaaacacttagacacataattaaccatgtctaccaatgggagcagcgtgatgatcagccctgtggtgcaaggaaagatgcagcagggcgtcatgaacggcatgcaggtaatcacttaaattaaacccggttaatatctagagagaaagattgcatttgacatttcgtatatttgccgtaatttaataaacctaagagattaacgaaccatacatgtttttcttctcaaattagaactctaacatcggcaacagcacgagtgtccctgtgtctggctccagcttcaatggcactgccttcctcagtggcaactatgctaatgcacctgcaccggctcggcaggtaaaagaaaatacagagcgaattcgttcatttgggccaataattttccataaattactgctgtttgtttcatttttaaccgattattaactaattaagtagtgatgttatttcattcaggttccaagtttttctattactggcataggagggaacgcaaccttctaagcagctagcctcagatggcaaaaggaccagcatgcataattaagcttgaacgaacgaatgaattatgtgtgctgcaaccaaataaaaaaccgcttaatagcgtgtttgtaatataatcctatatatgtatgattaaataaaatcatgggcctagctgggactaagctaaaaaggcattttaattgatacatatggattaatggattaatggatgtctcagtgtatgactcagaagatataccttgtttacatactccaaatatgttgttatttcgttgttaaatatacaagtcatttcagattgtgcggatgaataagttgtactagctaacttttcaatgacctttagttatactaaacgaatgtgtgagtgtgaacaatctaagacagattacagaacagataactcctggatataaatgaagtaacttcaaacaaaccatactgtccatacataaaggaaaaggcactaaaaatatgaaataactaggggagaggtgacatttcggataacatattttatttgactgtaagtcgataaagaaaaactacaatgattatacttgttttcttcccataacaaccacaaactgatcagcctttgtattctaaggagaaaagttaaaaaaaaaactcatcaaacaaatacttaagagcctcactatggtgctctctactggtagtagaaaccattgatttcatttcattgatttcatttgatcaaagggtttagatctatttatactactaccctaattagcggtaatagaaatgtggaggggcattattataaaaaaaataggtgcagagggtataatcgtcaagcagtgactataccttttttttcctttttttttggattttttgatgatatatgagcgatgctaacgcaatgaatgatcatatatcaatttagtcgggaaagaacataaataacaaagtaactcctcattattgtaataataaattattaatttaccgctaataatactggtagtataatacgaccagtagagaactctggagcatcgctcaatacttaacgtatgaaacacatgttgcaacaaaggtcgacagaagtgccttttaagtggattataaaaatcatgtcaccattatcatatttcacttccttaggaagataactgagagaggtagacaatttttaaagtatttttctattatctctaagtataggtagtataaattaaactaggaaatatagtaactttcttgaaaaaaaatagtactactacctccgagtacctactcaaaaataccgtgaaattacaaattttcagaagaaaaaattcaatacatagctcataaaacaatgcggtacaagaaaaaaaagcacaaaaaatttccgttttcgactagaagcacatatgccactgatttttcttcgattccgtcgtggttgcagttatgtagtcgagtgtttagccatgagttgacacttacaaataccaatttgcccttgttctatccctatagcatagggaacttggttggctgctctagctccttttcttaattattagttcggtcgtgcttgcaagttgcgaggtgatctccgaaagaaagggtgatgacggcggctgcttctaagagcaagtttaatagtcaatgtaatagccaattcatataatagttgcttactataatattaataccttgtctcacatatcatacacacattatatcttggagtctgtgctacagttggctacagatctatcgctagctgctcttatctctccctttatctatttaaaatatgtttatatagctagattatatcctgctattgtatctgctctgaggcgtcacgcgccgatcgaggaaaagggcgacgatggtggctgcttgcgaggcgccgcggggtggggcgacgacgggtcgacgacgtccgacagtggcgcgcggccgacggcggtggcctccgtctcgaacgtacggcggcggcgacgccacccggagacgaaggacaaattagtgcgagcataaatttatctactctgatctaaacgacgtctagcgttcgtttgctcaaaataggaatggtgtgttaggtatcgaaggaaaatcgatggctggtgtttctagtcgaaagcgaaaactttttatgctattttttggtactaggttattttttatgttatggatcaatttttctttttccacaaagttgcggtagaaattaacttatagaacatcaatgcaagagtctgatggtaattcaaaattagaatgctaaatttattaccgtgagactcttgcataagtcttaagtcttatgcaagacttaagaagagatacaagaaattttaagacttaagttataataagtgtttagaaggattaagtgtgtccactatgtatgaatggcaattgcctagtattgtgctatagaaactaataagttattattataatctagtgtgcatgttactaaacgagatccacaaataattaagacttcaaggtacgtgtacgctagctgatcctaggaacaaatgcacacaccattcactacaagcatatatatcaagatcaacatattcgatctcccaagaagaaaaaatgaaagtcatatatgcaatcttatccaggacaaattctctccacagtaacgatagatgagtttttcgcactataaaagcacacacaaatattaccaccgtgaactcagagagccaagagcgccaccaccaaattaacacacctacaaacactcatacaaaaaaaaaaacactttaaacacataattaaccatgtctcgcaacgggagcagtgttatgatcagtcctgtggtgcaaggcaagttccagcagggcatcatgaacggcatgcaggtaatcaattgattaaacatggtaaataactagagtatatatatcagtgaatttgatagtaatttaattaatccaaggttaatggagcatatttttcttcttaattttgttaatgttagaaccgtgacattggcaacagtacaagtgtccctgtgtctggctccagcttcaatggcacttccttcctcagtggtaactccgtaaatgcaccaccagctccagaggtaaaaataaaatacatatcattttcattcatttaggccaataatttttccataacttacttatgttcgttttattttatttgaggatattaattaattaagtatcgcaattattttattcaggttccaagttactctattacaggcatcggaggagatgcgaccttttaagtgctggcatacaacgccaggagggctacaccaaaataaaaccgcttaacagcgtgttgtaataatcctatatccatgagattgaataaatcatgggcctagctggtagtaagcttaaatggcctgctaatcttctatcttctatctatctatcttctatctatctattatctattatatatactaaaagtccattaaactttctataaacgctctcaagccgccacgtgagactcctaccaacgctcctaggccgccacgtggctctatctaatctaaccgttgattttcacttaaattggtggacccaatattttagaccattagattatattttcacttaaatcggtggacccgatattttaggccattagattagatgtattttattttaaagaaactaatttcttactataattcgtacgtatacaggagaaacatcatacgtacgtacaacgagggaaccaatgaagcttaccaattgttggcgtcagaagaaaaaaaaaactacgcacaaaattactataaaatcaataagaaaaaaaaacatacgtagttagtaccatgcgaaaaaattgatgatatttaaaataggattttctattatttaaagatataaaacattttactctataaatttacgtaaatatcaccattgattttcatttaaattggcagaccctatcgatgttttagaatactagattagatgtacccattataaactaaaagttcattaaactttttaaaaataatcctccatatgacatcctacaaacgttcctaagttggcacgtgatgctctaataaattagtgaattttttaaaatttctaaaacaatttggtgaacacattatttacaaccattagattaattttcaagaaaacatttctctcctatacccaggcccacctaagcctgtatgtataagttaatttttttagaaaaaaaacaagcagacgtatgtacgcctcctcttccttcaattcatatctccacacttttacctattccttctccttttttcatgctttattagttagataagtaataattttgtgttaaacaattaatcttctaaatcatacaactaatgatccacgtaaatctctagattatttataactaaatttatggttgaagaccatatttcactattatttagcttaaaaaaaatatcattttggtttatattttctgacttttgcgtaccattcaagcaactaaaaaaatatataataataataatacagattttttcatcatacataacttcgtaataattaaaataggtcgacaatcgtaaaagaaaaatgaatatattatgagtaatatctccaaagtatgttagttaggtagtaaaacttatgtaaaaaataagcaactataacatctaaatcaaacaactagtatttgatcaacttatgtctttagattgttttacatttaaagacccatatccactgtaatatcaactttgagaagaaatatgtcactttggggctatattttctaatttttgtgtgcttttcgaacaattataaaattatagaaagataattacatagaatttatcaccatatatgacttcggaataattaaatttgatctatatggaaaaaagtatgttttaaaaactactcccccagtataacattagaataagtcaaaaaaacattattacaatataacattattagattgtagtgttcgtatttttaatatctactgtgaatatactggaaaagacaagcaaaaaagatatattttaatcaatcaatagaaactaagacactacaaccccgtaaaaggaaatattacaattatatgcacgcgtaatctcttcccttaaactctctcttcctctcatctctcatttaattcctttatctcctaatttttaactaagtaaaaaaagatcaataattagaaagctaaatgattataattattaagttcaataataattttcacttatttgaatttttgttttatttataattaaatagataatttaaaatccatgttacccatatttcactctataaaaatgaaaatacatcatttaacatagacaccgttcctttgcatcgtagccaaatagaaaaaagacaacataatacaaaatgaaaataagtattatattaccataaatcattgtacatcctctgagcgcacttaagacgtcacgtgttacgccttaaataaaaataaaactttacgaattggaagaaaaaccatctgaccatcagtttccactcaaataggtagatccatcagatatacttttaggaaaatcttaagccgccatgtgttacgtcttaatcattagataaaatagaaaaaaccacccctccacttcaccctcccctacacatactcacaacacgacactactcgtcccatcc

SEQ ID NO: 67801 - DNA, 9688 bp, Oryza sativa
  unsure (1)..(9688): unsure at all n locations
cctttgggacaaatgattgggtctttggaattcctttgaaattcctattggaatggcatgtttcatgggaatcgtggaggactcctagcatgagctccaagctcttggaatttttttctcaatgtctacctctctcttctgaatcctatgtttttcctatgctccatccaaagcggttttattgtgtagttttctcatgtttttcattccttagctacgatgacatttaaatcctgcattttcctattcccgtgtttagagaatcctatgtttcaaaggagccctaaattgaatttcaaatattctaaaccttaggaatttttcctacatgtgttgttaggaacaaaggatttgagcatgcaaaattcctatggattgctatccaatgcaccaattccataggaaattttaccgtgagttcatcattcttaaatccgtgtcattcaactgtgcatatgaattaattgtagcttaatgacttttcaataactttcatttataggagaggggggggggttgatgtactacatactattcaaatgtgtgaagctctacattgattagtgtaaacaatccgagataaatttcataaccctaacaactaatggcccctttgaatcaaatgattgagaaaatggaggaatataaaaaacatagaattctgattgaattctactgcaaaacagaggaatgttaaatgcagaaaaaaatacaggaatgattatttgattgagacacaggaaaaacttaggaattaaatgagaaagataggctcataggaaactttctatgagggtagatctcatgttaaaaatcctccaaaacttgtatggattgaggcatttcttaggaatttcataggattcaataatttttaatcctttgttacaaacggctatataggaaaaaattaaataggatcagaatcctacaaaatttctatgtttttcctttaaagcgaaggccctaactcttgtatatatatgtaaacaaagagacttcaaacacaccatacatttaggaaaaggcagttagtcctaaaactatatatatatagactacgggagatttgacagtgaaataacatacatatattttatttgacttaagtcagtcaaaataaagtagaaacagtaatatcttttccatagcaacttaggccctgtttgtttcagcttaagattattgtaatctaaattattaagccagattaatataagctggattataaaaagccgacatagaataagttgttaactgtttgtttctctagattattagttgtatgttagccgttagccacccaatattctagaaaatgcacctttacagtggattaccagattatattaatctgacttatagattgtaataatttagcataataagctatctgtttgtttcagcttactcataataatccagattataataattctaagctgaatcaaataggtccttaaaaggtgagcacaacacaccataaaatatatctcgatagcgtattatttcatattttaaatgtccacatatctttctacaaacttaatcaaagttttgaaaaaaaaacatgacttatttctataaatttagacaaagtttagaaatttggcttatgacaaaaattaaaacaccttagaatatagaacggaagggtgtacatgttgctaaatgagaccggtaagacttcgacagttacactatagctaatcacgcacaccattcactacaagcatatatatatatatatatatatatatatatatatatatccggttcaacatattctcccaataagaatataagccatataaccctatccaggacaaattctctagtacaaacgtagtataatagatgagttttcaacgctatatataaaagcacggccaatatcacacaaccatgaactaaaagaacctagagtgggaacaaaattgacgcgtaattaaccatgtctggcaacgtgagtatcgtgatgatgcacaacgttgcaaggccaataccagcagcgcgtcatcgatcatgagagacatgcagataatcaatcaatgaaaaccctggtaaatatatatctagaggggggagaaagacagatagaatttaacacgtgtatctgtagtactaatttaattaatctataaaatccgcattagtcagattgtccctaactccttatatgtccgtcacatgcttccacagcactttcttgttcagtggcaactctgtcaatactccaatatacaccactggctcgggaggtaaaagaaatacatttatttaggcctcaagttactgctgtttgttgttttattttattttaaccgaagttattaataaccaatgcaactagtgtccaaacgtttcattgaaagctatgtcctctcccttgctgagattaagcaacacccccaagcaagtcctgagaaggggaaacatgttgtggatgtggttcaaaagaagtcgcacagcatcaaacggagtcgagaacctgttcctgacaaatggtcgaagccactcccaggaagcatgaaactgaatgttgatggctcattccaggagagtgacggcaagggtggtataggcgctgtgttgcgcaattgcacaggagaggttatttttgctgcttgtggacatgttgatcgctgtagcagtgctttggaaacggaactccttgcctgcagggatggtcttgccctcgccctacaatggaccctgctaccaatagtgattgagacagactgcttggcgatgatccatcttttccgcgatgcaacaggtgctaaatcggagctggcgtttttagtcagggagatagattctctcttggtgggaaatagggatattagcttcagtaagtgtcttagaagtcaaaatcatattagccactatttagcaaataagggccgttgtgacaagatcacacagttttggccggacaataagtgtacttttatctcgcagtttatctgtgaggaggctaatgagtaattatccctttcccctgaaaaaaaaaactactccctccgttacataatataaatgattttggatggatgtgaactaggatctataatattatatttataggacagagagagtaatcaagtactgctattattacatttaggttcgaagttactattctatatataactggcaacggaggaaacgagctgtcaaatgcagaatgatgaatgagcttagacagacgaacgaattgatgaactattagtggctacacccaaataaaatcgctaaacagcatgtttgtaataatcatgtatgcctgtaattgaataaaatcacaggcctgttgattaattgattcattatggattaatggacgcctaagtgtatgactctaaagaaatatattcatcgcatatatacttgaaggtcccgttcttttttttaacaagagttagatgaagattatgattttttggcacgctttttaaattgctaaacggtgcatttcgtgcgaaaactttctatataaaagttgctctaaaatatcatattaatctatttttcaagtttgtaataattaaaactcaatcaatcatacgttaataccacctcgttttgcgtaaaaaaaacttaatcttcatctttagaagaaaagaacaccacccaaatacacacacaggcaaaagtgcccgtgcgttgcaccgggtgattacaaagtgtacagtgaacaaaaagtgttgtttggtttagacatctaatctggtaaaaaattgtttgtttttagataaataatctgctttatatttgcggaatatacattatgtttagtttggatgatttgtagcatgggagaaaatggatggatgaacaatgcacgtgcagaaaaaatagattatttatttggagttagtacattttttttaagaaaaaattcatgtgcgttgcaacgggaaagatttaaaagaacaaatgaaatttggaattaaaaatataaagaatattgaaagatgggtttagagttcatatagaaataatatttagaaataatagaaaggaattaaaaatataaggaatattgaaagatgggtttagagttcatatagaaataatatttagaaataatagaaattataatttacattggatgagaagtctagaatattctcaaaagaaggtagagtgcatataggaatacaatttagaaaaagaattgaaattcgaaataaaaaagaatattttttgaaaataaacagtcataaacaattaaaatggtattaatgctatttctgaaaattacaaaaatacttaaaatcaataagagagaaaacttatttaagctcggcccaatagagcggccttctgtgcttcgcacgtgcggtcggcccataggatggcccaaaagcacggcggcctaaaacgtcgcccggcctgacgtgggagaagcatggaccgtccgatctgatggatagtctcgattagtcctgacctagataaataccatactctctcgtaaagcaacggtggcggcggcgactattccaacgggcgacgacggcagcggccttccccaccgagcagcgacgacgacatccttctcccccgcaagcgggcagcggtgccctgccctcctgcaagtggcggtggtggtggcgccgttccatctccccactgcaggctccttctctcctcgtcaagcggtggccgccgcctcgctcctcgccagatccggcgggtcgacggctctccaatggcgtggcgctcgggatttggctcctccctctccctctcggcatccagcgcaacgatggattggcagcttcttagcagcgcgatggcacagcggatccctagcgcagcgtcggtcatcggttcagaatctagccccccgagtttgcgacctccactgcagcgaggtggcgagaatcagcacgcgacggcctcatcttgtgttaatatttttttatgttctttgatttcgatttatatttggactgtaattttgtttttatttgggttgtgatgatttgacttttcaaacaatattttactattcattttattcaattgtgtaaataagcaaaagcataagtcatactaaaaatatctttaatgataaaatcctaataattgagctgagtcagccgagcgggtggggcccacgcgagtagataaggatcgatctcgatccatccagtcgccgccccctccccatctctcccagccctccgcccctcagccccctctccccacttccctcctgctccgtccccctctctgagccggccggccggcaacttccctccccctccaccccctctcctagtcggccggccgtttccctccggcgagcagcgacgcatgcggcttctccccttctctcagcttccccacttctccccccactatctctccacttctcccccctctctctctctctgcggcggcggcaagaggggcggcgatgccctcccctccgctagatcggggagaggggaggtgcggcggcggtggcggcggacgtcatggagggggcgggttggacggcgtggaggcggccggctgggcctcgcctccgccagatccagcggcgtggaggcggctgcggcccggcgggggcgggaggggcggcgggccagcggaccggaccttgcctccgccagatccgacggggacgggagaggcggcgtcgtcatctctttctctctctctctctctctctctctgcatggtggggaggtgcggcggcggtggcggcggatgtcatggaggccgcgggtcggacggcgtggaggcggctggccgggcctcgcctccgccagaaccggcggcatggaggcggcggcatggaggcgggaggggcggcggcatggaggcggagatgtcgtctctttctctatctctgtgcatggtaccggtggaggttcatgtgttcttggttgaaagtttgttatgtgtgttattgatggaatgtttcatgtgtgttcttgatgaatttcgactggaatttttcctttggggaggggggcggactaaaaatccccgcatttggttgtgccgattttgggaattgtttcccttgtatccgattgtgagagggattggggattttgggaattgtttcccttgcatccgattgtgagagggattggagggattgggaatcgggggctgcgggcgaaggtgcaccgcgagggacgaaggcgcccttcgtccgacttgtgacgaccggaaaaatccgaatagttatattatatatatatatatatatatttcatcttcaatgatataggatattaagctctaattgtagccaagttacttttcaataaccttcatttttactacttggatatggattgatggttttcgttggattaaagcctcccacgacctccattttaccgaaataacatgttatggagagatttttgaaagttacatacaagttacactatagttacagtgtaattacatgcaagttacagtgtaattacactacgattgtactgtaattacatctgtcaaatttttggggaaaaatttgtcgacaaatatatagcaaaatcgttttctctttaccaaatcgttttcggaggagtttgaaccagttcgcacaaaaaatcatacatttgtgtgttcgaaaggagccctattcttggatgaaatattttattaagtaaatttcagaaatctaaatgtactttgatcaaattattagaaagctaccgatttaacactaaatctatcatacaactacatatttaaggtgaaataccacaaaactatatatttagtaacaaaattatcacaaaattaaaggtttatcgataaattaataaaaaaattgaacaattataagtccaacataacattagtgctaaggatttaaaccgcaaaatctatagatttgtgataattttattattaaatcagtagttttgtgataattagccttaaacttgtagttttgtgataaatttattattaaatttatagttatgtgatacatcactttaaatatatagttttgtgataatttgatccaagtatccgtaattttgtgaaatttactctattttatttcttccctagaagaatccattggcttgtttagccgaaatgctaatggttaaacgtttgagggtagcgaatgttccctccaatctagatatgttgtacgcgatgacgatgacatgtttccccttggccaaacgagtttttcccctttgtccctctgccaattgaaaatagggatctatattgtcaaaaactcgctgtctgtataaaaacacgattcatagcttattcgccatttgttagtacaaaataaattaactaataaaattgttacaagcggaaaaaaaaccttcttgccctagcccacttgcatctctaaattaaacccgttgcaacgcacaagcgtctcactagtgcttgtaaaaattgaagcgattgtacacacatcatgcggagaaagatgcacgagggaaccgaagggtgataaggtttgtgtttggatggtgcccttgtctgaatgctctagctgaggctagaaattaaacggctgagaacgatgcctaaggtggtgtttggatccagggacttaactttagtccctctatttagacactaatttagattattaaatatagactacttacaaaactaattacataaatgaaagctaattcgcgtgacaaattttttaagcctaattaatccataattagagaatgtttactgtagcatcacataggctaatcatggattaattaggctcaatagattcgtctcgcgaattagtccaagatttaatagtctacgtttaatatttataattaattttcaaacatccgatgtgatagggacttaaaagttttagtcccatctaaacagggtctaaattaagcgagattctcagagcatatgatccaaagaggtgctgaatctttgacatttaagaaactgtgtgtattacagctagtgcaaaacaataattgagttgaatttcaatatttcatctataattttttttcaaatttctggtttgttttttatttgacatgattagaatcattaattttgacaataatatatataattagtgtacagatggctacttttccatgtgtttccattaacaggtcttagcagcttggcccctgatagattttattgaatcacacacatataggattacatatacacgccattaagcggtttttatttgggtatattatatagtacatgtaatcgattcattcgtttgtaatttgttctttgaagctcttgtcggtattctcttgccctcgctgggttaaaaggttgcgtttcctcttatgccagtaatggaataagttggcatctgcatgtaataacatcagtaatcttttgttaataacctcgattaaaattaaaaagaaatacagtctatctccgttttttaatatatgacgccgtgttgactttttaacaaacgtttaaccattcgtctaattcaaaatttttgtgcaaatataaaaaaagtttaagtcatacttaaagaacatttgacgataaatcaagttataataaaataaataataattactaagatgaatgatcaaacatattttaaaagataaacggcgtcatatattaagaaatggagggagtagtaattaacttgcagaaaaattattggcctaagtaaaaggtatatggaccttttttctttacctgcggcggcgttggcgcattaacagagttgccactgagaaatgaggtcccattgaagcatgagccactcacagggacactggtactgttgcctatgttgtggttctagcaaacatagttgaggaggacacatcatgatccactaatatcatatattaatttaactacgtactgtaagtatatatgccaaatactttctnntctcgtaataagagattttagagggatgtaatatattatagtccaatctggatgggctctccatccagatttagagcccctttgaatcgtaggaatgaaaaaacagaggaataggaaaaacacaggattctggtaggaatacaattgtaaaacagaggattgcaaaacacaggaaaaacacagaaatggccatttgattggaccacagaaaaaacacaggaatcagatgagagagatacatggcagaggatatgttccaagaggttagacctcttgctaactttcctccaaaatgtgcataggattacccattccttaggaattttgaaggattggataggattcaatcctttatttcaaaggccttcataggatttttttccataggattgaaatccaccaaaattcctacatttttttctacaaatcaaaggggcccttataatattaggatgtgtcacattctttcaaaaccctttattttatgtgacagagggagtagtattagtcatatatgcaacatttaatatatatgttgattacctgcatgttgttcatgatgtccgtctgctccttgccttgcaccactgggctgatcatcacactgctcccattgtaagacatggttaattatgtgtcaagtgttctcttttggtctcttctatctgtagtgtttaatttgcaggtgtggcactcttggttctttgagtttacagtggtaacattggccatgcttttatagtgtggaaaaaaaaagcatatatcatagtggtggtagagaatttatcctggatac

SEQ ID NO: 67802 - DNA, 10079 bp, Oryza sativa
aagcgctctgggccgttcacttggacggaggaagctgaacatgcccttactcagttaaaggcatatctcagctctcccccggttctagtcgccccggagccaaatgagcccctgctactttacttagcggcgaccccccaagtagttagtgcagcgttggttgtggagcgcgatgaagacaatcctcattccgcgcacccccaccctgtgccgacttggcccgggagcaagcagggaggaaaggtccccgagtcgaacggtggcctaaggcccctgacgaccggagtcggccctctgcccgcttgtcaaacggtgctgggtgcccccgaccctcaggaaggccccgaggccactgagggaaggccgcacttatcgccctttggccccgaggctaaccctgtgctgactcgacccgggagagagcagggagaagaggcccccgagccgaaaggaggcctgaggcccctgacgaccggagctggccctttgcccgcttgtccgatgacgccaggagcccccgacccccaggacggccccgaggccactgtgggaaggccgctcctgtcgtcctccgaccccgaggtcatcggcacagaagacgagtgcgccccgaggggccacctggacgaagaacgccccgggggtacggcccctagcgaagaggatcggccccgccgaaaggtacagcggcctgtctactttgttagtgaggccctccgggacgccaagacccgatacccacaggcccagaagatgctttacgctattctgatggcctcgaagatactgcgccattatttccaggcgcatcgggtcactgtggttacgtcttaccccctcggtcaaatcttgcataatcgagagggtacaggacgagtggtaaaatggcaatcgagctttctgagttcgatctgcactttgaaccacgccacgctatcaagagccaggccctcgccgattttgtggcagagtggaccccggctccagagaccgtctcaatacccgaggccagcacgaacccctctcagctgcctcacaccgcccactgggtgatgcagttcgacggttctctgtctctccagggcgccggtgcgggggtcatgttgacctctccaaacggagacgtcctcagatacttggtccgtctcgactttcgagcgactaataatatggcagagtacgagggactccttgccggactcagggtggcagctggactggggatccgccgcctcttggtgttaggcgactcccagctggtcgttaaccaggtctgtaaggaataccggtgctctgacccacagatgaacgcttatgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccaatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgttggtagaagggaccctctatcggcgcgcggctaacggaatcctcctgaagtgcattcctcaggaacaaggagttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaggcaaatccatcagccggcccaggccctgcagatcataccactatcatggccatttgctgtctgggggcttgatatcctgggaccgttcaaacgggccccgggcgggtttgagtatctgtatgttgcgatcgacaagttcactaagtggcccgaggcttatccggttatcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgtgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggaggggggggtcgggtgtcaggttttggctcaggccaaccccgcacccccctcgggtgtgcagggttggccgggggctaccacacatgcattacattcttatttctcttttttcaacatttcaatagaagcagtttcaatttcctaaaggttgtgtctgtgctgttctttccttttgaagaatcttgacttaaaataaggtcactcgtactcaaccttgccctcgggggttcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatggcacagatcatcctcatcgcgtatgtatagcaaaataaaactaacacaaaaattttttcatcatttctgattgcagattaagttaatttgtacaaaaaagaggcatgaaggccttagaagaaagaaaaagaaaaaagttaagattggcgggggcctgggggctcattctgacgcgcccagttcgccggcctcgttgccaccgtcgcttgcactgctggcgttccccccctcgtcggagtcgggggcgaacgcgagccgaggggccgagccctcgaagccgttgacaatgtggtcggcagcatccccgacccgcgcgcgcgcgtcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgtcgggcccaatctcgcccgccaagcgaagggcctcggcctccccggtggaggagtctagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcacaggcggcctcgtgcgccgccagcgtcgcctcccggagagtagcggcggcctcgcggcccgtcaagcctttctccacggcgccggcgtgttcttccagcgccatagcacgggcctcaagggactcctcgcgccgccgggacgccgcctcagtctctgttacccgccgctctcaagcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgggctttacggcccacctccaccatggcgtccaccgagcgccgcccctcctcaacgcgtgcccatgcggcctcgagctccgctcgttccgcgcgcagggcctccacttgggcgctaaacccatccagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgctgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctgacttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcctagcatcactatctcccgaccggtggcggactccggcatgaagcggcgcggcagtccggcgtgcctctcgctcacgatgcgggaaggcggtagtacactgccatcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgaccgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacaccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcaccggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagaagggactttttccctagaacaagggaggggaaaggaagtgaatcctttgtaacttgtccatacacaaatccacaaaaacacaggagtagggtattacgcttcgcagcggcctgaacctgtatacatcgccgtgtctcgtgtgtcttgcgggcgggtgatctttccacatacagagagagagagagcttgggattgcaccctaagcccctggtcgaaccggcaaaggggggcttgcgcagtctcccggtgaggggccacgagctccgtcaaacataaatatggtattttttacgtttagttgttcttattgagacgagcatcttcgccccatctttattttaattctgcatccgccactgcaccgtggcacaacacaaggagcagaggcgcgcaagaaaattgctgagaaaagtcacatgacatcatgaattttggcgagacctagaccatccaaagtgaataaaacttattggtacttttagaagcctgaaaactagatacaattaaaattaatatagttgtgtaccactgtatcccgatggatttgaactagttcggcatcaacctagagatccagacttgcggtaagttctatttgttaaacaaattttcaaaaatgtctaaaatgtaaaaaaaaaatcttgccacgctgcatatgtgctgaatattggcttgctaaacacgacgcttccatggacgcgggtgacgcggcttcctcgccaactgtaccggatgcgttcggtcgcggcacgttggctttgcgtgttgtcgagttcccacatgctatcgcccaataaaacccacctcgtcctcgtgtccattcgtcctcatcccacaaacccctgagcgagcgacccaccacaccagtaaccataattaacctcttcctcactgactgcacctgctctgtcacaccattcatgcccgtgatatcctggctccacgagctctgctcccccacctgctgcctcggcgcgccgtcgtcccctcctcatccccccgccgactccgacgccaagaaagacgacgcgatggccgccgccgccgataacgaggtggccgtcatcacccaccgcaccgtcgacgccaacggcctgcggatgcacgtcgcggaggccggcccgcccggcgcgcccccggtgctgctcctccacgggttcccgcaggtgtggtacgcctggcgccaccagatgcgcgcgctcgccgacgcagggtaccgcgccgtggcgcccgacctgcgcgggtacggcgactccgacgcgcccgccgccgagctgcagtacacggcgatgcacgtcgtgggcgacctggtggcgctcctcgacgccgtggtcggcgcggggaagccggtgttcgtggtggcgcacgactggggcgcgctcacggcgtggaacctgtgcctgttccgccccgacagggtgagggcgctcgtctccctcagtgtcgcgttcaccccacggagccccgcgaggaggcccgtcgacggcctgagggcgctctacggcgacgactactacatctgccggatccaggtacacaatacaacaaacaccttgcgatctttccataaatcgcagatagcttgaccgatcgattgatttcaggagcctggagcgatcgaagctgagttcgcacggctcggcacggagctggtgctgaggaagttcttggcttaccggatctcttggcccgctgatgatgccaaaaagcgggtgggggtcgccggacgaagaggtgcctttcccaagttggataacaaggagggccttcaggttatcgcgagccagttcgacaagactaatttctaccggagggtttactactaccgcgccctcaacaagtaagccatatcccctactacttgttggaaatatattatcaggctttgttcaaaagatgttcgatttggctgtgtcgtagggcagaggctagggatataaacgctttgatttggagtcaatttttccccaagtaaaattttagtc

SEQ ID NO: 67803 - DNA, 2023 bp, Oryza sativa
atagaaatctagtatggtctctatattttagaacgaagtagtatttagaaattaatggaggtagcattatagaagtcacttcttgtgtatccaacagttagctgtcagtgtcatgtaatttgtcttggaatgtttacagtaaagagcaaaggaggagctgctgcaatgggaggagctgttttgaccatggctcgtaggcctgattctatggccattcttgctcttatagttgcagttaccatcgcgataactatcgtcgtgcgcctatatgttcctctgcaagcaacatgatcttcagatgaacccacggtaagttcgcaaaacgcaacagagttcttctctgatcacttcaaattctaagctgtatgtatggaaaatcgacagagttgaattgtataagacgggaaaaggcctactagtatgagttctactagttcatttcctagcctgaatgccaggtgtatgatgaaatagcaaggcctggtaccaagaggcaaaagaagataagaggttcagattaatagtttttctcctaagtggtagattgctagtctttcttttctgtagggtacgtcactgcttcagtgctgaagaacatcacaaaggttgtgacagggcaaccggcaacaaaactatgttgaaattgtgatgaacaacatggcagtttatcttaattattcttctctcttatcattatatatcacccttgttagtaatctgtagtttatcctctactctggaaatgaatcaataatctaagattagccgattattctacagtttctgtgtttgctgccaaaacagctaacaactgatgaacaagaaaagttattatggttcaaatactcaacagcacctgctttgacaaggcatatactcactgttgtgatgtcttgacatcaacgttgtggcatcttttttcccacctatttgatactgactggatgtcaattaattgttactggacgtcagtgttgtggaatctttattactagtattttcttccatcgtgctagactttgatgaagtgtttttactggatgtcaattcttgacagccaaatgttatcctaagtcctaactaatcttaactctccaagtaaatgcaagaaaacatcaaaacacttacaaatctaactacaatcttccagcctttgttgtgaattgtgatagattctcacaaaaataatttgaacagacgggatcttagaaaaacatatagctcacgacaggaataataacaatggtgtgaaatagacgacacgttccatgagcaaaagctttaaaacatagggaatgttgatctttttgtgggttgtgacttgataatttgcttttgcaaatctcttgccttttactggacgaaagcttgtggtcttttacaatgtcaaacccaatcaaaggtgtaaaataataagagccagcaaatgtaataattcatcatgttcacaatatagataggaattaaaaaaaacatctataaccaagtcactcgcatcataatatatatgccttttttttttgttgaaacaattcattgaagtacatacaccaaaacaataatgaatatgaaacactgctagagcattagagatttgctgcataaaaatgcagaatcagcacccgttcatcctcaatcacaactctaatgaaccttaccaatgtcatgcagcgcattctgggtggcacagactcctaatagctcttgcagcttcaagcagccaaaccagctatcctttttttcttacatggatatgcacatcgagctcttgtataatacattaaatatttaaaaaatataaacttaacatataacttaaaacaagtgatctaacaaatgcagtggagaatatatatttcaatccgtggagtaaataatccatttcaacaatcccaccatgaataatatgaaaactaacagggtcttatatcttcttgcttgaattccaaataacatagtactgctctttatagagagccaactaaacaactccattctaatttcatggaatggaaacaaccaa

SEQ ID NO: 67804 - DNA, 15798 bp, Oryza sativa
aaatcttgtttttttttaatataaccattatttacaatgagatgtcagattacgtaacatagttgacacttgactgcaatggcataaaagaaatcatctcaatataacaattctcttacgtaacgatatagggggaggggaaaaaaggaatgtataactaggagtaagaagttgattgcacgctgatatgctaacgttcataaagagttttttggttttttttaagataatgaataacctggcagctgcatcaaagacgtacataggccatcatgcattactgtgcaccaagcaaagacagaaaaaattaacgttcataaagatacatcatacgagtattaaacgttgagtgggaggcttggtggacctagcattatataatggctagtacatgaaaaaaaaggttgttgattaggggaagaaatcagcttagtacctgagttagttcatcatcatcgattgtattttgagcgctgcttgattaggatagtccttaagtgcctcttcaataacagccttgctgtcatcatcaaaggaataaatggttgcatgccgaagggagtagagattctccaaacctaaatcatttaagccacccctccttagtctggtccaaatagaaagataaagcctttcaaggtggggcatagctcctggttgaaacgatggcatcatggagctataaaactgaaaatcttttaaactccgaaatgcacatgcacctctgtggatagtgagcttttcctgtagttgttccgaaacaaatgctaactgtagcctgagaaagcgaagagatggaagctcagcgaggcgatcaaggtggtcagactggagatattcgaaatccagacaaatggataaggtggtgaggtgggagagcatcaatgaattgatccaacatgggaatgctttcataaacgaatcgggcatgaacaacctttggagaccggaaggaacctgttgcatgtctatgatttcttcaaaactaatattatttctcaaatctaggtcttgcaaattggtgagcctttgtatagacgtttgaatggattcctttaactcaaatgttttttcactaccgaaaacgatcctaagagtccttagctctgtcaaattaccaatctcttttattacctttcgggtagcttctattacaagctcctgtaaagatttcatattccccagcatcagaccttgcgccagcttcactctgccagcatatagccgcaacagtttccttagtttggcaaaagacattggaaacagtaccttatgagatttaaaagaacttggtttacgtgcacctcttatgtccaaggtttcgagagattccagtttcccaatgctttcagggagctcagtggcactatagtgccctagacgcagaaatcttaggaggcgtagcttatcgagatgattaagatggttcttgtccattccactgcagtcctcaagctgcaacacacgcaggacatgaaagctcgacaagggtggtatcgagtcgaccttgccgaagatagtaatggaccttactttggacaattgttctcttgcttctggtgaggcataggatttattgctgttatggagagataatcggcgaatcttcttcttttgtgctgtacatgtatgtttacctgtttgttgaccatctgataaatacgttgtaacaaaatcttcttctactgacagctgatttattagctcaagcaccatgtcatgtactttgcatgcatgcaccttaccatcttcatcccaaaaaacatgcaccttaccatcttcatcccaaaaattgtcctcactcatcggctggatcaagcttcgattgatgagctcgttgaagtagctctctccaatctcctgcaagcttgtccctacaggtcgtgtttcatctgtaataaaaccctcagctaaccaaccccatatcaaaacatcttttctaattagttcatcctcaggatatttgcttagagacaacaagcaagtcttcaaatgaaaaggtagatcgttgtaactgaggcttaatatcttccgcatcttgtccacatcaaggttgttctcaagccccaaactgatagacttattgaccttgtcccattcctctgaattccttggtttgctagcaagtaggcatgctgtagtgatgattgctagcggtacaccaccacatttcttcaaaattttctcagtgacaccacacaaatcagcaggacagtcatcgttagagtcaaatattcgtttgcagaacaattgtctggaatcatcatcagataagggtttcatttcataaacaccactgcctgcatgttctgcaacgaccttgtttcgcgtggttacaattattttgctaccaagtttagcatcttgcacagcaagtttgatagtatcccacgctgattttttccatacatcatcaatcacgcacaagaacctaaagatggtagcatatacacatgttattgaacctagatataaatcatgtgaagcctgtccaaaaaagataggaatatgtatcttgcacattgaatatcgaaaatgatgtgcagctttaaatgtgtaattttccaacaattttgacacaataagtgcagctttgtgaatttctattcacaaagttacaaagatacttaattatgcgtaaatagggcagatttctgaataactatgtgttccattggaaaaccaaaactttatttacaagccagttatattataatagtataaaaacttgagctaggattcccggttatattagaatacaataaaaacttgagccaggactcttattcgtacaacaaaaggtatcttcaaataatgataaaaggtaggtataacatagaaatgtaccttctattgttgaggaagtctctaattttgtcgatgagctgcttcgtttcccatgtttcatctatgtgggaatacattttctcatcaagttggagaagaatgttcttgagaatcttgtttatatcaggattcaaggacaccgaaacaaaacaatagctgtcaaattttgccttaagctcctgaaataatgaattggcaagagttgtctttcctaagcctccgaatccaacaatagaaattatatttgattgttggctggatgagccgtcatattccaagagttgcttagttagctcattttttggcttgctaatgccaatgagttctgtcgcctttcggtacatagcttctaggcgagaatcaacatccacaacagttggcctggcagcattgtcgtcgactatgtacctatcacgacgttcgctgaccttcttgacctggtccatgatgtctttcatgacaccgtggatctgatggttggttttgaacttgttgaacaaattggtgaccttcttgaagctcgtggcaggttcatgccccttgcactttaacatgaaggtgtcgatggcatcctcgatgtcgtaagatagctctctcacctcgctggcccagatcttgacctgctggtcaagttgatccacaggtgtctcagccaccttgtggagtgctgcggtcatacctttcaactctttctcaagttcttcgatctctcccttgacacccttttgcagcttgtattcgccaaccagcagctccccaagcttggggaggagggtgttcattgcccctgtggcgatgttcatcttggcctatctgatgttgaatgcctgcacgggtacacacagatgcacttaaatgagcctcttgagtttattagtatgtatcaggattcaggaatgatcaagcaaccgcaaaaacatggagaaaaacgacatctgaataattaagctgctatgtagcatgtcaaatcgagactagattgaggtaacaaccgtgtgctgcatcacctaatcgatccaagcaaagctcatcaccgtgagcagcgcaagatagcgacctctcaacgctgtacggtatactagtaacaggaaggaccaagcaacgacgcccaaacacacatggagaaaatcagcatctggatcaaccgggccgtaccggaatcggaggtcgatcgggacagtggatgcggtcgcgccgtcgctggctccgctccgctccgccccgcccttgctgcgccgcgaatcgggtccgccgccactcagccacgtcgcccgcgatcgatcgatgccgtggtggaagcggccggcggcgagagtaggggagctcgggtcaacgggtgggagacctggagtcaagcttgctccagccgaagaggatagaataatgagaggataaccaacggactccgcttcagtgacttagctaaggcaagtcacagcgtgacataccatgtatctcggccgtccaaaacgaatccaatggagatggcgcttggtcccgcacgcaggcaaaaaaaaatctccgtttcggcctaacaggaagcccgcacgcgcacaggacgcgcttaacctcgccctcgtccgcgtacaccggcgcagcctgagacggactcaacttcgcctcgccctcaggtccgcgtacgccggcgcttcatctcgccctcgtccggccgccgccgcgagtcagctgggaggcgcgtcgctgcgaccggagaggcaccaggctgccctgccctgccgccgcgaccgggggcgcgtggaggcggccggccgccgggcctgacggcgcggtggtgcaggcgggcagccgcgcagcccgagcccggcgcgtggaggaggccgcgctgctcctgccgcgccacacgtcccgatttcggcggcctcaactccacgatggatttcagcgtccgagcccgcatccagagcccgcaccagtcggccgcccacttcgtcgccggcgagaggtgacaccgccgcccggcttcgtccaaggtaggagtcactggtggttgagtttgtggagaacgacgcaccttttcctgtgcccgcgaggtgtttgtggaaatgacctgccgtctgggatgatgcagagtcctgattgaaagtgaattgttattgtttggctttgtgagattagaagcaaattgattctgtaatctttgattgagattgatttggttgtatgactcatatatgctgtaatttgaatgaatgaatgaataaatcagtaacttctgacgatgttttctaaaaaattttgagatgtttgagatgttgcccaggtccatgatttgttcaggtttaaagtctggaatggacttatagtattgtctggtttatactggacatgagttgtgctgccatttcctccttttcgctatctctgctgtaaatttttagttcatgctaggtgggaggttccatgtcttgttatgatcagttgtcctatgcagcaatgttgctctgaatctctctctctgaagatgctgaatggagtgccgtcgttactgtagtgctatcgtgaaatttcatggtcagtagttcctgtgcatggtcgccctgatcaatagtgggtaggacatctttggagctgtttttatgcgagattcctgcaaaattcctagtacaaattcatgcgttgcaaacaagcccgtatgtctccttcatttcttgatacgatagggatggattgtgttttggttgacaaaatccaaagagagcaattttgtgcatgaaatgagaatgccagaatggggctgttgctttgagcgatctgatatccatcgtggagttgaggccgccgaaatcgggacgtgcggcgccgcaggagcagcacgacctcctccacacgccgggctcgggctgtgggccgcccgcctgcaccaccgctctgtcaggcccggcggctggccgcctccatgcgcccccggtcgcggcggcagggcagggcagcctggcgcctcccccggtcgcggcggcggccggacgagggcgaggtgaagcgccggcgtacgcggactcaagggcgaggctaagcgcgtgcgggcttcctgttaggctgaaatggggattttttttgcctgcgtgcgggtccaagcgctaccttcgttggattcgttttgaacgggcgagatgcatcgtatgtcacgctgtgacttgccttagctaagtcaccgaagctgagtccccaacggaccacggtagttgagggaatgataaaataagacctgtccggggtacggatgcaagcgggtgggcaagcaggcttttttttccctgtttattgcacttttattttatttttttcttctaaattttatactactatgcgatagataaactagcaagcaggtttttatagagtagcgggactacccatttgcatccctagtccgggggaggaggaaaaatcgtcctccccctccctcccctgacgctcacatgtccacatgggccccaccatgtgtaactgtccacctgccacgtgtctcacacacatattccgttgcaacaaatcaccctctattaaggaaattcgttttattttttattccaccaaaaatattttacctagtggactcacaatgtttcactatgtatagatctaatattgcagtagattaaaacattcttttctaacaaatcagcaacatattaagggaattcattttattgtttgttccaaaaaaatgtttcacatgttttaccatgtatggatcaaatgttgcagttaattgaaacattctttcgttatttgctgaaacattgtttttatataaggtgaaacaatgccaccaaaaatgtttcacctagtgtacttataatgtttcactatgtatagatcaaatgttgcagtgagttgaaacattctttcactatttgctgaaacattgtttttatataaggtgaaacagcgtccgatttaaacgattggaacattttcgatctacttagtgaaacaattccgatatacttgatggaacagcatgcaacatttaaaaataattcaataataagctaaaaaattcatctgaatatatacatgtgtggtcttgttttaaagaattaattgtaacgaatttaatagtgcaatcggatcataatttggataaatattttaaaagaaaaattagtttaaagtggttttgtatgcatgcgtcatgctgacgtcagagctcgattttttttaagcccggatcgggcactcgacgggtagtgcctccccaatataattactgttaattcataatatcagtattgtacttatacgaataatatgaattggtacttgaatttgtttacttgtaattttatttatttaatagcaatatagtataactgttacaaatatataggactatagtttttttagttacactagttagatatatatcagtgcaatatatctgttacaattgcattatcagcacagaatacagaattattcacatatacagaatacatatgaacgaaatacaatccattcacaatccataatactcactaattaattagcacaacaatattaacgcaaaaaacaaaatacgcgggccgatgggatcgacttggaaaattttcgctggctgaatccgtctatgcggtggcaaaatacatatgccaacattttaagataatatttaaacattgagacaaaacttaaacattaaaagtaggtatagttttattttttttattataaacacagtccaaaagcaagtactaacaacgtcacactcacctctatcaacagtgtgtttggttgagttatggcttttggaaaaatagcagtggccagtggcttttcgcaaaacagctatggaatatgggctgtggctttttgaaatgactagtccggtttacaagcgggtcccacgtgtcatacacactggatcttatctctcccctcttctctcttatcttatctctctctcccctgcttgtggccgaagcgggcgacaaccagggtgggcgcacggccggcggagtggggcgagtggcagccggagtgggctacgggcgaggcggatcggccagcttcgccgctcgcgatggccgaagcaggcgcagagagggatgaggcgaggaggacggtgagcaggggtagggtgcggagggaggagatggggcgctccgcatcggccgacgccacccgcgttgaggcagacggaaacaatcatgtcataactttcgcagtaaatcaccattatacgataattcatttaccgacgaaaacgtctacttacaacgtagtagtaactcaattactgcattatgcgaatcacctcatccagaaacaacaacacatttacgacaaactcggtcaccatagttactaaacgagtaacccatttattagctatggcaaacaatttaactacccagtaaatcgattaccacaagcctggctgtgacaaggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaataaggtaccgatttcctaaatctactttacaatcttatcaaaccaggactttaggccgttccataatatacagggaaacgtaatacccaagtcatgatctgttacatattccatacatatatgttatcccctattactagtcggataaccatgccgtgtgggtatggggtacccataatctccacagtagcccctgagaccttcacagtcgaaaatataatcttctctcgaactagattactctaaagccgagtgcttcaatcatcttcgccatggtctcccgagtacttttaccaaatctgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttgataattatagtcaaccaagtgacttgataccaatatatagcatatgcggtgtgaatccccgaataatatgatccaagtgatataccgactgcttggcaaaatatgatgcgtataacctaaagttgacaacatctttgaaagttcacatagcaaaacaactataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccccgagcatatagcttgtccttctgtcatagtcaaaattgtctattggcaatagctgacgcagtcggcatggagatgaaatgaccaacatgaagacgaaattgctcatcagaagtaacggaagatgtcagcggtagtaaaaacagtgacaccaatcaaaggtaatgaagttgcataaccatggaggcaaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacaaagtttcccatcaacggcagcagagtaggctatgttgaagaggcttgacaagatgttgatgaagatgacgatgtcggtgatccagtcaatagcgatgtagcagccgatgataacgatgagatcctctattggcagttgcgtagtaggccaaccgtgaagacaaataattggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgagtgaagataaatattgaagattggaacaccacttgttgtaataaaataacacggtatcatatttggtgacgtatgccgaggtgtcgaaacactggtagtcgtcgtggttgatgaagtagcaaagcttgcgaagtagaggcaatagagtttgccgatgccgaagataataaaaatgaagttgctccaccatggtgacaaagttgcatagtcgtgatgaagtgaacacgagtcggcggcaacagaagcaaaccggtagtgaagacgcgcagttgtgaagataaaagcaccagtcggcggcggcataaccaatcggcgacggaagacgatgatgtccatcagtaatggtagctgtataaaccagacgtagaggcgagggcactagtcagcagcagacgagacgaccagcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacatagacgcccaacaacggcggcataaaggccagccgtgcaggcggaaacaccagtcggcagcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataatagaccagccgtgcaggcggaaacaccagtcggcggcagacgaggcggccgatcggtgaagacgtagacgcccaacaacggcggcataataggccagccgtgcaggcggaaacaccagtcggcggcggtcgaggcggccgatcggtgaagacgtagacgcccaacaacggcggcataataggccagccgtgcaggcggaaacaccagtcggcggcggtcgaggcggccggtcggtgaagacgtagacgcccaacaacggcggcataataggccagccgtacaggcggaaacaccagtcggcggcggtcgaggcggccggtcggtgaagacgtagacgcccaacaacggcggcgtaataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttccctattaacccacagtaattgatttacctccagcggtgtatcttcaacaactaccccgaattcaaatatatctaatctacatagaacgaacatgggcaaccgaacacggattttgcagactctgggcgcgacgtgcggtgctcggaacaatattccatgcgcaagcgctaccgttaacacaactcctttcagcccagtctaactcttttaccactcatccgatcaccaattcaccactaccccttctccgtacatcaatagaaaaattagtacaatttcatgtgcttttgacacatatgtatgaatgttctatatagatatttgcaaaataaaaatattgatatttcaaaattttaaagttcaaggaagttacaaagacttgaaaaatctgaatacatgaaaacctaatctaaaacaacattttatttgttagtggagagtaagtcatagtgcatttctgtttcgtaggtatgactacaaccaaccgtccgaatgggatttctccataccaagttcacataaaatactgatttttttaaaaagaaaattcaaactttttaaaatttaattttaaaggaagactatcgcaaaagaggcctaggatgtagaagatcatgacatgagcgattcggcagattctcattttcaaactagaacccggtttaggaataaaatttgggagagtatattaaaaactaaaagttactaaaaaggtttttaaaaaaaatctaaaatttcatcaaatttcagatgggccggattactcgtgggcccacatgtcagccacacgccacctcgcacgtgcgtcacgtgacgggctcctcggcccattacctcgcgtaccctcgcacccgtctcccgcagacagatccgcctcgattcttcgccgccgcgacgagctccctccatggcgccgccggccgccgccgcgacctcctcgtcgtcctcctacaccgacacctcgggctcctcctccgactcgtcctcgtcctcggggagcgaccgacgccgacgccgcgcccgccaccgcagcggccaccggaaggatgccgcggcggcggcgtcgtcctcgtcgtcggcgctgaaggcgcgcaaggaccggaggtcccgccacaagcggcgccggagggagcggcggcggtccccgtccgacgacgacagctacaggcgaggctctccccctccccctcctcctcctcatccttcctttctaggtttcttgtgctagggttaggcccagatcgatctctgtgaatgaattttgctcgttagctcctctgatagtttatcttgacccatgattgacgctacatcaggagtggtattaaggggataacgaattagttgcacaaggacgtgaagaattttcggttgttttacaactaacaaaggatttatttgttcagtttggtttggtcgtgccttacttgagcaacgagagccctaaccgtgagaaaaattttaggatttcacttcaacttgatacttcatccgtttcataatgtaagattttctagcattgtccatattcatgtagatgttaatgaatctagacatatatgtgtgcctagattcattagcatatgtataaatgtggacaatgctagaaagtcttacattatgaaacggagggagtagtaatgagcactgaatgctagctcgaatctacatggtttggagaatttctgtgatgtactttttcaatgtgtaacaatcgcaacagtagtaggacaaagcctcattccttcctagtttaatagtcagtgatcggttctatcagcagtaggacaaggatttcttagatatgatttgagctcactattgaagatgagtgttcgcatctccatttaaaattccttttcagtcagttaaatattctgtaagcctgagagggtggcaatccatggcatttaccggagctatgatgctttgttcttttgaattcaatttatctgtgattaggagttatcatggcatcaagtttaggcagctaaagcatagttcagaatctaggtaccagggaagttttgaaacaaaaaatgccatagtcttgcattacattgttacggcttgaatcattcaattggatgacatggatcggcatagcaacaagtttttccctagttttagccttcaagctgtcttggctttctctgctacactgaaaaaaatagagatattttgcttcttgcgaaacttatattcctgtttgctttatgccaccactgttattttgaagtttctggtgctttttgtagtagctcaagctcttacgacagtgaacatgagggcaaatcacgcaagcacaagaagagcagatcatcaaggaaggtactgccccatcaatgcattcatatttgatttctcatttagattttttctccatgcgtcgaatatgtggcctcattgtatttacttacctgacagtctagggagagggagcgaagcaaggataggcattctaaacgagacaagagcaaacataaagaggtaaaaatcctatttattcagaaaatacctttttcttggtttaacttttcagtgaattgaatctgtgttgcatgtaataatcactctctagaaatcagcaagtgttggttgcatacttgcgtttgattgctgttacagtgccatgctatatctattaatagaaatctacagggtcatgtcttatgaagtagatatgtagacttaaaatatatgtggtttacatttaaatacaagaggtccttatatatcttgctgcctgtttctgggttggctctttgacattggagctgggattcgtgaacgagtgacaacatggtggattggcttgctggttggcttgttggttgattggttggttttgttctcttcaatgcgggagctctacacagaagaaaatagtgaacgtactagtggccccgtgcagctctccaaggtatattagatacttggctttacatttttcttttctatttgttttatttaacatatgaaacattctttattctgtaaatcagtttcttggacgtgacaaggatgaaggtgttcaaaggagtgcaatctctggtaaaaaggtgagaatagtctcttgaccacttcaatgtacaccttttgaattgtacaatagaggggggtaagggggggggtgcctgttgaaataaaaaatcttctgatcaaagtaaggttatgaaatatgaacaatttttcagtatccaaactgttccatcggttgttaaattcaataaaacagaatgggctacctcgcatatgcccccctcataacaaattattttaggaaggcaaaagatttgatgcatttgcattgacagataatgatg

SEQ ID NO: 67805 - DNA, 5566 bp, Oryza sativa
gaaaagaaaaaggctttaacactaaataactccacataacagcagaaacaaagcacaaaaatgggttctttacatcttgaggaaaaattagagacttgaacggtccaattccgagttcaaatggccaagatatggccatttgaagtttatatgctctttaaatggatatttgcgaatttcttcatttaattttcaattaaaaattcggattattgcgtcagccgagggggcgggcgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcacccgcgccccgatggtcgccgccggcgaccaacggcgcggcggagtggcacccgagagagaggaggaaagggggaaacgaacgggacggtcttcggctcaccccgagacggcgaaggcggtggaaacggcggacggagcggaggaagacggcggcgcggctcgggatgacgagggcgacggtgctccggcggtcggcgggcgaagcggagcggcggacggggtcggcgacaacacggcgaagcggacggaggggtcgccgagtaaggaggaagtccggagcggcggcggcggcgaaccgaaggtcgacggcgacggcggagagagaggagcacggcgctagcacgattccgacggcgagagcgagcggtgagcggcggaaacggaagagcggagctcgggcaacgaatatatagcaacgggagggggagagcgcggccggggaggaaggaaaccggccgcgaagatctcggccgccattgattgcgccggcgactaatgcggtcacaattcgaacaactccgaaggagagagagaggggaaatcgggggaaacgggagagggaatgacggggaatgattcccccttctttaatgcgcgcggcgacagcggaatgcggctcattccgcggctgcggcggcgttaggtcacgggcccagcggcgggcgctgcaggatgaggagaatgacaggtgggccccacccttcagcgagagtggcgggcgggcccgcctgtcaacggcacgcgcgcgctcggtgagccgatgggccgcgggggaagagagagatagggagggaatgggccgagccggccccaagaaggaaaaagggggggggaaacagcagttcttttagggttttctttttataaaccttttcaactttgttcatttcttttcaattattatttgggctctgaaaattccactaaaatttgtttaagcattttaggcttttaggaaatatacaaaaatcctccaagcctcatttgacttttatctttgcacattttaattgttggaggctttcacatgaattttaattattcttttgcacaatttcgaggatgaattttagagtcgatttgggacgcgacacgccttctctcccagccttgatatgaaacgacttagggcggccatgcaaccggtgacgcattgcacatccctaagtttgctgggggggcgcatccgctcaatagctcgaatcttctcggggttggcctcaatgcctcgggcagagaccaagaacccgagaagcttgcccgcaggtacaccaaacacacacttatcggggttcagctttatgcaggcggagcggaggttctcaaaagtttccgctagatctaaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctcgagaagcctcgccacctcctcgcggatgaaggcttgacgttccggggcctgccgccgcactttctgccggaccggccttgcgcccggccgcacagcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccgagcctctcgtcaccaccctcgggcttggtcgcagcagcgaggtggtccgcgcgctgctccatgcaagcgagcgcgactttaaggtcgccacggacagagatggggccactggggcccggcatcttcatctggaggtaggcgtagtggaccgccgccataaacttcaccaacgcgggccttcccagaaccgcgttgtagggcagactaaggtccgccacatcgaagttcacccgctccgtgcggaagttggctgatccaccaaaggtgaccggtaggtcgatgtgacctaacggccatgtgtgccccggcgtcacaccaatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaacctgccctccccgggcaacgcacggtgggtggtcggtctggtcaaaggtgagggccacctccgaccaccgcgcccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccatcatcgatgccaacggcgggggccttctgtctggcctcacttcgccgtttaccggagggaactgccgcagacttgccctcacggcgttcctgcctcctgtcctcctcccacttcctcgttcgctcagccaaatttttgactgcgcgacagtccgcgagatcgtggagggaggtgttgtggacggagcaccacttgctggccgggcgctccctgctgggagtaccagcctctttctttttgtcgctcgcaggcctcccctttcgggtggcccgcggagcgccctcgacggcgaggacgtgaccctcgtcgccggaatgggccgaccttttcttcctcctcctgtcacgccgccctgtctgagcggcggatccgggggcggccgaagctgccacaccggaaccggaggggttccaggtccaggcctcctccttgcgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcacctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtcccttcagggccatgggaaagaaattagccatgaccctgtcgtctcccccagcggcctcgatcccggtcgtatagatctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacactctggacgaggaggcgccctccgttgcacggggagtacgccggctattacgccggcgctcgatgttgaggcgggcatccggctccccatgctgatcctcccgagtcgaaggtgtcgacgagggagtggcagccgaatgccgtgcagccgccgccgctcgccgcgccctccgccttgatgacacggaaccggtggtggcggcgccggaggtcttggtagtggcggaccgtccaccagcacccaggcgctgctgggccatcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttcccctgcatcacccgcaatcggtgatgctgcggatttatcaactctctcgagcgcctccccctgcttaggactttggagtggaggtgggggagtacgagctcgacggcgtgggttcggctccccgtcgtcgccgctcacactcggagagaggtcgtgcacctttgcttgctcggccattaggctgaacaaaggaaacttggcacacacggaagagtatgagagctcagaaaacacacgctgagccccctacctggcgcgccagatgacggagctcgtggcccctcaccgggagactgcgcaagcccccctttgccggttcgaccaggggcttagggtgcaatcccaagctctctctctctctctctgtatgtggaaagatcacccgcccgcaagacacacgagacacggcgatgtatacaggttcaggccgctgcgaagcgtaataccctactcctgtgtttttgtggatttgtgtatggacaagttacaaaggattcacttcctttcccctcccttgttctagggaaaaagtcccttctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccggtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctacgagatagg

SEQ ID NO: 67806 - DNA, 1872 bp, Oryza sativa
ttattgtgtgcgtatggaatgcggggtcgaatttgaaagaagtccaaatttggtacgttgggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagagttgagttttgagctagggtttcgagtttagtcgaaatttttgtaaggagtgctgttggtgcactttgtaaacacagagagaagtaataaagtcgtcatccactttaagagttcttcgatttgtgtttcaccgagtttcggcggtccaaccggcgacatactggctgtcagaccggcggcatacgggcggtcagactggcggcatctactcggtcagaccggcagatcaatctcggtcagaccgatctccatcgatttcaagggtaacttttatttccgctaaaagttttttgtttttgggtataccaacctttcaccccccctctggttggcttaattcttgtgattcgatcctacaagtggtatcagagcttcgttttcttctttggatttttattgatctaaagtttttgccatggctactcccgctaggttttcaactaagcctcatattttcgatggaactgattttcctgattggtgtagtatgatgcaatcttacattatggctgaaaattatgatatttggaggaaagtttctcatccttatgtgattcctgaagcaattaatattgatgctttaaaaactgaatttgaaaataattgcaaagctcgtaatattcttttgagtgggatttctcgtgctgattatgatcgtgttgtacatcttgaaactgctcatgagatttggaattctttgaagaattttcatcaaggaacaaataacataaaagagcatcgtcgagatctttttaaaaatgaatacattaaatttgagatgaaacctggaaaagctttggatgactatctttctaggtttaataaaattttgagtgatcttagatctgctgattcttcttatgatgctaattatccacaatctgagatttctcgtcactttttgaatggtctcgacatgtctatttgggagatgaaagttacatctattcaggagtttgttaacatgtctacgttgactttggattcactttatactaaattgaaaacacatgagatgaatattctttctcgcaaagttgattctaaatcgagtgccttggtttcttcttcttcttctttggatgttgatgcttcttcatctaagtcgttttttcttgctgtttttaatgccacatccgatgatcaactcgaacaaatcgaggaggacgatttagctttggttgctaacagaattgctcgagctatgaataatgccaggaacaggaaaagaggtggtccaaatcgttgctttgaatgtggttcaattgatcatcttcgttcgcattgtcctaagcttgggagaggcaaaagagaagataaagatggtgagaagaccaacaacaacaagcccaacaacaacaagtcgaagggttctaacccaggggggaagatggagaatcttaggaaggcttttcaacaagtttgcgccgctttcgagccactaagtaatgtagatggtgaaagtggagatgatgataagggaaagaacgtctccgatgtttgcttcatggcgcgtggtgaatctgacacagagtatgaagataatgaggagagtgcttttgaggaagctattaatattttgagtgctaaaaataaaaagtgtgggaagatgtataaaaaacaggaatttatcattgaatctcttaaatctgaaatttgt

SEQ ID NO: 67807 - DNA, 5650 bp, Oryza sativa
tttaagttctcgtctcgctgcaaatgcatagtaacgcgacagtcaatatgtagtaacacgactactttccacaataacaatgttataaaatagtcatgatggatctagtttcgttaaacatcttgtctcgattatcgtatagtaacagggcaattgtattattgtttaaagattagaattctaaaagtttacttgtactaagattgttactatgtatctttgtatatagaaagagaagtacttttagcacttgtgttcacttgtgaccatgcacatgctcctttttagcacttgtaatttgcacaatattgagatttaaaaatttagctatgcacaagcagtggtactgtaatagtacagttactaagtatgttctcatttactgcaatttcgtcatgatgttactgcaaaagtgcactaacgaccgataaattttacagtaacgacctataaatttcgcagtaacgtatcatgttactgcactcctacgataatgttactaccgaatcgtaataacaaggtatgatttataacaaggtatgatttatacagtaacataatggatttgtgttcacaaaatttgaatagatgtacatagaaaacaaacaatgatctcaaatcacaaagtgtcatagggtaaattggttaagagagtttgttatgaaccatgagatcatgggttctaatcttgaatttatcaatttatttttatttttttctagaaaagagaagaagaataaaaaatggagagagagatcgggatggggaggaggaggagcgatcgggaggggaggcggggccgggcgccggtgctgcacgtgacctcgaggaggcggggccgggcgtgatccagagggataggctttggtagttgggctgagaaggaggcgggtgtagaatagagctgtcatatgtatatatatatatatatagagagagagagtatatacccaattcaaatgagtatgaaattgttttttaaatagttaggtatgaacattaacttctttacaaactagttcaaacaagtttgagctaaatttaaacatgtttaggtatataccatccaaacatataattagttaggtatgtaatactcctatatggattgtgaaataaagttgaatttgagttgtttttgttgttaggtataggtatgaatcaaattcttatacctaggtatatactcacaatttgaacattttgaaaaattcgagttaaactgtgtatttcatattatatgtatgtatgtatgtatgtatgaatgtatgtatttgaatttatatatacatgtatttatacatatatatgcataaatataaaaaagcagcaagcaataaaaatcattaaaaaacatttttagtaccgattagtaacgccaatcagtaggtcacgtggtcctacggtactaaagatgtttttttaagtcccgctttgtataatcaagactataaatattcatatttattcatgcattttgcgtccccattgcacaaacgggactaaaatgggctgtcaaccgggactaaagtgtatttccccagcaaaatactcttctagtaaacaataaatgcatattttttggttatctaagccatgaacttttttgtgatttgtgaataataccacacacaataaacccatatgaatataatagtctcctacatcaaattctacgcttctaacagtatactcgagaaatttatatgttccttcaatgactaagtatgtgttcttctcatccattggagggagctggttcctcacttgttatgagcttctaaactgctaaacggtgcgtctcgtgaaaaagttgtttatatagaagtttcttaaaattttcaaataatttattttcaaattagtaatagttaatttttgattaatcatgagttaatcatcactctcgtttcatgtttcttgtgcacccgttcagctccgctgaacagttcgaaccacatcctaataagggcaaaatgcacctatcttgcagctatttaacgctcaaccaacgatcaattgacataataataagtataaaagggataaaaatcaaaattcagtgctataccatggaataagtaaaactcgaggatatacaaggattggctaaatttgaaaggggcagataaaaaattttctcaagaaaacacgcttccctgtgcccaactgccgagctctatttaggcagcattgtctcggctatgtgcaaattattccataatcgtgagccaagtttgacagagatatgtagtacaattcaaagcaagcttgtgctcagtacactaggttgagtggttgaccaagaaattacatgctaaatatttcccccgtatccattgatataggcatgtatgatatgacgtttaaagtttgtacatatatataaatatttctacagtactacttacacaaaacccaaccactattatttagtgttgataacaattttataaataagtatttctgtcaattcagcccgattagaagttggtccatgctctttaatgtgggacacatcaaagtctttccctttcattctaaatctctaagaaaaaatatttatttatctgaacggagtatgtatataccatatatttgcttttggtcagatgattgcgcatctctctgtaaaatcaaaggtgtttttgattattattctgtgatgaacaattgggcattggagatttcataggtgaatcgcaggtttatcattttatgtggaccggtcagaccgggccggtgcggccggtcagaccggcgtgtattgcgcggtcagaccggcgcagcctgcggtctgaccggccgacactgtgtcggtttcggtttcgggttgtttatttggatatccgagtttatttcatgattatgacttctagatggatactatacgtatgtaatactattgtttgctgctaatgagtcaagttggagatagcttggtctcgtgtcgcgtcccaaaacaaccctaaaatatatcatttaaattatgactagaataattaaaatccttgtgaaagccttcaaaaattaaaatgtgcaaagttaaaagtcaattaaggcttggaggattttttatatttcctaaaagcctaaaatgtgtaaataaattttagtggaatttccagagcacaaataataattattaagaaataaacaaagttaaaatgattttgtaaaaagaaaaaccctaaaacaatccctccctccctctcttgggccggctcggcccatttccctccccctctctcctcttccccgcggcccactcggcccctccccgcgcgcgcgccgctgacgggcgggcccgcccgccaccctcgctgacgggtggggcccatccgtcatccccttactcccgccgctcccgccgtcccgcccgcgcctagcgccgacgccgccgccgaatctgccgcatcccgtcgcccccgcgtgaaatcaataggggggaattactccccgtgagcccctctccattttcccccattttcccctctctctctctcattcaaacgagcggatttgctcccgcaaatctcgccggcgccattaatagcggccggacctcccacgccggtttccttcctccccggccgccctctcccccttccaaccctatttaaaccctccccgcgcttctcccgtccgtttccgcctctcgccgcccttcctcctcgccggattcgagctcgcgccgtcgccctctctctcctccgtcgccgacgacctccggccggccctcctcgctcgccgggactgtctcccgccccggcgtcgcctcctccggcttcgccgcaccgccgccgaccccgtccaccacctcgccgagctcgccgaccgccggaacgccgtcgtccccgtccacccgagccgcgccgccgccttcctccactccagccgcctctttcgtcgtcgccgtcgacccggggtgagccgtggaccgccgcctcttttcccccttcccttcccctctctcggccgccgctccgccgtgcctatggccgccgccggcgaccataggggcgtgggcgccgcctcccgccggccgcgccgggaggctgccgcgtggggcccggcagtcagccgcccacgtcctcgggtgcggctgatgcgtggggcccacggcgccggccggtgtgagcccgggtgcacccggtccaccgtggaccgtgaggctgccgcgggggcccactcccgtggacccggtccgcgcgcccttccccctcggctgacgcaataaaccattttttaaattaaaatttaaatgaagaaattcgtaaatattcatttaaagagcatataaacttcaaatgggcataacttggccatttgaactcggaattggaccgttcaagtctctaatttttccttaagaagtcaagtacccatttttgtgctttgttcttgcttgttatatggggtttattagagtaaaagcccttttcttttccgttggtcgtgtagacgctgcagcttcgggagatccgctcttcgtggaggttgaagccgacgtttgggaaagcgagcaaggcaagtcacatcatctttgaacatattggatcccactttgtgaaattattttgatttaaattaatgcattaccgctttatttaaattcccgcgttatcactgttttatttagccatgcctatttacctttgttatgaccttattattattgctattgttattattaccttgttcaccctagaataaacaaaaccccaactagtgggcactctattcatggttccactagtataaatttaggtagatgcttcgctggttaattaggcaaactttaggtggttttattaattctagactttgggaatattcatattacttggacattatggaatggttggactattgtggaattggacacacacctccccctctattcaaaaccctcaaaatggttttaggctgggctaggggtgcatttgatagtagcacctcggccacataaggaccggtcttcgggcctatgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcagtcctgcctacctgtcccggaggttccggccgtaggtagggttgggtcggtactcttgtctatggctaggatgggttggaaactatgtcatgtcttccgtccatatgccgtggtggtatgtggcacgtggctgcacgtgaggaagacgtgtcaaaagggggagaagtaatgtgaaaatttttggatgctaagctctttcacattaatgaacataattcctatgcttgatgaaatcattgtcaaaagggggagaagtaatgtgaaagtttttggatttttgggagaagcgaggtgaatttttggagagttgttgagaagagcatgtttttggttcaattgggaatttctttcttttaaaaagggggagaagttttcttttgaatttttgagcacgatgtgtacatttgtacgaagtgtgctttttaccacttttgttttttatttttccaaac

SEQ ID NO: 67808 - DNA, 624 bp, Oryza sativa
aatcatacgccaatgtcggaagagactagcagagtaggcctccgagacggtcgcggcacgagaacggcgtagagggagaattgccggagcagcacgcagttgccgaagaagagcgaagtgtagtcgaggaagatacggcgatgctagcgatgaatcatgctggatgaagttgaaggcgaagtagtaggaccaacggtctagacggcgtcatcggtagccatgtaaaggtagttggaccaccggcctagatccgcgacagtggcaacttggagatgcggcggcgatgctcgaagtagataaagaagacccgagtggctgacgatgaccagtggggatgatgagggtgtcgaagcgtgaacgacgatgaagacgatgaaagcggtgaaactgcggtccgagaggacaacacacctgcagctccatgtcaatgaaccggcgagaagtccaccggtgatgaagccatgctaaggaggacgcctcttgttggtatttcttaatgacattacaagaaatataattcccagcaatggcgcagaaatacttctggtatattatggttacagagttcatccgcaagcgcacggatataccattatagcatttcacccgagagtattccaaggg

SEQ ID NO: 67809 - DNA, 10214 bp, Oryza sativa
aggaggggaaaggaaaaaaagaaaaagaaaaggaagaaaagaattccctgggatttaaaatattgcaagctcgattttaaaaggttaaaattatttcgagagctctgaaaattccactaaaaatcctgttagtgaatttcgacatgtagaactcaagaaaaattccacatgccaaatccgattattatttgcattgatttaatagggtttactcttgctttgcaccggtattttcttagggtctcttattaattcaattttagactcaggaggaggacttcatggtgtgacagggcaccacataccataccacatggtttgcacggtctcggctgaagctcctatctcacccttgcccgtgaggggcttgttggcggtatggcatgaggcccttcgaccaaacctgccgaaaccacgcgatcagtggggattcaagcccgtggcgtgaaggttagtcagggcgaagccccctcatggcgaaggctatggaacaaggacggcgagaggtggggaatcgcgcaggtaccttgtcgggctagaggcctcttgggtgaaggatgcagggcgaagagtatatgctgaaggatgcaagttcgcccctgcgaggaccgaagaagccattccggcccttcaagccaaggggctattgcgccgacgatcgcctggcggcccatcaggggctcatgaacctcaattacattatgtacccatgtaaatgtccctttcataagggcaaccatataaattcccctgtataaccaaaaccctagtagtaagaacctgtaatgggggctataaatagtcccatagggccttgtaatagggggatcccaagaaaaattctcaattttatacactttacttcttttccaactactgttgagtgaccacgtctttcgacgtaagctgttgtcgtttcgacaacacaactcaccaggctcatgtgcatatttactggaaagagcatcagcagcaacattggatgctcctttcatgtaacagattttaaattgtaaatccaacaacttggtgaatgctttgtgctgctagggggtgtgtaacctctgctcactaagatgcatcaaactgtgatgatcagtaaggattatgaattcagcgtgttgtaaataagacctccagtgatccacatctagaagaatagctaagtactccttttcataagttgataaacctctagatttcacacctaaagccttgttgacatgaacaataggatgaccttgctgacaaagcacagcaccaatccctgcatcactgccatcagtcgcaatagtgaatgtcttagaataatctagcaatgctagcacaggaactgtcaccagagctaacttgagagcctgaaatgcttgatcagttgcaggagaccatacaaaagaaacatccttcctcaacaaatgggttaaaggtttgctgattaaaccaaaattcttaacaaattttctataatacccagccaatccaagaaatctcctaagtttcttgacagatgtaggcactttccaattgacaacttcctcaatcttagttatcagtagtgaccccttgaccactaaaatatgcccccaaataagccaactgatcttgggcaaaagaacacttactaaacttcactctccattttttttgactggaacttcacccggagatgagacaaatgagattgcatatctaaattgtaaattaaaatgtcaccaaagaagaccaaaccaatttttttagtacaggggctaaggtgttaatcatagcattttgaaatgttgttggtgcacctgttaacccaaaagacatgaccctgtattcatagtgaccagaatgggtttgaaaagcagtcttgtgttcctcaccctccatcaacctgatttgatggtaaccaaccctaagatctagtttagagaaaaacttttgatccaaccaactcatccaatagttcatcaatgacaggcataggaaacttccctttagtagaaatcgcaaactctccaggtgccatccgtcttcttaactaacagagctggagaagagtaagcactggtactaggttgaatcactcctcaagagagcattttagaaacttgtctctctatctcatccttctgtgcaaggttatgcctgtaaggcctcagacacacaggtttagaattgggcaataggagaattttatggtcacaagctcttttgggtggtagtccatgaggtgctgcaaaaacctgctgaaagtcttgtaagagttgtcgaatatcaggagaaactgactgaagctgatcagtagataattcacaaagttggatgacatgcatgatggatcccaaattaagcatgccatgtagctgctcatctgtgatagaggtacaatgtatagcgtgagactagatgctttgaagcttcatcaaatattttctatgttgatattccatccatttagcagcccaatcaatattcattgtacccaaagtaaccaaccaatccatacccaaaatgtcatcataagctcctaagggcaaatgtttgaaatcggttttaaatccttggccttgaacccaccagtcacaatgaggaataaactgagaacatagtagtagtcccccatcagcaatcttaactgattataccttggataaggattgaactcccaaaaaatctatgtgccaaactgctgtcaataaatgaatgagaactcctagaattcaccggcataagaactttagtgccctgaacccaacctctcaacctaaaagaagtagctgattcggtcccactaacagcttgttgagatatagccatcaaatttccctcatctagttcttccaactctgcttccacaaaatcaacatctgggtgtagtatatccaagagttcctggaccacatgcaattgcactgaagtagcaaacttattatctctaccccaacgttcaccacaagtaacacaatccttttgctcttctataagctttcagggcagacaatctgtcatctcttgatttagaaaagtcaagccctcttatcatccaacacaggagaatgaatacctttaaccacaggacttactggagagaagacttatagtagtgttgtctgagaactataggagtatcatatttcctatgattgattggtttagatccttccaagatttcctcccacaagagcaagctgcatctaggtcctgaggtttctgtaatagaactattgacctggtcacaaagtaattaagaggaagggaaccattataagccagcaattggtgcataatactatcaaacttttcaacatattctgacatactagagtcctgcaaaatgtgaatccactgtcgaatcaaagtttcttgtttgtccttagtgaatctcaggcacacctgatcagcaaattcctaccagctaacacccacaaatttggaccccatagactgacgccagaatgctacattcccaaaaaaaatttaacccagcaactctgacccaattcttaggatgaaccccatacacctcaaaatattcttcaaagttgtttttccacaactgaggactgttgccatcaaattgtgaacaagtcatggatggtacactacctcctaaccccaaaatcatagcagaatcgactgcatctacaggtgtattgtcacatcctgattttcgttttaggatttataaattatttaataaattatatttagaatttgtattaaatgttcattaatttacaagtgaagttaaatgtgggaaataaaatttcctaaatataaagcatggatggatttaatttttattaaattctccatggttaattatactctctggaattttctcggatttttcggagctcaattcctaattttaatcatacaaagaacatttcagtaattacccacatattaaattaatcattaaatggtctgattatatactttttaagtactttgagtgtccaagtattttcatgatttttcttgaaattatttgagcattggaagtatttttaacaattcaaaggtcattttagtgattaatttaattggaaaagtaattaaaatcctttccttagctttgggcttaatctggcccacctctctctcccttagcccgatccagcgcctcccctcttctctgcgcaagtctaatttgctatcctccttcaatcgggccgaggaaatgaagcccggcaggaagtctgctacagtgtcgcccctaacctccagccggtcgatctcctccctgccgtgcccgtgtacagcgccgcttcctccaccaaatccgccgcatcccgtgctccgtttgcaaaattagttgaggggaaatattcctcttatcctcctctatcctttcccccaagaatcggactttatcccgaagaaatcaacacggaatagaattcgttttcgagtttatctctccaactaaccctcggattttccggcttcgattcctctcggttggagtccgatctcttcaatccaagcctataaatagcatcccctagtcgtcctctttcgtttgccccatctcccgagctctctcgtgccccgtagtgccgccgccgcgccacccaaaccgccgccgtcgccggccggcgaacagccgcctcgcgccgtcgtattagccgccgccgccgcctcctcacgtcgccgtcgggtgcgcgtggaagaggggaagctcggccgccccttcgccgtcgccaccggtcaccggagagccgccgccgccgcacaagctcgtcgccggtcgtcatccgtcgtcgttcgtcgcattggttagtaccggtgagatcgcgttgttctcctctacgcgtaggtaccctccaaaagtccagtcgagtcttctagcgccggcgaggtcgtcgctgatgtcgagtcgacattgatgatgtcagcgatgacgtcattaatccctttttcttagttttctctattagatgaaaatcgattaaacttcggaaattcataactaaatcatcgtaactcggattcgagtggttcaagttgctaaattcatctaaaatcaaaatctacatgttaaaaatatccacatgtactgtttttgcttgtttttgtactgttttgttgattttgttcttttgttttagttaccgacgttccggaggagagtattttcgttgaggaaggttcggaagtgtttgcggaagctcaaggcaagtcacacagatcccaaacaaccctttgagcatgttgaacccgtttaaagctattgtttgatttcaacttatgcattattttcgaatgtcatcgggtggtgagcctttcccaattaattaatggccgaagatgactttattttcctattagctagaaccttatatattagtttgggttcagctaaatgctatatatatataattgcttagccatgcttagaaacattagcacatgattgggataactaatgttacactatcacttatggttatatttaatggtagctcaggatggtcaatcgtgattggttaattaattattgccaattaaaatttgtcaatggtgggttgtgagcacatggttgtgaaggtcgtgctcattacaattaaggactggttcgcgaactactgttgtgagacattaaccgtgccaaccacaagccagcatgtgcaatggctttaccttttgtatagcatgattcattgcggggcaccagactgagaagcggtgagaagtccgtggaggtcgctggggagtccatgcctctggttatatttatagagggggtgattatgatccagaaatggtgcactgtggtgagttgtgttgtgcagggggtattgtcatagcctctattcgggtactttccagtatcgcgacgcatggtagacatgatgttgaggctgtgtcttgtgggtacagtggtacacctctggccagagtaaaactattcgaatagccatgcccgccgttatgggcgagttgagcaatgtttttcgtgattagtctcacacctctcacaataattattgatgctataaccggtaataatttgtgtagctcctggtttggagttaggtctgtacagccgggtatggttgttcaggatggttgggcctgtgcagcatgggtgtgctgttcagtgttgattaaaatttctgattaattactctactgttttacttcttttaaatctttgctaaatgctgcttttgcaaatgagcctatattatgccatcctttggtatccttgtgcacttgcatatttgctgtgtggcttgttgagtatgtcatatgctcattcttacaataatcatcaaacctcaaaaaggatccagaaggagaagacgtttggcttataccccagttgagctgcctgtaggagtggagctgaagccatcgctagaccgttattccgctgctgttttcttttcttttgtaagtatgtacggttatttttatgatggatttgtatattaaattgtcaatttgtgtaccttggctgattcctggatgaggatttttatgcacaaattagttcggaaattactagtgaatttccgggcgtgacatgtgtgatccaattcaggagaaggtaaggtgggaaatagcacctgtaggagacgtaggagcagaaaatggctcacgggaagcctgctgaaccacaatctgcagcttctcgaccttgtcttgcaattccaccaccgaaccttggagttcatccacgcgtttctccacgactgtaaaatgagattccaccaccaccttgagagccatgaactcaattcggctcttctcctccgactgctccctgcgcttctcgctctcttcccacttgcgatcggaatcctccatcttcttcaagagtagatctagcttgccatcctgatcgatgactttggccgccatcttggtcacgtaccttggcttgtcgtactccaccgtgatgaaacctggcgttcgatctcgcttagccagttgagggagccaaagcttttgcgggatcagatcatcgaagcaatcaattcccacctctcctaggaattacaacaaaatgaggggaaatttttttcagcgagactctgataccaaattgttagcaacccaacacccaatcactcaagaacatgcaagaacagtagatagttcaccgaatccgataggagtaccgccgccgccttcgctaccgttcttttctttcttgttcgattggaaaggaaatagagtagttatagtattacattccagtctctctctctctctctctctctctcgctcacattactccttgtgggtcgggaaggtgctcatttggcccattccagcccatacactttaggattacatttacgaatacgacctatcttttctgtagaagtctgatgctcccactccagcttgtcgctcccctatatatcatcaggcaagggtaggttcctgacaaagaagcttttgaggaggttaaacaacatttgttgaaagctcctgtagtgtccttgccaaacttttcaagacttttgtggctgaaactgatgcacgtgacaagaggattggggttgccttgatgcaatcacgccatcccataactttcatcaacaaagctttagggaagaaagcacaagcattgtcaactaatgagaaagagtgtattgtatggcaatcttacttgctgtggaaaagtggaaatcatacttgcaccataatgaatttttaatccagtctgaccacaaaagtctaacacatccgagtgaacaaatgagcaagtaagactgaattaaaagaggttttgtgaagttgatgggtctaaataggtctatagtatcaaatcaagtagaaaaaagggtgtgataacgtagcagaatatgctctatcaaggagaggatggatgatgaataaatccaagtgttagcaccccgagatggatggagaaggtgatagaggcgtaccacaaggacctagcaactaagcaactactggttgaattgagtctgaatcctgaagggaaggagggtttccaaatcaatgttaaacatcatgttcctagctatagctgactattgcatcatataccatattaatttctaagttttcgcaatccacaaccaacagtggttcaatcaattacttcacccagaaagatgtacgtgttacagtactacggttccttgccttgcatgcaactatacgatgtccacatgttgattcaatccacctgtccacaccttgctgccctcgcatgtgcatcgcttaccccgatgccctccatcctcgctccactaagggtgtgtttggtttgtggtcaagcagggatgggatatggctatccattttttcagggatatggccatccaattttttgtttggttggatgagtgggataagctaaatttttgtttggatggaaggataagatgtggatatggtgatccatttttctatttggtaggaaggatgagctcttacactcacctattggatgaaatggtgagaatacccccttggttcacacttatttgcatttacactatgtaagaaggaacatatgcattgtaagtttctttttttctctggttgtaaatgtattgtatcatatgtttaatttttggataataaagcacatcttaatatattcaatgtcatgatgcagatataaatttaagtttgattcctacactggtagaggacaaatattatccaaatcatgtccatacatagatgagggatatagataaatacaacatatcaaaagacatcaaaattgacactcataaaccagatctgaacaaatacttcaatgagcaaaatcatcagcccccttaatccatcaacccaccatatctaaattaatccattaaccattgcaacgttgagtagtaggaggaaaaaaaaatctcagcaggacgtcgccccattcagccacatacatcgtcgccggacggttgcctgcaccaccaagaccccgccgcccccgcggccaaaccctgtcgcctgcatggccacgccgccggacgtcgccgcccgagccgctgaaccggtttgccgcctgcgccataaccgaacgccgtcgtccgcgcggccgcccgcgccgccgaaccctgccccgcggccccgccttgacatccttggcgccctctgttacaaaatcctcaaatcttcatgtcctcctcgcgaagcccatcaccatcacagccgagtttattatacacttgaaccattgtttttcaattaaatcaacggtttaagtcaacccatattggctatgttttggtgataaagaattacagaaaaattacatatttgacccatatttattttcaatatattaatatatgcatgcatcatttttttcaggcctcccctaaattaaagaaaccctggaaatttttctcgacaaagcaaaatataagtataattttgggagtgactattagtcagttgcctgaaaaaaaaataattatcagtcgatctctatgtatcgtccgatcccatccaatatctgatcccgccaggataaaaaaaaacaggtaaaacatcttgaaccatggaccgcttatcatcgtgaactggttttcggatctacattgttcgatcggttcgaatcttttgtgttttttatgctggttattgatttggctggagtttgtttcgtgctcttttgttccatttgtatgtgccgagcccttagcaatttagaagttatagtgtaatatgcctagcccttagcagattcagaagttataatgtaatacgaggtcttttacggtgacctagacacaggatcaaatgcaaacaagcagtttaatcttatagtgtactacgccttaaacagcccatgggactaatacaaatcatacaagcttgacattatacacgaaacaaccacaagaaaaaaaatagaaatgaaacattccccaaaaatcaacaacttgtactaaacaaaacattagttcttattagagactcactgcaatcccaaagaataattatttaccaacttcatcagacccaggcatagagcaaataaaatataacaatggagatcacagtaaatatttcattagatgcacacttgcttcaagttgggttcgcatcccctgcctttgaggccaaaggcaaagtttgccgttgctgccatccagcacatccagttcctattcgtggattgcatgtttttttcctcaatttaagatgattacaggcgattagttgataatatcaattatgctggtcccatttaaaagataatcccttgatcaatattg

SEQ ID NO: 67810 - DNA, 21205 bp, Oryza sativa
gcaaatagcttaaaacaaatggtttaaacaatgccgcagaagaaaggtttttaagaaaacatatttttcaaagtgtactccctccatcccgaaaaaagaaatctaggactggatgtgacatattctagtacaatgaatctggacagaggtatctccagattcattgtactaggatgtgtcacatccagtactagattagttttttatgggatgaagggagtagagcacttaatattttaagtttaatagtttggtaataagctgaaaggaatgggtctggtcaaaatttcttagccattgaattgctggaattttcacctttgatcgtttagaaaatcctaaaaaagttattctagaaatgatcattttttgcggcacgaacgtcattggcatcgtaatccaacatgatggcgctaatgacgttgatgtagccccatgtggaaactaagtcactaatgtgaatgagacaacattttgctgtccaggaactatttgtatttttttgaaaatgatctatttgtaatgaaaaatatttacaaataggtcctcattgcttgcatcattatcactaaggatctatttgtaatttttttttattacaaatagatccttttctactacgaatagcagccccatcacctcacttattcatggaataagccaaacggaatatttgcgaacgaaaaataatttgtgaataaaaattttatatatgtgtttttagtgatctaaaagcaaggctgaaaaataaacttcaatgatgaaaactcaaaatcggctccaaatttaaagctgaaaaattaaattttgactgataagcataagcataaacgaaaagatgggactctaggtcttttacattttcacaaatagatccttggcgtcaatgatattggtgatttggtaccgtcccctatcacattaggccattcccaacccaataactaggatggtgtacatagcattaaataagctatcacataggatgaaaaatgatgtggcaagtgaataatgaggaaagagaaggaaaccatgtcttgcatgagacatggtttctacacaacgtccaagacattagtgagataagtagcattaaatttaagtatggaatattggtgtttgcattggaagaatagtgtctagtactagtttcttgatgatgtggagtttatgaaaattatgtctaatgttttagattgggaatggccttagcgacttagctttcactagagacgagggggacggcgccaacatcattggtgcaccaatgatattggcgccacgaaaagggtgtattcttggaataagttttttaagatctatttgttaaataagtttttcaaaatgatcaagaagtgaaaaatccatttctcaaaaaaaaaagtgaaaaatacagcattgaattgttcagatcaatctcccgagaacttgcccaccgtagcaaccccagccttcatggcgtattcttcggtgtctctctaacggctactgttgttcattgtcatccaaccatttcttccatccatgacaccctcactacacttaatgaaagccaatcttggagggtctccgtggtttcctcgccgttgtcaagatcgctagagtaggagcgatttgtttcaccttcttcaatggcctttttgtacggtgattaggtgatagtagtccactacccggaagaatggaacagaaagaaacactctcatcgcttgtatcacctttctgtgtgtgtggatgcactagtaattaaccgggtccatgtggcccgtctcattatagtatctatccctctcatcaagagccaaccaaccgcagctagttgttatataagcaaatgctcatcattccctgccttcctggagcgtaattaaatgttattaggactagtatgttgttagccttttgggacttaggactgcaatccatggcccatttcggactccaccaaccaagaattaatagaactactctaatcaacttcatgctagctgaacgccagtgacctaccagccaacatgagctgatcatattagcttggccaataactaggatgtgatcattctggacttctggtgacagcagtacagcactttctgcaagggccattcccagactgcagtgtcctgcaagaaccattcctggagaaacaatgacctgaactgccagaaatgctcccaattgtaaggattcatggaactctggttttcagaaactctgagcctctgaattcagctaggacaacaatggaggtggttggctggtcgcattacattactttgtacagaatgaaaggaagaacaaaagtgagtcgacgtaacatccttcaccttctttttcctagccttgtttccatgatatgttcttgcttaaatacgtcagttttactcgacagtgacaacgcaacaaacacccaagccaattaattaactgagagaagaggcgaaaaaaaaaagagagagaacgaatcactcttgagttacaagcaacatgaacgggtcacgtgaacatttcacaaatccatggcactgagattacagagaggaattatatgcctctaggggataacattatctggcgcctagtagagtgaatcgaccgtcttgttcagctcctcgagcttcttcatacgcatcctctcactttcgctcaccagctgcgtcgaaattataagttttcagtgaccgatttgacgatctgaagatcaaagagatggtgtgacaaacgtttattaattctactcacctcaattagcctgtttacaagcagtgccttctccttgttcttctcgttgtacgcctccaggatttctttgtattccttctcctttataagttttcaattcaagacagacaaatagttgtgtcagcttattcagtcccttggaattaattcatcgtatcacgtcgcaaattgtttcgacagggtattccgactattatgttcaagaagttgtactaaaaaagttagaacctgttgaattgcaaatcaaatctgtgtcatgcgctcatgctattcatgcctaaatatgtatttatgtgcagttctgcacatcaagtctgtgccttcaccttcttgacgcaggttttgccgagaggcttgagctgacggttcaccacgtcgatcctcttcctgatcacctccacctccttcctggttggatccgccatcccttccagttcctatcaaagaacaaacaattcagccacacgcatcatttgcagctgattttttttctctattcatatttaaaatttgggtaattttaccattcttaagaaggtatctagaggtaccaaatttttctctaggtactcagtatctcaaggtactaaaaaaaattttttagtataaaattttgatacctttagatactttcttaagaaccgtaaaatttctcttaaaattttcttgcatcttttctgagctagctgatcatttggtgtgcctttaagcatcatcaacttgtatgcagtacgtgtcctatatcacacgatctctgttacaagtacagataaaaaagaattgttcctttttagggtcctgaaacagcaattgctacttccgtgctgtttctgcagttctttcagacgaaatcaagctgaaatatcataaattataaacctaactaacagctcttaggacatatatgaattgtattttgaaaacgtgacatgaataagctgcagacattccaagtcggaaagtgacctgtcggatgaaggcaaggcgcttggactcctcctcgacgcggccgagctgcgcgaacaccttctccctcacctccatcttcttcctctcgatctgctcctccttggccttgaacaccgacagcgccgacctcgacgacgcctcgccggcctcctcctccccgccgccgccgccgccgcccagcgacgacgggtgcttcacccgcagcaccatctgcatcggctgatccacctccccctgcatatccaactacccaatactgcaatacaccctctgatctgtactgcagtagtctacactggtggatattctttctttctcctcttcctcgcttcccgccatttataccccccgccacgatcctgtccctctctgccccccgtcccggcttcccgccgcggatgctgcatgtctaagcaacgggacgggatggaccgacgtaacatggctcctgccaatccaacctgcgggtgtatcgcacaagcaagagctactccatcgagaaaagaattgaagaaaaaaatggcggaatcatttcattcatttgtctgcgacgacggatgaggagtcgcttctgtcagaaaaacctggcgatgttaggttaggtgagacgagagctagcctcgcgcgagagctgtcattggcagtgcagtgcagtggaggggaagggatcccgatcgagtcgggtgagccggcggctgtcgccggttggtgcgcgcggccgtctccctcctcacgccatttttttttcctaaaagaactttttcgatcgagtgggctagctttcgcgctcgattcgtcccgcggcttagatttttcccgtctcgtcgcattgcaagagtaggcgatagccgatagcttagcttactgctttttttaattagggggaggtagtgagggggacacggcgccggcgaggcgaggcgaggcgaggcttggaagacacaagctgcgccggccgcggcgtcgccgtcagttcgccgtggaaagtgggaaaatgtgggcgacgacgcgtgcaggcttcggcggcgacggggagatgtgaggtggccggtccgatcggtggatgccgagagatgcagccgagctgaggcagagcagtaacgaactgttgctctgcacagcgagagaagcacggttacacgaacacagtggggggtttttttcgctgtcattttcgagatcggatcacaaatggtacggacacttgtgtaaggacaaaaagggatgcacgcgagagcatctcgctttgtgcgactgcaaatctaatgcatgatcactagatgatccatggttgttagctttggctgaaacaatgaggatgttagggctcctttgaatcaaatggaaaacggaggaatagaaaaaacataggattgggataggaaatgtaagtgtaagagaattggaaaatacagaaaaacacaggaatagccgtttgattagatcacatgaaaaacacagaagtcggatgagagagataaactcaaaagaatttttccaagaggttgaacctcttgctaactttcctctaaaatcttaataggattacctattccataagaattttaaaagatatgataggattcaatcatttgttttaaaggttaccataagaatattttccataagattaaaatcctctaaatttcctacacttttcctacttttcctacaaatcaaagggaccattactagttctgatttgatccttctatttagcaaagctctttgttgcgatagtttcagaatcaccgataccgatgtcatctttcataaaaagacaactgaagcggcagaaggaagtcggtggcatcaaatgcaaccaaaaacagaacagattcaaaggggtcatccaggcccaggagacagagtttgcagaagaccactactactaaaaatttgaagccttaaaaatacgaacagcacaatagatcaatttgggctaaggttcaaccgtttgctgaaataagttgtccaataacggagaatcactatataaagcttatacagaacatagtaactgtaagcactgcggttccagctgatatatatcctgttttctaacaagcgaagagggtcgtctgaatcaaatcagcaacatcataactggtggctctcttcactctcctggggcagagacaccttgcttcagtttttccctcttcatcttcttcttcgagactggcttctttttgcgaggaggaagcgtcttctgagcgtacacatagagagcgtagttcccgacaaagaaaagcagcaggaaggtcgcgaccacaatcaggactatcattccagggttcagtcccttgttgacctcctcaatgactacattgttctgaagaccagaaaacaaatctatcaagcactatgcatgacaaaagggcactgcaatttaaatgtatgtgacttctttatcgaaaaaatactatgaggcttgcagggttagaagaagttaacccttccataggagtatatgttacaagttactagacacatagagccagagcagagatatctgtggacatggatgagtctgcacatattgccatgtatagatctccatacacagataattcgaaagctagataacaattatttgtactgtatagtcacccacatctgtagttctgtacagtttgatcacagcacaaaataaagcttattactaaggattgcatgttttcaacactagcaactagcccatccaagagtggccaaaactaaatggaacatgatagataaagtgaagtggtctgcctagaattaccatttgcataagatacacaggatggctattaaacatatgcagtagacatatacaaggttggtagtaatcacatacaaggttgaacagagggaaatgggatggcagtgcataactgcatatatatattcattgaaaacagcagcaatctatgtcaacattcaatttcagcatatttacaggataaaaaatattcaaaatagtgaacaaacaatgtggacttgataactgaacaaaaaatgaactattggaatttggaaagcgcaaagttcgcgatataacttgattcaaaaattaatttaagtttaagaaactaaaagatcaagtgtacatcatggacatcatggtaagtaatactccctaatgaatggccaccgaatgtatgaccatgcaaagactactgcaataatccgacagatctaaccctacccataaaaaaagcaacaagtgcgtgaatccattggcactaccatatcaacggaacaaaagaagtataagaagcccgtaagttccttaccgcagagtccgcgaactgatccgccatggctgaccgggaccaaacacctgcaactctggatccaacgatggatcaaactctggcgaaaaaagaaaaagaaaaagaggagcaattcttaatcgagaaggggttgtatcaatctccaccaaacctcaatccctacctctccttttttagatattttatttagcctacggcagctgctgcactattccgctgttcgtggccgatcgatcgtcgggtctcgccctcccgcttacgggattcggttaaggagttcgatgatctgataggattggaaggtgcgagtgaggaatactactgaaatttttgggggagttctgagagacggcaggacgaggattcgagcgaggaggaggggatcgaaggggaagacaacaatatatttgggcagatgaccccacccagcagatggtcacacggtgcatgtgtcaaaatgggacaaaataaacatgtcatcgccacctgctggataggataaggatatccttacaaagacatagtaagtacaatcctattattttcttttattcgaatcacttattattaaataaaaatttatttgtgtgtaaaatttttacatggtgtccttagccactcaaaagcaaatgacctaaaataaactacggtgaaaaaccaaaaaatcaaattcaaaattaagttctagtaaaataactctctaacagcctctccaaataactctctaagctaaattttagccattccagtgaaatttccctccaacagcctctctaacaggatggctaagtcatatggctggccaaaaccctccccacactagccaaatttgaccagccaaaaatcactggccaactgtggaccccacgcgtattctcctcctatctcgttgccggccatagtccacagcgccgacgtcgtcgcatgcaaccgccgtcgcccgccgcggcctccgccgccgtccgcaccgtcgccggcagcggcctccgccgccatccatgccgtcgccgcccgcgacctccgccgtcatccgtgccgtcgccggctgcgaccgccgccgtcgtccaccgcaaccgccgctgccgaccccacgcacaagctggagcatgagcagagctgcagaggcacaagctggagcacgagcagagctgcagaggattggagaaaggggaggaaaaagaaagaggaggagaatgaaaggtgggcccattgattaatagagagagtctgttggaatagaagacaaatttgactctctaaatttttgttaggctggccaaattggtatttggagagtcaaaaatggccactctgttgaagatgctcttagggtgtgttcagcacccctttttcccagcctatttctctcgtttttcgcgcgcacgtttttcaaattattaaatggtgtattttttgcaaaaagtttttatacaaaagttgcttaaaaaatcatattaatctattttggaaaaaagattagtaaatacttaattactcacgtgctaatgaactgctccgtttttcgtgttactgttccgggttgggaaccagtgtatacgaagacaccctaagaggggccaaaaaaaagaaaaactatagtaagagggacattttaacaatctcatagagtatgacttgtgggctcacatttgtcaataatatgtgggtctaataacaaaatcgttaaatgtaacacgtgaaagtggcaaatagtaaatatgtgatagtaaaagggcagcagagcaggcccattatcatatatgaaaccttctcattatcatatatgaagtagatttatcatatactccctccgtccctaaatataagggattgtgggtgaatgtaacatatcctaggctatgaatctagataaagggtatgtccagattcatactcttaggatacatcatatctatttataatccctcatattttagggcggagagagtaataaattagtagtagttggcactatgcataagaattaaagcaacaagtgaatctattagcactatcataagtataggtttttcactcttggaaatacattttctctattttaaaatgaactaatttctatatctaaatttttaggcaagggttggtttattttggtacgaaagattgctatcatgtttggttgcttgatgcagagctgtgcggcagcaatggttgcttgaagcagttggctgcgacgcagccaatccaccaaacagccgaacaaggcctacgataatatacatatgccagaaaccgtcgttgtatcataatgttgcatcacatcattttgtttggctgtatgtatcatactctctccgttaaaaaaaaattaacctaggatattttgagttttcttgggacggagttcataactgtatattgtatattttgatggttatatattgtgaattggacgtcatagttgcgcagaggatcaagctggtgtggatacatgagatggtcaagactagtgacagtagccgagccaaaacagatcaaagcatcatcaaggatccaagggcaaccgggaccctggagcatgaaatctgtctttgtgggtttgctgataggcgtgcagctctcttttttttccgcgaaagtacgaaagtacagctattacaatcaacataagcgcatggattatgtgcacacgtttcttttgaaatgaagatttaatcaatttgccatttattaggaatagttagcaatataactgaaaaacgttcagatatgtatggcctgttcaggctcaatttaatttgggatgacgcaagcatcatcttgtgcaacaaacttgaaaatgcgaaggagggagcccaagctactatggcacgccggatgcatgtcagcaccaagccatcaaatacaacagaaaacagcatcaagttataaatcattcagatttcagattgcaagatggctacgcaggttgcagaaattttcaggcacgatcgctagctaaatcaaagagacacgcagaaacaaaaccaaaagaagggctcaatttgcagtgctgttcaacagattgctcaaataaggcgtctaatacaaatgtaaaccacttaggacaaagcttctacataacatagttactgtaaacactgccgctccagctgataattcttatcatgcaaaagaagctcaggataaaatcagtaacattggtaaactgacgaatctcttcactctccgggtgcagaaaccccctgcttcagcttttccctcttcagcttcttcttggagactggcttcttcttccgaggaggaagcgtcttctgagcatacatgtagagcgcatagtttccaacaaagaaaagaatcaggagagttgcaaccacaagaaggactatcgttccagggttcaggcccttgttgacctcctcgatgatcatgttgttctgaagaacaaaaaaataaactatcagaaaccaccctaaagattgaaaatataattgcgatttaggtagctggaaaaatcaaaatagttaacccttcaaacttatatattacaaggttagtatgaacaaattagagcagacatgtacacccttttgtacacatgggaaacccaaaagctgacttcacagatcagcatgtctaagcatgtcaacagagcatgtcgacaaattatgttcaatatggactgttcagttccactacatatctgttaccctttattcatacagatttatcactgcgcagacgaagcttaattttaatacattattgagtctgacatttcatacatttacatgttttctacactagcaactagcctataagtaagattccaaaaactagtccgaggtcagccaaaacgaaatagaatgtgtgtaaaggtttgccattcagagaaagatatgacggttaactgatataaggatgcatacagaacaacaagacacaagtgttcagaacacctgaaagtgtttgaaagcaagaacatatacatttaaaagaggcaatcatgccaacatacagttccagtggattcacagaacataaattataaaacactccaaatgagagcacacaattgtgctcttaattatttattgaacggaactacactaatgaaaaggtagtcatgaatgccatgaggacaaagttaaattaagcaacgattaaacgatcatgtatgtatcataaataaaatagcaattcagcagaccggcaagagtaaaattatctagtgatgtcaattcttgaaacacgttatacacaaccagacacactaacctaatcaggtagcaatttaatcattcagctaggggatattttcctttttgagttggttcatgtggctcaactttggtttcatatctagtctaccagccaatttgcttcagattagaggctgatgatgataggacacagctaaaaaaacaaaaaactgaagaggaaacggaacaaccataaaatttaccgagatgtaacaaaatgtatgaccatgcaaaaactacagcgcaaattctacagatctaactatccacgccaggggactgatccaacttgggacatgggggttcagtttttggggggaacaaacaaactgttacttgtattagttaaggctctgaaattaagagaagagcttcttccagatctacaagagaagctagggtcaacacaagcaaattccagacaaaagcaaatccgccgtaaaaacgcgtcgagatccggtcaaacaaccgaaacgtcgaaggtttcgcacccctaaaaccaagagattaaacagaaacagctcgcagatccttaccgactgatccgccatggcagcgacgatacccgcagcaccagacgacaccagctgcggacctctgtggatcgaaaagaaaattagatcagcggctttagccaaagaagaatttctcggaggaagaagagaccccgtggaagtgagagatctccacagtggattaagcccgccgtcctcacctctcgcttcttggcgcggatttctcacttctcttcctcccccccttggcgacaagctcgcgtgatctgctctgtcaccgcttgctgctcatgctcgttcgtccacccgccgtgtcccgcccggctttatgtatttgtctccgagccgagccgagctttacccgatttctcgtttctccgtttatctgtgggccccacatgggtgtttccttggcacatagaaatgggacgtggctgattcatggtcaggatctgccgtccaccgctggatttgtcacctctctcggtcagtatccgtctgatcggtcaacggtcaactcttgtgtgaaggaacgagttgaggttttggatagggttactttttttggataatgcgtgagcagcgtatttttcgaattgggcaaatagaagtggagtttggatgagggcattattttggcatgaaaaatttgatttgtaagttcttctcgagaaatattatacaaatacaagcgcacgtatacacatgcatgtactcacttatatatttgcgtgcacactgtactataatgctcgatatgatgtccctaaaagtgttgcattaaattagatgatgaagtgaatgagagaagtgaggaaatggaagatgagtcactcctcatgcaaggagcaacattcacacaaactcgaagagaaaaaaaataaaagaaaaagtggattagacaaacaaacaaaaataaattcattagggtcagtaagataaaggtagtgtagaggtgatgtattgtatatatcacctcttattttacatggacaaaaatagatgtggtaactacctcttctataaaacttgttctaaacactttcgagaatttaggctggtatattttgagattgatgaatttaccacatgtgctgacaacttaaggttgacgtagtttaaaacttgattttgaaaataaaaatcatctaagtctatttttctataagggcgtatatataaaagttttatccattaattcattttttctaataagccgtgtgacttataatcaatattaggacaaccattttgtgaatgaaaattaaaggagggctaaaataaaataagggtggaaggaatgaatggctaagattaaaacttacatgtgggaaatggtagtatatattttcctaatgccattagccaaacatactatgcgggctcctgtcataagtatttaatgtttaagagtaaaactgagtcaattttttattgccataattgtgatatcagtgtaattttatagaatctatgcagacttacaagttaataagcttatgatgttatgataatattccactatttttaaaggcaaatttatgcatataacttttttagaagctaattacttgaaatttatttacgatagtcaaggttttagaattatgaacaaatcttattttaagtatcaaatatttatcaccagagggagtaacttttgctaagaagatggttaaaagcgaaagtctaacaggtggaacaaaccaatgtagtagtagtagcccaaatcgtgtaggtttttgttaataatggaaaattcattccagcctttatttcaaagaaactagttaaactacagccaaatcgcttaggtacccagtaaggattcaatccaaagggcgaaactgctcttcaaattcatcaaagcaaagatcgatgtaatgtcacaccgtcaactgttaaaataggtgtcaaatatactagtcctatttggttacagttggacttggagttgtaataggtgttagggggtggagttagagtcggactctgtaacccgtcatttctcttaaatagagagggggcaccacaatgtaatcatggcgactacaacgtagcgtagacacgcagggagatgatggcggcgtggccatggactcgtagcggctaggagctatattggttggggaggagcgcccataatcagagccccggggatgtaggcttcggctgaacctcgttaacaaatatcgtgtgtttttgtgtcgtcatctggcatgtcttgggtgatcaatgattgaagcgatcgagaaggttagtcgtcgttccgctatatcgactaacttttataacaagtggtatcagagcataaggtttcagcattggatcaagaagacatgtggaggaggaaacacgaggtggggatcgcgcatcgacaggagatcgtcagccgtggcgatgagatcgatggcgacaacgaggatgttgcggaggcggcgacctcgctcgcgatcagaccggcgatggcggaacgtgaccggaagacggggccgggcgtggccgaaggcgaccggagagattggaggggtagcgccatggacggcgcacccgacgcacgcggtgaatgtggatccgcggcggcagggaggctactgacggaagggcgaagccagcgagcctggcacggcgcggcggacgtggagggccgatgacgatgaggtcgtggacggtgaacacgagggttgcgactgcggtgcgtacggtgtacggacagcgcgtatggtacgtgctatacacgcacaagacgcgcatctggtgaacaagaagtgcagcacacaaagagtccaatggagctacgggcagcatgcactaatttaattagtgtttgcatggtgtaattatatgtaaaatcatacgacagggcttgatgcatgtacgtgcatgcggggctgcagttaattgcatgcaatagcataacaaatatgcatgcaagccggtcatgcatgaggagagcatgtggcaggacatccatggatctcaacgtggagtcgtgtgcgtcagaaggccagagaaatcctattcgagcaagaagtggtgtgtgcaaatttggtggtggcacgtgacgctaaatgagatatattggagccgattcttattggagcttgacacgggcccgacttggactaggcagcattctatgggaaggattcatcgagtttgtccaggactcaggttcctgtccgactcggtgactaatgacgctctttaaaagaaggcgtcaggacaggattggctaagtaactcacaacagcgtaggcacacagaggtttgacacatcgtttggtggactatttggcaggcgacgacgcaaattgcacgagttcttgggaagaaggcgcacgggtgcgggtggaccaagccaggctgacacggttaggcagctagcaggcggctaaaccaagggcagaagatctggtctaatcggtgcagcaaacagtcggtttgctgttgaatgtctgagatcggatcacaagacgagattgtgaagacgaatacagacggtactgagaaaggcgagtattctggtggcgatagaccagtcaggtcgcgggttggcaagttggcgccgacatgtatgaaatttgatttggtgaagtttgacggcttcggaaattttggcttgtggcaaactagggtcaaagatttgttagctcaacaagaagtttcaaaggctttgaagggtgtcaaaccggccaagatggaggatgacgattgtgaggagatgcagttgcaggcggctgcgacaataaggcgatgtctttcagatcagatcatgtaccatgtgatggaggagacctcaccaaagataatttgggaaaagttggaagctcagtttatgtccaagactctgaccaataaacggtatctgaagcagaagttgtatgggctaaagatgcaggaaggggcggatctgacagcacatgtgaacgttttcaatcaactagtcactgatcttgtgaagatggatgtggaagttgacgatgaagacaaggccatagttcttttgtgttcattacctgaatcgtatgagcatgtggtgactactttgacgtacggcaaggagaccatcaaaactaaagatatcacttctgcgttgttggctcgtgattagatgagaaagaacaaagagggtgaaacatctcaagcagagggtttgctagtcaaagaagatcatgctgggcataaggtaaagaagaacaaaaagaagaagatggtgaagtgcttcagatgtgatgagtgggggcatataagaagggagtgtccaacactgaagggaaaagctaaggctaatgtagcgacttcttcaaatgactcggatagcgatggttgtgatcttctcacgatgtcaagtgcacagtctaaggatgcagaagcgtggatattggattcagctagctcgtttcatgtgacgccaaggaaggagtggttctcttcatataagtctggtgagtttggttttgtctacttaggcgatgacacaagttatccggccgtgggagtaggtgaagtcaaaatcaagctagaagatggaggtgaacatgttcttcaaggagtcaggcatgtaccagggctaaagaggaatctgatttcgcttggaaccttgcatgaagaagggttaatattccgcggtaatcggaataggaagaccattgagatcatgaagggcaagatgactatgatgactggagagaaggtggagtcgcatctttacaagctgcgagggtgcactgttgcaggtgtagtccaggaggaagcggttgctgggatagcaattgcttttggtggcggcgggtctggcgcagactcgtcgggcggcttgcggtgaagctgcaaagaagacaacccaagtctggaggaccggtggatcggcatggtgattctactacttctaggtggcgtatattcgccaaggtggagtttgttaaaataggtgtcgaatatactagtcctatttagttacagttggacttggagttgtaataggtgttagggggtggagttagagtcggactctgtaacccgtcatttctcttaaatagagagggggcaccacaatgtaatcatggcgactataacgtagcgtagacacgcagggagatgatggcggcgtggccatggactcgtagcggctaggagctatattggttggggaggagcgcccatatcagagccccggggatgtaggcttcggctgaacctcgttaacaaatatcgtgcgttcctgtgtcgtcatctgacatgtcttgggtgatcaatgattgaagcgatcgagaaggttagtcgtcgttccgctatatcgactaacttttataacatctacagattaagggatcaagctatcgacagtatgacaagagaagacacaagagaattatctccagtagaagtttcagccttgcaggtataccagaagtgacaagcgaagcagaaacataaattaagcaatttatagtctagattcagagacaacataacactacagtctacaggtcagcaatcttcaaaatgtaaccatagaactcagtagtcgtagtgtagattcagaaattcaactaaacataggaaagaacagaagcctaccagtggcatcacaaatacagtactcttcagcatgaaatgcatcctactaggtcataatctagattcagaaaggcaactaaacacgacaaaaagagcagccaacagcatcatgaatactggatagcagtcatcttctgagtgaaacctcaaagctcaaacatttagagcgagttcagtagtcagcgatgataggtgtcgaagggatcaggcagagtattcgcaagctctaagctcaagtgctcgagatcatggctttccatgtcttcaaacacgatctcagcttctgtggaggccacgtggctttggttgagcagagcttgctgacctgcaacgcattggggggtgctgaacaccttagactgaatcgtcatgagctgcagcacctgtgctctagcaaggagaaaacatgcaaattcaagcatgtagatgttgtgaactttgctttccagtcggacgctgttgaggtggttcatgacacacccaatgtgatcaagcttttcgtggtagcttgagccaacagtgtcggtgctatcctgagtcagatcgaaccttgtatcagaggcctgcacggaatgatgaatccaatgaatctgtgttcagctaaattgaacaggtagtacctacacagacagtgcaatgcaagtattgcaacagctcaagctcaaccagttacctgaacgtgcaatgtctccacgaaaggaaagaaatttagcaagttcatcagcttgtccatgtcattcttgctcgagaactttacactgatagccagaatcttcacgctcagaagcggagcacgcaaaccattacagacatcctgatgcaatgcacaagtaaaaataactcagtgagagcaactaaagagtagagtaggagaacgacgaggataaatgaaacaagaaaccaccttctcaataacctcgtcgaagaggaggaaattggacgagctgatcacgacatagccgaaagcggtgagctttggcgcgccagagacgttgatggccgcggtgaggcgcatgtcgccgaggaggcgctcgaggcagggggcgtcctccacggtgagctcctcgaggttcttgtactgccacacgccgagcagcacgaggctgcggcaagagcggacgcggatgctgcgggggccctcgacgtgcttgagcatgacggtgcgcagcgcggggcagccggagaggacgctctggagggcggcctcggagaggtgggtgctcgacagcgtgagctccgtgaggcgggccgcggaggccccccggtcggagacgcggcactcgccgagggcgagggactcgagggtggcgcagccgaggagcgggtcggcgagcgcgaggtggcaccactcgggcgcgcagaggagggcgacctccctggcgcgcttcgcggcgagctcgcggaaccaggcctccgccgcggcgacgcggccgcggaaggaggtgcgggagaggcggaagagcgcgacggggcccgggtgggaggcgagcacgcgggtgacggcgtcggcgcgcgcggtccacggcgcgatcggggacgaggaggcggtggttctggttcctcctcccagtcccagggcggcgagggcggggaggtcgaggtcgtctaggcggagcggggtggcggcccacacgccgcggaagcgggtggagagggcggcggtgcgggccgcctcggcggtgccgaggagggagaagatcacggagaggagggcgtccgggagctcgctgatgtagtcctcgccgcctccgtccgctgctgccatctcgccggcgtccggggccccgcggcgcgcgctcctggctgggggtttggagaggatttgcaggttcagtcgaaagagcagtgctgatttgtgcgtcgtggctcttggctctcttgatttttcacaatttgatctttttgaaaaacttattttgcaaatagaaatcacaatttgatctttttaaaaaacttattttgcaaatagacccataaaaaacttatcacaaaaagagtcaattttttaggtgctagagtcattggcgccgtcctcctgccaccgtggcgggtcggcgctaaggtggcagggggagcacgctaatataattggtgccgcctaaaaaggactattttcggaataagttttttcaaaggtctatttgtgaaatgagtttttcaaaagaaccaaattgtgaaaaatccagcttggctcttgcccatggcccatggacagtgttgatttctttcagctgcaaatctgcagtaacatatattttttttgggtaaaaattgctacagaacactcaaaatttgtatgatttgctggtagacataataaaaacatgtcatggttgaaatatacttaaaaaaactagtaatttgctggaaaacactttcggttcatttggagagaaattctttaaaaagactggaatgccccttagggtcaaaagcttttgagcggagactgtagcaaaatgaaatatagtgtgtactagtgatgtatttgagtgatgtatttgaggtgatggcaaatttaaacttgcataatttctaaatttttactctaacatcatgtttaaagcatttggtcagggcatctcatctttcttaagaatttatcaatccaattgaatcgaaagtatcctctatcaaattaccattttctaggatgtctttttgccgtgacacgtttttttacgtctatcaataaattgcaaaaattttggatgtcctatagcaaaagttgcctatttttttactactttcgtcccaaatataaggagttttagagtttgacacggttactaaaaaaaatatgtagattaaatagtggaatattgtgattggttgagaagtggagctaggtgaggaaattaaatggtaaagggttgtgatttttttttttttttgaaatttggtgaagggttgtgattggttgagaaagaaaatgttgatcgagaaaaattgttatattttaggataaattttaattggctaaaaattgttttattttaggatggagggagtacttttttactccagtttttttggcaggaaaactaagagcggttagtcgaaagtaatttgaaaagatttggatcaatacgctatattgggctgtatttggaagtaaggtgaggccgggttaggctttggttgagtaacaaattcggccgtacttctccttggcccattaaacaaaaacgaatgtttaagaaaagatgcatataaaatgcagcgaatgttggaatgtgcaacaatatgaaattcctccaaaagactatgcaacgatataggagtatctcgcaaggagatcgaaagcgcgaaaaagtagcacaagcgcgaatatcaattttcatcattgactaatcaaacacagccaaaattttaaattttaaagcataattctatatttctatagttcgttttgaaggttttttttttcattcattcttctgcggcccatttaaatggtttttctgctctgattgcatgcattgtcttatctcaagaaatatgcagtaacagactaaagagaagcttattgagcactaaatacaaggagaaaaacatttctgtcgaacagattattcataaacatacaaatgccaaccgatatcgttatgtacaaaactacagcgaatgcgcaacataggatgggtttggtatagctctgaaaaaagccgttcaccctggtctatttccttcacgagtcactcgaaaacaggagctcatcagtaggcttttctacctcatcttcctggcattggcgatgaaacacaagcccctcaaatcacatcgtcagggcagcctttcttttcacctttcacttgagttgtattccggcgtcattaccaccaactcccttgagttgttcccccaatgatcagagctgatcattagtcct

SEQ ID NO: 67811 - DNA, 2916 bp, Oryza sativa
  unsure (1)..(2916): unsure at all n locations
cagcgtgacacgcttgaccagactgcaataaatgctggtaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacaatgttgtaatcatataaatatatagtataatcaataaattaaggcaaacaaaaaaaataatattaaaataaagtaataatttttgcaccatacataattcatcatacataaaaagatactagtaaacatatcaatttcaatttgcaaatatgagtcaattcataaagcatggttgatatatatcttttaaaaaataaatatatgagaagatatcgcatacccaaaataagatgattattattttgcttagaagggagagagaaaaaattaggcacctaactatagtaggagacgggggtgagcagtgtcgaggaattgactcaggaaagcatcacatacgcaggattaaaattgaacacttggactgcttatttatgggtcaattgtgaattggatatggtggtaggtggcccaaaaaggatatggagggttggggcggcncggnccgtanctgggccagccgcccaaccccgcctaatgggtggtatcgcccctgccaccgtgctactcctatcctacgcggtacttccctacttgtcgctaatgtcaacagaacttaccatagcagctttcactctaccccaaccccatttccccggccactccttgtggtgagtggtgacaaggtgtcctgaaacgccaccgtcctctacctcctaaccactcgtgatcatacacctcccatcactgacccctcctactgccttcctccaacctacggctttggtggcattgccatcgcctcactgttcacctgtatctgtcatccaccacggtccatcatcttgcgaccatcccttcgaacccagagaaaccacctcttcctcctttccttcgttcctcctaccccccccaaccctaatccaactcactactaccattggtgaccatacttgcctgtgtcagagaaaaggaagagccccccccccccccccccaaccacatatcctgagcttgaagacaatgtcattgaattgaaatttcttccattttcagacacttgaaacctagtgatcacattaattttaatagcaaattgaactttgtacatggtaaaatgtaacatatttcgctttgcaccagatttagcatatgttttcactttacaccaggttaaattgaaataagttttatttaacacctggatatatcatcaaacctattaaatttcatgagtttttataaaatctaaatgaaactttgtgaacacagtagagtcaagaagtttaataagttatactcatattttaacaaaatctcctttcatttatatgataatacctccaataaaaaatataagcatttctggcggtttttacgggaattaaggaagtagattggatgaaatagtgaaaggttatgattggttgagaagacaaggtaagtgaaaaaattaaatgcaagagggttgtgattggttgagatggggtggtaggtaaagaaatagctatattttgagagaaatttgaactctagacaacttcattttaaaacgaagggaatacaatttagtgcaaagtgaaacttattggatatagacatgtataaattaagtgaaagtaaactggatgttgaaggcaagaatgtacactctacccgatgccaatttactctaattttaattgcaaaaatatgacaaacaaattacaaaagcatgttttgaagataaatttttatatgatttttatgcatcaaatctaaatatttagaaagtgttagtacccacagctttgaatatctaatttcatacttgtacaaaatctcattgtggacaaaacgagtatgctgttattttttttctgtagtgcattgatgcttttcctcgatagaacaagcatgatgatgagtattagtatggccaagcagatcagctgcaactttaaccatcatgttgcgcatatcggcatatgtttatgtttgctacatatgcgttgcctattcatgtgaacttggaataagtcatcgcttcgtggatgcgctatgcacgtggataacttaacttttatggctttgtggcaagaaggttcacatgtgcaacaaattctctctccgtttttttaatgtatgacgtcgttgactttttaaccaacgtttgaccattcgtcttattcaaattttttatgcaaatacaaaaatacttatgtcatgtttaaagaacatttgatgataaatcaagtcacaataaaataaatgataattacataaattttttaaataagacgaaaggtcaaatatttattaaaaagtcaacggcgtcatacattaaaatacatacggggggagtatatacttcaggccactgggtctgtgttgtattatcactagttcactacatcccaaaactcaactcttgccttcttggtggagtgtgagtcagtgcattgggccattggccggccggtttctccaagttatgcataatatacatttgtatatggagattccagaatttatttagtttataacacaaaaatatttgcaacaaggtgtgtcccacaaattattttcattttaggttcaatttgaattagttagacggctgtagctgttggtggctcggaaaacgggacgaatcatttgcacatgattaatcaagtatcaattattataaacttaaaaatagattattttatttttt

SEQ ID NO: 67812 - DNA, 11944 bp, Oryza sativa
gcctctccccctccccctagccagccgcctctcccaccaccggcgccgcttcccttcccttctccctcccttctcgccggcacggcggagacggcgcccttcccccacgctagctgtggcggcggcggcggcttcccccacggcgagcggcggcggcacccttccccacgctagcggcggtggtggcggtggctctccttcccgtctcgccggcacggtgcagcggcggcggggtgcggtggagacggcggcggcgaccgtccctccccctctccctctccctctccccgttggcctcgatggcgacggcgccctctcaacggcggcgtcgacgacgtcggcttcgtccgagggtggatccgtcggcagtggtggccaccgcgggtggatccggcagcggcgctccctccgccgcctctcttctccctccggcggcggtggaggtggcggtgcccgccgattttttttttttgcaatttttttcgatggctattgctaaccgaatcagattgtgtatggacgaaaaacggacgaaaattagatgtgacgatcggaaaaatataaatatttatattagtcatagatttctactttttggaagggtatattttttgcctgctcaattcggcatttgtttcatcaattttgtggtgctaactaaattgggccgtgtttagttttaaagtttttcttcaaaacttctaaatttttcatcacatcaaaacttcgctacacacaaactttcaacttttccgtcacatcgtttcaattttaaccaaactttcaattttggcgtgaactaatcacagccttggcctgcctgaaaatggtgttggtatagaatccagacagttggccaaaacagacaacgggataaacgcaagcttgcaaggttgattgttgagcaactatatctgatattatgcattagcagcaaatacaattgatgcagtgcagaaattaaacacaatatatctctacaccaattgaattatcaaaacactgttgctgacaaaacaaagcagaggctaattaaaaaaaaagagagacgtcctttcaaactatttttaagaatgaattgtgagcatattagagattgaacaagagacctggttaaaatcacacaaccttgtcactgcatctcaagcagaggctaattcgatcactactagaaactccgtgaggagtaacctttcttttcttatcattgtacatttgttcttcggcaatttttctatacaacggtagctaaactgcaattaatgtttgtaaaactgttaaactgattcagaattcagatggcaaataatgttctgtgggagcatgagaagatacttttgtatgcatgcctactcatttccaatcataaaatatgcaacaaaaatcttctagctagatgtaagaaagatcatatatagtattaagaagcaagaagaagatggaacaaactgcagattacttctgacataatctgatttctatgggtgtgctgaaacaagaattattaattctgatttcttctttttttttactaatcgtattattctgtacagagcctagttattgcttctttctattctcctccttttcatctacggagtactactttctcgaagaattttagttcttttttttactattattttacattgatcaatcatttgacctacaagacctcgcacaaaaaaaaaaagaaaaaaaaagaaagaaagactggatctacaagggaggaattaattcgatcagatcgacaaatcatatccaggccatggagtttgggcctgggctgagaaattagggaagaggaatgatagatttgggctggttgcattaggcccaacgtaaacaactgaacatttgaacccgatttgccattaaaatgaaatatgcaaaaggaaaaatgaatttgaaagatgtgcttcagttttgtccatgcactctggaaacatggggaaaaatgtctagactctttgatccctcaattcatggagtctaatatttcattaaaattattatttatgtagtgtttgcgatacttgtgcacatgaaagcattatttaggtgaagatagaaaatcaaatgcgattagctggtatatatatatatatatatatatataatataccttgtgatattgtaatcatgtttgtggacaggattagctacatgcctgatgacaacatcatgcattgcaatggtctagagatcataaccaatctgcaaattaaaataaatataagtaacatcataacacgcacatatattgcgtgatactgctatatttcagaggataaatcattgtttgaatgataattaagagttaaaattatacccatgtgcttcaccaggctagacaactcgatctgtgtggatcacgtgctttgaaaacctttttaatcacttactatattgtgtcacaatctaatattgggtttcactctcatttctggtcccattgtttttccagataaactgacaagcctccgtttttagtggaaaattgctggataagaataattgtgttctctcacgaggaaacagaaatgcttcggtttgaggcatgcatgcctttaaatcattttcaaccggagttaaatgcatgaaaaataaacttgtgatgatagatcaaacatgatgaacaaaataccaaactaatcacccaaagcatccacgccgatttgttaatgaaaaaaagaacttcctccatcatagaatataaggagttttagagattaacgtggttattaagaaagtaggtaaaattaaatggatgaatattatgattggatgagaaatagaggtagagaaaaatttgaattgtgaagggttatgattggttgggaagagaatgtcggtagagaagttatattttaggacaaattctaaaggttaaaaattattatattttgggacagatggagtataaatttagtactaaaaaatatataagtctagtttcctccatgtagcattgttagagaccggcgtggacctatcgccggtaacacttgactcactttagctggatcaactaaatgaactgatcatattttttttaacaatgtaaatcaactaagtatccataggtccgccaagggttttttttcttcttggcggttataagggttttcctcctttggcctttgcagttatagttaccacttttaccgcagagctatggtaggtgtaattaccagaatggtttggggaaatttgtttgaattgaaatataatttatagaagcaatgaaaatattaaaaaaaaatcttacaagtaatacataatttctagtgatatctagtgaaaaccttgtgtgaaagaaaaaaaacaaagttaaattcatttttttcgagtcaaactgaagttgaaacagagaacagggaaaagaagatcacaaagcccatttaatcccagcaaagggaaaaaaatattttctttctccctcatttaatctctccctacacaaaatattatataaaatgttttacaagtttcctcaacctttttgcaatttttttattttttctaaaaagcataccacggcgcggttacctcgaccgactgagggaggttgaaaatcttgaattcgaaaatttaaagataaattttatgcgataaccttcgtaacttcgtgtggtggtaaaataaacccttgcgcacggtatggcgaaacctgactacacacgcccatctccactatatattatgaccaaattgttggcacgagtccctcaatttgatcatagctgtaaccatacttcttttaagtgacaattgacagtcgttgggccccataattcacgttgtacactgtagtacgtgtacttccatctcacgcatgacaagtggacaacaaaatctttggagaatcacaaccatacatgtatactagctagtactatctacacctacttgtaaagttgcaagctagctctacataatccatatgcatgcatgtatagctttatcatcttttgctttctaatttcaacgattttaactaaattcttttctccatgagagagagtagagtagaggagagagagaggagatagagagaggggccagcatgccagacgtacactccatgcaaaggcttccacgcatgcaagttttgcagcttactgcagcagcttccatccatcgatcgatctgttattgcatgcagcatacaatagggactgttttgatatgtgcccctggctagctctctctgtgtgtgtggatgaatgatgatgatgatgatttttgatggcatttggaagctgtgtgagagggacatgaaaagagagagaagaaaaattaaaggagagagagagatttatagctagatgatgggccaggattatgtgaactccaagcaattatgtgacctatagctaatagctctctctattgtctatgcttcattgcaaaacaaccccacaggggcatgtatgtatatgcacatatctctgtcccctcaactgatctccctgcccctcaggtggccatgataaccttctggctcaagggaagtgagaaatggaaaaggacaacaagagctggagtcaaagacaagaagactagagctctatctctctctcatatctctccttgaaagagcatggaaaatggttggttcacacataccagctacaccgtagtacaatgatgtatatactaaattgtggggttattatacgtacattgaagccgtacaaactgtagcagcgaataatttgtatgtataagtagttgctttcaatatgtagaatttatgcgtagacgcctattctcatgatttatatgaacacaaaccaatggccacatttatttattgatccaagcatgtcactacatacaaccttttagtgcattagtttcaatgcaacagatatactcagttgccttaagcgcttccttaggatggtgtattgctaaattatagtgtaaattttggttcctcgtccacaagaaaatatatacctcttggtatcgactccctatgtcaagtactataaaattcctcttgctaaaaacattaactttctcatatagaaaatccacgaatcacacattcgagaacaaagaaataaaaacgcaatggcttacacataaaggggcatcctataattaagctacatatatagaagccacatgcctagatgacctatgcgtgtgaacctagcattttacaacccttcttttatttcctctcttgtttgctctccatctacttgtccagtttctaagcaaagcacacacacgcacccatcgccatcaccatcatatcatcccctctcctcctctccttcttcctccctctcatctctctccattgctagctcctcatcactccatacaaacaacaagaacacaacacacttgatatatatacctcacacacactcatgtccatttctccctagctacttatatccatcatatctatctacatacttgatcaaaatcacagcaagatcggcaatgaggaagccggattgcggcggcgggggaggggcggcgaagggcggcggcgttctgggtgtggcgggagggaacaatgcggcggtggtgggggggaaggttcggaaggggctgtggtcgcccgaggaggacgagaagctggtggcgtacatgctgcggagcgggcaggggtcgtggagcgacgtggcgaggaacgccgggctgcagcgctgcggcaagagctgccgcctccggtggatcaactacctccgccccgacctcaagcgcggcgccttctcgccgcaggaggaggacctcatcgtcaacctccacgccatcctcggcaacaggtgcagctaatcagttaactataagctcctacgactaagtagtacctaattaattaattaccatgattaattaagctttaatatattaggagattgattcattaattacttcattgtctttgtaatgtgggggttcatattgtgtgttcttctttgttcgttcgtttctcatcggtttttcttaagtagtttgcttgtcttcttcctacattaatttgtttcttgtttttcacaaagtgctagctttttctgtgtgtgtttaatttgttttgttttctcgtttggaatgttgttatattgtgttgatagggctagcaagtaatgtagcataatctttcaatgaatttccctcgcaattaaaagatatatatactgttctttttttaaaaaaaaatctctctctgggtgtgtattaattgttttcctctggtttctcttttttttttgagatggtgttgattttgtttataattctctgtggtgctctgatctacacatgcatttctccaaaaaaaaagtatataagagattacgtgaatttgacacaatacgtcgtacgatatttttttcccatgtacactgtcctagttcacaactgtcttaggtagatctaccgtgagcgtacaatttccgtattctacagctgaagcattacagatcacgtacagcaaaacgttgacgtgcatatactcatgcatgcatatacatttataatatgtgacataagttaaaaaaatttgattattagaatattaatatatatacagacatgtgtctcaagtctcaaagggctatgagaacaacatgagtcctggatatatcaatcaaaatatttcttgattaattcttttttttcttctgcttaattttgcatgaaatgtcgtacaccatgcataattacaaaactgatatatatgtaacgtagaaactaaaagttgcctgaaaagacaccgaaagggatacttcatacttgtatacgttctaattaaccctgaaagacatatgcaaatttgtcggatccaatcatccataattattgattaatccttgtcttaccagaaatgagattatgacatcgactaattacctctacgtactttctcacatgtaaaactaacctatatatatatatatatatatatatatatatatatatatatatatatatatatatatatatatatatatatgcttttcgttttacctaaaaaaaccttttcattttagctttgtataaagtcaaatattcatcataaattttcaaaaattcgtatacagtttaacatgtgaattatatattatgaaaatatttctcatatataatgaatttagaaaataaatcttattatggtaataactgtataaatttctagagaattgatgatgaaggttagaaatgtttgacttactgcaaagttataacgacaagtaatttttttaagtaaaacaacaagtaatttgaaacggagaaaatcatatatattttatctttatttttttttggaagtaaatactagattaatcatgcttatgcgcttatgcatgcatgcatgcatgcataaaaagaagattaattaaggcgcattgacatatatgtgcatgcagctaattaacctttttatttaattaatcttttgtactacaaccatagctatagctaagcttggataataattcttgacagaaacatctcgtttgctcactgatgaaaaatctaccgtactacgacgcatggaattattgcaggtggtctcagatcgctgcccggctaccggggcgcaccgacaacgagatcaagaacttctggaactccaccatcaagaagcgcctcaagatctcctcctcctcggcgtctccggccaccaccaccgactgcgcctccccgccggagcacaagctcggcgccgtcgtcgacctcgccggcggcggcggcgccacggacgacgtcgttgtcgggacagctaatgctgccatgaagagcatgtgggtggattcctcgtcgtcgtcgtcgtcgtcttcctcgtcgatgcagagccggccgtcgataatggcggcggcggcggcggggaggagctacggcggcctcctcccactccccgaccaggtctgcggcgtcgacacctcgccgccaccgccgttcttccacgaccactccatctccatcaagcaagcatactacggatcaaccggcgcccaccaccaccaccacgcgatcgccaccatggacggatcaagcttaataggagatcatcaccatcacagcagcagcatcctctttggcggcgcatcagtgccacctctcctagaccaccaaaccattctcgacgacgacgacgaccaccctaacaaaaccggcagcaacacgaccgcggccacactgagcagcaacatcacagacaacagcaacagcaacaagaacaacagtgataataacaacaacatcagcagcagctgctgcattagcctaatgaacagcagcagcaacatgatctattgggagggtcaccaccaacaacagcagcagcagcatcagatgctgcagcagcagcagcagcacatgagcaggaatgtcatgggagagtgggacttggaggagctgatgaaagatgtgtcatccttgcctttccttgatttccaagttgaatgattgagagggaggggccccatctatagctgccaaaggagtacattgcatatatatacaattatacatatatatacatacatacacattgaaggtagtatttttttccattgacacatatattctctcttccaaatgtacaagatttctcacaccaactccacttttgatcttgcatatatataaatatcttgaaattcatccttgtacacaaaattatagagttatgtagtcatgcaaataactaaaagaacttgagttgtatatatactcagtatcaagatactaggtaagatcgttttttttatttgtagtatcacaggatcgaaatactaccagattttagaaagtacataatttaatataaagtataaagtatgttgtataaattaaagcatataatattgattttgatcaatttaattggttttatgtaaacttgagcgtatttattcaaattattttcaatccaccttattttaaataatattttgtaggattgtatggatcgtagaatcgagatactacctaagatttcatagaatcgtctggaaataaatagtaagatcaagatactataaaaaattaagatactagatgagatcggtatcattttgatttggtaggatcgcagcaccataagatactaggatacggatcagaatatcgacagccttgcatatatagcgatatcataattaaatatatagttagatgccttaattatgtgggtgttcatgtttagaagttagtttagaattagggctaaacactgtagataatgcttcacctttttataaaaattttcttcagggtaaagtttcccctgttttgtttctttgcttcctctttcctttcatgcaccaactgcttcccttgcacatgaagtcacattgatgagcttatgaataaatatattgaagtgtctgaaaggtgcatgcagctagtacttgcctgagtgactagtgatcagtgtggtgttggagagagatgatgagtatcatgtgcatgcatgaatgaagtaggaggaacagtcactgtcactggtcaaaatatatgtaggttggttgcaattacaggtcgttagcagatgcaattagctgctagggtccagaaagataggaaggggaggcaggaaagtgagtactccatgtactatctttgccatcacatctctctctttctctacccctaatatcatgctgtcatctagcacattgagacaatttaataggatattccagctagctttgatagcttctcctgaaatttaataaatataaaaataatttgtaagaaatttaataaagcaggctccattgggtttatcttgaaattagagaaatatatataggttccaattgaaaataaagattatgagagttctggtaattaaaatttaattctttgtttcatgcgaaactgtcacgagataaatactccctccattccaaaatataaggcataaccacccctaacacaaagactaagaaataattattatcatcttgtagtttggatcatcctaataaatacaatgcatgcatccaatagaattaaagaacatgagagtggaggattaaaaaagtaataatttaatggagaaggggtcatagttaattgcctatatgcatgcatgccttatggagtattatggaacatctaagaaaagtggtttatatggaatggagggagtacatgtataactaatgagccctgtctgaatgactatttgacactatgcaaactgcatgtagaaaattgtttatcaaaccactaattaatttgatcggagtttgaatgtataataaaccgtgcaacttgtcctcttgcatttgacacaataacatatataatttgtcgatgtttgatgtcgcgattccgatatttgtatagtgtggggattgttgataccagggtatatacgagattgtagtaaaaaagatggagacggggatttttatacaggttcgggcccctgaattgtcaggtaataaccctactcctgttgaccgaagccggtcgttgctcttattcaccataatcacaccagtacaatatttggggtagcttatctatctgttgtcgacatggtggtctgaagttctgactcgtagtcaacaacagggtagccttcctcctcgaatccacatccggcgaggtcagagacagcgctagattcctctctttggttcccgtaggtaccatatggggttttcctagacttatctctgatgtcgatatctggcagtttgacttggcgtatgttggcttgtattggcttgtggctttgtggcgtctatgttgtccatgtagaactctatttatctttctttatccggaactccttctatacccgaaggttgtttccgtataaaacatggtatgtggtgggtcctgccgagatttagtcaactactattaggtatccataaccctgacataattattctctaagttttaattttaacagcatatgctcatgttgttgacccaaaccctatgatgtgtaagtgtgggtaatgagccagctcgattcattaaggctcgacttattaggctcgataccttaataaacgtgctagcttgcctcggtttgcaaactggttcattaagattgttaggtttgtcaataaattttatctaatttatattaatattactggctctatagttttaaatttaccgattcataatataataataaaatattaactaataaaaaaactaaatacaaatagttttaaaataaataaaggactaagtattggttaagaagcaagtataaaaagaagatatgatgctcgtgagctagctcgctaaactaaagagataaaagcgcagcttgacttgcctcgttaggactatgagcttgattcgagctgagccgcgagtttttagagcttttattcttacccctcccctagtgatgtgacacactaaaattgaattagtgaacggtaaaatttctatttgctgtaattattaaatatattcatactatagcattgatcatctggtgatcagtatatacactacaccgcaacaccaaatagaaggcaatagtttgttgggaaaaatggactattggtacaagtcagtctgccggtaaatatcctggcaaaacaatctatcggtaaaaagataactatgtcaaacaatctgtcagtaaaagaaagtgacggactatctgtaggtactcggtaaagatcttggaccgacgagctgtctgttgctatatcactagggcgtgtcagatattggggtggataggataaggttcctgtgacaagaaaaaacacctgtctccctcaccacactgctaggcaaggcgtagcctctagggttttggcacgaggaggcggcgaagcaagccagccgagcgagtgggtagaggtgcaacggagctgctacaaggtggacatggacgagggtgtagccaccgggaggacgacatggtggagatccccatctaccgaaatacaatatctgtcggaaaaaa

SEQ ID NO: 67813 - DNA, 4773 bp, Oryza sativa
gcatcaaaattgaggaaaaaatcattcaaatctgtatattcgcttaaagcaaaccgttacaacaatcattccgtacttattcgctgtccacacatttcacacgtactccctctatcctataaaaaatcaacctagtactgaatgtgacatatcctaatattacgaatctgtacatacatccgtccaaattcattgtactagaatatgtcacatgtattagattcgttttttagggacggaggaagtagctctatttttcttacaaattacaatcatacagtacgtatacactgtctacgcatttcacccactacatggtatctctcttttccttctgtatctatactccctgctgtcatctgaatgtctagatagagtaagccataagaatttttttaaggaaaggcaggagattttgccttatgtagtaagccgtaagattacgtagtatagaggtaggaacagcacagcgagaagcatcccgataatcaccctgcagattgaattaattaagcagttaggatggtaacgtcgaaacgaggactctctccgtttctaaatgtttgataccgttgtctttttagcatatgtttgaccattcgtcttattaaaaagaattatgcaatatgtaaaactatatgtatacgtgaaagtatatttaaccatgaatcaaatgatatgaaaaaaaattaataattgcttaatttttttaaataagacgaatgatcaaacatatttaaaaaagtcaacggcgtcaaatatttagaaacagagggagtatatactttctcacttaattagtaaatcagttggaagatcctacgcggtgataataatctcaggatgcagcccgtattcttttgcaaatatgaatgatgaaatggcttgtggtacagcagcctgcaaaatgtttgcacagatcaagagatcatcagttttccttgcgtagaacaggattacaatggcgagctaacataggagagtccgaaacgttccaatttgggtaaagctaagattaactctgagtctctgaccattatgtttgaacacagaaaaaactggccattatgttcttttaaaaatctgaccattgtgaacttaactatttgagtaaatctaagctaggaagtgatcaagattaaaagttatcaatctcagggaaaaaaagattaacaattatcaatcgtcttgccatggtaaagaaaagctactttcaaccattatcaaccgcgctcgctttctgaatattcaagcaggtaattaagaagggttggatttccatcatcgaagcaagaaaagaaaaagattaaagagcgtagttggaaggtaatatggaaatgtgtcgtgagaaagttgcgtttggtctctaaacgtctgactacaaatacattgtattagatacctgtatgatggcagcccggagtttgttgccgtgaaggccaaccattttggatgcaatggtcatcgcaatgggtccaagagcaaacttcaaaacctgtcccagaagccacccgcacagatcacaagctatgatactttcctgacttcccatggacaaacctgcagataaaatgagcatgaccccgccccaaaaacaagtgtccaagacatgcatatttgttacaaaggaaaataaaagacaatctgttactgttagtgggaaatttaaaaaggaaaaataatgtatatcccctgtacctggtgtatcatatactcctatgatatatacataggcagaacaatttatatttatgcatgtatgagcacatgtcaatgttttaatgcgagtataaatttgtacttacccgtgctgatcataggcagcgctcctatgcccagtgacaaggacgcgatattcactggtggagaaaccctttgtagtcccggttcgtaacttctctttagtcctggtttctaaactgggactaccaatccgaaactaaagatcgctatctttagtcccgggtgaaataatcgggactaaagatcgatctttagtcccggttgataacatcaaccgggactaaagatcgagctaacctttttttttgtatggccctattactgtatggtttatatatatatatatatatatatatataaaccatgcatatatatgtttcaatacatatatatgcatatataatatatgcatatatatatatatatatatatatatatatatatatatatatattatatttatatatgtttcaatacatatgtacatgcataatatatatgtatttatacatatatatgttttgcaaatgcatatgtatgtatgtgtgtgtgtgtctatatatatatatatatatatatatatatatatatatatatatatatatatatatatatatatatacacactcatatagggcaccatggtgcccggcaccatggtatcaaatgcacaaaatcactcaaatttttcaaaattttcaaattgtgagtatatacctagatataataattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtggttaatgttaatacctaagtgctttgaactgcttttgctttgcgcactacaaataaatgacaaacgacgagagatctaattaatatacacttgtatgtatttgaatcgcagaaatatatatgtagagcatgtgtactcacagaaaatttgaacttttgtctaagtctttctctccagttgccggggaccaaatgacggaaccgataccaagccctacatggagtttaaagctatgattcgtagtagcaattaacataacaagattttcttaattaacagaggaacttatgacagtacctgtctataagttcgaaaaccttgtcaaacgtagactcttttttatccattgagtcatatacattgacggtgcaggccgacaggtcgaaagtaaaagcacccagtggaatctacaatgtgcgtgggatgcattacatatgaaacacttagcaagttcatacgggaatgaaatttggtataggaagacagtaaaattaaactaactctgtgttgtacggcaacagtatgaacgtcttgtaatgctgcgcctttaggagatggacgagattgtcctctgtggcttgcggatattggtcgagcattgcgacgtttactttccgagggtcgatgaatccagtatcgaaaaccccccgccgtcgggccctttgaatctccattctacaatgataaaagggagtatattattttctatagtctacttatatacaaggacctaattaattaaaggagacgtagtaagaaatctaactgaacgatatacttacaaaatccagcaactcataatagagacgtcgagggcatccagctggtatagttcgtagattcccttgaaattgatccagagaatgtcatcctttaattaattaggtctttgttcttggcggcgtcaactttcgccttcttcgttgcccttgtgtgggcaagcggtggagcttggggggcccttgactttgaaggtgccggaagaggagcttgcggaggagtcggtgcaggagcctaaggtggagacggtgctggagcatgaggaggagtcggtgcacgagcctaaggtggagacggtgcaggagcctgaggaggagtcggtgtaggagcctgaggtggagacggtgctgaagcctgaggaggagatggcagagccggaggagatggtgcatgagacgccgcttgtcgcccagggaggatgatgtaccgcctgcgccatagaataatggcatggcttgtgtctcgtagatgcgtctcaccgtctcctccagggtaatccagcgcgaggtcctcgtacgcgccttcgaccaactcaacttcgaccttggagtatcctgctggaatcggctgcagtggtaagtacctgaaaggtccattgggatggccatgcccgacgccaccttcatgtggtgagaggttatttattagtaatcaacatatataagcagcaactagcggaatggccaaatctaaaatatataaactacgagcttacctttattgataagttcttgaaaggaatatgcagctcacatggtgtccactgaatgatgtcatcaacggggcaagtggattcgtcctggtttgtatggcgtccatactctgtgatcctacctgccccattgaggcgcagctgctacggtttcctgacgggctcaccattgcaggaggaatggtcggctggggatcatgggaccgatgtgcggccatgcgttcatcaaccttccttgccacctcctcttgcatgctgcgctcgtagctcgataccctgaactctagatctgcaatcttcaccttggtatctctcttgctcctcatccgactcctgtacgtgtggatgtcctccttgaacctaatcttccaaggaatcacccctttcgctcgtgttcgtcctggatgctctggagtctgcagggcgagtgacagctcgtccctctctctgtccggtcggaacgtgccctaagaagaggcttccactgcgtctgctagtcaacgcgcagcctcttgtatctgatcgccgaagaccagtgggccatcagctgggttgagcgttccaccgtgagcatagtaccagaacttcgatcgttccggctaattagcggtggccggttcgatacccctctcaag

SEQ ID NO: 67814 - DNA, 2691 bp, Oryza sativa
tgtactgtttatgtaccagcggtccgatggagaccgattaaggttgaacatacatctagaactccaagtgtaacaccccagaaaaccacataagcctgggatgccactaaacaaccatacaaaagtgccaaaataagcaaatttcagcaacaactaccttagataagaaaacatcaatacaacaagacaagcaacatgctaaacaagcattaaagaaatatgggaatcataaccatttgcaatacaaaataatagttggatgcaagttgcaaacccataaccatcctatatgtgcatgtgtgtcaagttaatcttcattttcataaaagttgtaggtattgttctgtagatttccaaagtgtatttatttgcagtcatatcctttttatattttgagatataaatgtttgaatcagcagtgttgtttatagtccaagcggcgttccttgtatttgcgtgttaacgggctagggccataggggcatattatttattgttttatatgcatgtttgagtgtatatgctgaggttgtcttgtgaataggtggtagtgcttcggattatgcttggtatcgtctcttcgttgttagaggcaagtaaacgtagcggtggtttgctatagctttaacctgttattttattctaccttcactttgaaaatatatatcatcaaccgagatattattattcgttacatagaggatttacctatctgaatcacatattgatttttacactgtatatggttatacttatgctcttggttataatacccttatactgatctccatcgaaggaatgtggttccgatattctactctggaattcatactgcatttgcatcacttgcattgcatttgaagttatgtcgtgaacctatggttgcgaccgtaccggtacagcatcgtatattgccgtaatacgatgcagcttcataccttattggatgtgaaggcaggagtacatatcattgcattgcatatgcacttattcaccttgttgggtgtgaaggcaggagtacatatcattgcattgcatatgcacatattgcaggatgttatgagaattatcgatcgaagatatctttgagaagtgttttcttctctgggatttgtgagtatatggatttgattggtgacgctatggtgttttagtccttggatattgaacttgtctttatgtgaatcataacttggtatataattagttatataataaacatgtggtttaaatagcttgttaaagccgtttcttgctaagatttattctcacccccttatagtcttttcaggtacttgctgtgacatgttggcatgtagggatgggattagctacacagtcgcacaacatgatctcacttagtcatgagttttgtaatatactgataagattacttgtgtttagacataatgagctaattaattactagagttgttgaccattggttaactacttttttcaagcctatccctatatgtcagtcagttgttgtatcataaacttaatctatatgttgatgcttccgtgatgttttcttgtctaaggtagttgttgccgaaatttgcttattttggcacttttatatggttgtttagtggcatcccaggcttatgtggttttctggggtgttacaccaagctacacttactcacaacttgaacaatggactacgccttgaattgcaagtcttgtgcaagcaagtttcactcagcgtcttatctggtactagaccgtctgtagactacccctcgggtggagcgtataagtcatactcctaggtctttagtaagcttcctagaagattcacccaaaatctctacagactgcgaccaacagtcaagctcacaaaggtgagttctttcaagaatgctctgcaggacagcatctgcgctaattaaagccaacagaactcattaaggcatagccaacctgccttgcagctcacgagagtacatgcatcttcacttagagagggtatagattggtactctcctctagtttattaatggtttgttcttcccaggttctaattcacgggatcttcgatcacatagattgggttaccaccatagtataactcacatgggtctcaaacccatctccttcgatgcattgtctatcacatttcgtgatagtcccttcgtgaagggatatgccaggtttctagctatttggatgtaatccaacgttataactccggagtttctcaaattcctgacagacttcaattgtcttttcacatgtctagacgatttcatattatccttagaactattcactttgacaattaccgttttattgtcacagttcataaggatagccggcaccggtttttcaacaataggcagatccattaatagatcacgcagccattctgcctaaacagtagcagtatctagtgccgtcaactctgcttccatggttgacctcgtcaaaatggtatgtttgcaagacctattccgccgctgttttggtcatcggtgagttcgccgcgtcgctctctacgtgctggtgccctccgttcgcgtcctcgcgccgtcgttcgccggcgagcatgcgcgcccgagccgccgccagaggtgacgtcaccgctgacgtcatcgtggccgtctgccgtggccggtcatggaccgttcgatctcagccgtccgttttggataggatcgatctcggtcgttcgtttccgtgagc

SEQ ID NO: 67815 - DNA, 1926 bp, Oryza sativa
ggggaggggtggggcccccgcggtgtcgccttctcccgtggctccgggtgcagagctggcagcggggtggggccagctgggccaggtgacgtacggcgttggggggtaggggagatcgcgaaccgacggtggagagcgcatcgcagagcggcagaggccatccgttgtgttgtgggctcctttctctctttttcctttcttctttttttttacttttgttttctgagaaaaatgaaccgtaaaataattttgtactttacagaggcctgtttagcacatatcagaatcctctgcaatcgaagccatataactttttcactgatatataggtccgatgatccttgagtccatatattagtgacaaaggcacttgcagagaatctcaatccatttagcacaagtttagctttagctttacctctcttgaaaccgaaactcagccaaacagtttcagctctacttaaaatagaaacggaactgggtgaaacgctttaacaaaatgaactaaagagatgaatatgggtttatgctgctctacaacttcactccagactcaactcttatagttaaatttagaagttagagttataagaaagaggtccagagtagctactcctttttcacatgactagtgataatgataataacggatcgcccctggttgcatcatggaggtcatgtgtgtcacgcgcccactggtactggtgcctcgctctcgaaaccgtccatttggtttccaagagagtgactggccatgggtgatcggtggcaatggcaactggcaagcaagttggtcacagcttcatggaagaagacaaacgaaaatctcgagacagagagttgaggtggaatatgctgggcgtgcttattcgctgtattgctggatgatccgataatcccccaccaagctaggttaacacttaacagcgtagttttttgcagcatcaccatacttcaatcttttgttgttactttttcaagattcgctcaccttgtttgagcgagtgttctgacttcggagcatcgactgagaaacaaacaggagcacccagatctcactagccagtgtcatcacgcaggcatcttcaattaattagtgattactacgtagttagtaattagcccaacacctggaaacgtgcaacaacagcataatttaacccctctcgatgatcctagatacgggagaaattattattatttatttaaacaacaatgtctatcggtgaactagttgaggaagaagagcagccgtctgaaactctgaatgaaacattggcagcctcgttgccgtccgtggtccctgcccttggacttgtccggtcgctttctctagccacaggccagatcgccggatcaacgtcgcgagggcacaccaaaaaggcgcggccgcgtacgacgacgggcctaccgcgccaggaggcgcgcgctctcccgcccgcgaattcggctatccccgtggcgtccgatattttggcctttgggacccttcctctctttgccgctagaatccacggcccgagagagcgaacgagtctgggccgtgcacgcgcgccgttccaaatctgtgtgtcggcatcaggaaagggacaccgggaatccagattacaacttacaagaaaaagaaatgctgatgtccaaaaggccaggtcattttcctctcaacagaaaaggcaggagaatcatataatctgttctgttcatggcaacaaggaaggggaaaatgagttatcttcgtagttgcggacttgcggtctcaaggtatatagtggtacagccatagaaaggaaacggcagtaatttacatgtgagatttcttgttttgatctaagcacgctaggtgtgtttcagaattcaaattccttcagatgttgtatagagcacttatcagtcatccagtagctgacgtgagggcctcagtaagga

SEQ ID NO: 67816 - DNA, 525 bp, Oryza sativa
cataggggttgagatccatttctttccgtccttgactgcaccatctggcaaagttatcctgaagaaagttgcagggaaaaaaatcacatgagaagaattaattgccattgccattgtgctgcacattgcaggtcacagtgtgccacatttgtattgtaactagcaaaggtacattgagaaaaggaaacctaagcaccatataatcaagggttttctatattagaatatttaggcagaagaaatgcttgccgtctctattttcttattaaagacagatggatgttaaagttgaataacattatggcattattatgcagtttgcgcagcgcccattttgtcgtcgcatcgacattcaaatattcccaacactcaaaatccgactccaaattatgcagcacaaagcatggctatcgacgatattcccttggtgtgctatatgcctatatctacatctcaatgcctgagacatctgccatccatgtagtatctaactccattttcatctataacgcgccgcaagcatta

SEQ ID NO: 67817 - DNA, 9657 bp, Oryza sativa
aatagataagcacagaggatcctaatccaatgaaagtctagttgactaaactcaaatatagattatacgaaactataaacactaatcaacaaaacaactcttggtacttcctatgctcctgatgattggccaattgctgttgcctttctaaaagactacaacaccaagcgtgctcaagcagtcaagctaagtggtgtactagtgcgcgaccagtgccaccatatgtgtgatgtgccgcacatggccacgcaccgaacaacctagagtcatggaggcgggcagccagcctcgtagcatgccttcatgtgcttggcgatcccagcctgtgaaagacgcttgctagtgctcctagctgcccaaataaagtgctgatttgcctgctacgcagcacagcagagaagccgttccactgttgcaggccgaggagcctgggcgcccagggtggttgggccctagatccacccctgtatgacaaggtaacgccacaactcacaactagcatggataactgctaactctcaggagctgttgtcaacgaatccactgtctttttgtttttacctagaccttgattttagtggcgtttcctactttcctcctgttcctgtacaatagtcgcctcagttgcaatttgtaaataagctaaaccataaaaaatatcaatatcaagataaactaatgaggtttctataggggggttaggacataagaacaagcccattttggccctcgaacattgctcgaattccagttctcaacctaaaactcaacagccacatatttttcacactgaacatccaactccaataccctagaacctattctgtgaaatgttggccaaaatggtgatctttttcgcaaacgtgcaggtttggctaacatggacccatctaagtggcatctaccccgaaatttggctagtgggagtccatgtcagcaaaaccaacttgaaaaatggttcaggaagttatttctttgggtttggaagttggggatgcaaaacagcaggtttttgaagtttggtgaaaattggactcacaacagagttcaagaaccaacaatagatttttccttatgcctatggaatttcaaaatggtatgacaaaatacaatgaaaccagcgaaacgcacactgataactgtttactaggaatactcaatagcccactgcctgtaatttttaacagaatgtcatttaaaacgtgagagcaactttaataaatctgactgcatattaggttatttttctataaattcaccaaggctatgtcaaaagtcaaaacaaattaactggtttaaacactttatgttaagatgagatagcacaaatatggtccagtgcctctacttggttcataataactaaagattatcacactcagtaaaggatttaccattttattttatctcacctttcagggtacgtaatccttcagtaaacgaacttgttaaaaactttatttcttagaggggactaaaatgtcttgacatggcataagaccacagaggaaaaaatacggatattgattttctcagtttagaatagtgggaactgggaacagaccgttgctagaattaaactccaaccctaagttgggtcatttacagccaaaatcctactagcatgacacaatattgacccaacaaacaatgatgtaaagatctatttattgtatatagaaagcaccttgaatactgctcaattatcaaagtgtttatagatgcatttgtgagactagaatagcatctaaaatagatactaaagaccaaagtgttctgcaggatatgttgatctcttcgctatagtagagaacaatggcactttggtgcattgaatgatacatctttgaggtatgtgagaggggattgagtttgcagaaacatcaagttaggcaatgcgaaaacctaatagaagcataacttttatgttgtggtaccaagagtgtgcaatctgcaatgggatgaaatatttgctcacctttggtatgttccaaacgtcctgcctcccgcttagcattgcaacctttgatatctttgtatctttagttctcaaaattctaaactgttcattcaaatcaatcgacctctccaggccagcatgaaccgcaataagcttacaaataatctgtccttcgttagtatcaatgggtacattttcctgccatacaaccatgcaaatatctaagaaacaaactccctttgcacctctcattatactttgcaccataaaaggatagcatacctcctcatggatccaaaccaattcgcgcagaaattttttgtgctcctcaggtacagccttcacaagatctgaatgacaataaaactttgtaagcattggtggtttctattgaagggaatcagggatccctccctccctctctcaaaagctgtatttactggtaaaaacaatagtagcaaattagaagtagctttgtatagttgcagcgggagttgtactatgaaaccatgcttacaaaccctgcacgagaggcatcaattcgttgtttgctttcattaggtgggctaaatgacactaccttgaaaagttaccttcactgttggtgaactgctcgctagcttgctaaattttgttatgttgagactacaggtcatcgaagtactataaaataagtttggcgctaattctgttagtgtatacaaaattcacctgtctataaatgttatcatggtcttatacttttgtgctttgtaaacagtactaaagtactaattcctaagattgtaactagagaaatagacaattgtgcattgatttcatatttcctggcatttggatttcagaacttcttttaaggtttacgcattgtatagcattttaacattttgggaaagcaatcagaattttcaagtttgaagccaaacgataacaatctagagagttactagtggcttagtgccagtcacctatggtccgttatgttccattgcaaagcatgaatacagatgaataaatcttgtgcggtactcctgaacactgacctggggatccatgagcaacgccgtaggactcgaaggtagggcgcgcgtcgtagatggagcccatgtacgatgaccccctcttgggattcctcttctccttcatgatcccgccccatctcctcccctggcaatgcatcccctcgtggccggggccacggtaccacccctcgttctcctcgttctggatgtactccccccaggtggacgagaacggggtgccgtcgggcggcggcggcagcgccccgacgaaggcggcgaaggcgaggtcgtggttgccgcagaggaaggcgtggcgctgcgcggggtggcgggacgggagcgcgaggaggaagtcgatgacctcgcgggtgctgggcccgcggtcgcagtagtcgccgaggaagacgacgagcgcggtggcgaaggcgtcgggcgggagcgcggactggaggttcgcccacaggctctccagcttggagatgtagccgtggacgtctcccacgcagatcaccacgcggggaggcggcggcggtggcggaggagacatctcgccgccggcgtcgtttcctgtttcccacaggttgctgataacacaccacagaaagagaggaaaagtagaattccaatttccaagtagcccagggaaacaaacgcaccgtccgatgatggtgacaacacgatcctgaccgtccatcctgatgccaactcccctcttcggctcctccaatcctctccagtgcggccggtgcctttctacagcggcgttccactcgggttggtctctcccccgaggcacggccgccgccgccgccgcgctcggtctaatcggaatctatttctcgacgcgactccgcttccccggctcccctctcacccttccgcgccgccgccgccgccgcttgtagtggttggggggcgagcggccgctcgagagcgaagcgatgctggagaaagacaggatagcctacttctacgatggtacgaccgcgcattcgctaagcccccctcatctcctctccattctccctaatcactggagcaaccctagctctagctctagatgatagagcgaaatcctacgccgtctcgatgttgtgtggcttaatttcgtcgaagaaggggcatgcaattagtacctaagctgatttctagtggtgttatatgattgtggaggttggagtggatgttacggttggacggcttatgagaaattccagaactatgaacttcccaggacttgttcaactaggatttgtggtatttcagttgccctagccctaggtgcatgacgcatgattcattatcagtcagtaacataaggtggggaagcaacccttgaatcaagatttgaattagaatcgttgatccctttatctgtttaagagggcgcagtcaggctagatttggttaacaagttcctatattctttagcgccagccattttctaaaaggtcaccaacgccagccatatgtggttatttcttagatcacacataaatttccatgataagttctctcacatattttgtactaggtggtttcatgacttgtgccctcattcacccatggtcctttacatctctgtttatagagagccactcattttgcagatgtgaaaggaagttttcattgttcaaaatgtgtaatttttattactcattttgttttgatcgtttacctttttactgtgtcaatgaacaattcaggcgatgtgggcaatgtctactttgggccaaatcacccgatgaaaccacatcgactttgtatgacacatcatcttgtgctttcatatgatcttcacaagaagatggagatatatgtcagtatgaactttatttattcccttcgtttgcacttgttaactgcctaaagttcctttcacctcttacttttcacacaacgatttatgcagaggccccacaaagcatatccaacagagctcgcacagttccattctgctgattatgtggaattcttgcatcggataactcctgacacccaacacctgtatgaaaatgaattacgtagatgtatgaattatgaaacttttctcctctatgaactagtactctgggatttgttaattttacaataaaatggttgtcacatatcttgctactcatgtttaaattattataaatttatttattaagttccttacctggatctaataagtagcttagatcttcatgtacagttaaactataaggaatctcatacacaacttaaggctaattagcttcacttacatgaatgctgtcaggtgtatattcacgatatgcctatttgacaattcaaggaaaatgagggcatgtttggtcccctttcaagctcaagcaacttcccatctaacgctgcctagatagcgttggtgtttagtacagcttagcaagtcattcttcataggatgtatatccttgcccattgaagcgcatcccttgtggtcaaggtttacatgatttggtgcactaaatagttttggatatctttacagtatttatatagtattagttgcactcttctaggacacatgtgcttattttacagtttcagggcaaaataactgaacacctaacctaagtagcagagtaatctggacaaaagatccaacttacccactcttagagcttttccccaattgaagttggtttccaacataatcctcatgccttttggagctttctaacttcatttatctggttccttcatatttgttcccagacaatcttggagaagactgcccagtctttgataatctgtttgagttttgccaaatatatgctggaggaactctaggtaatatgaaaattctgaatgcttctttctaaagtgaactcttaagttcttctttgctattttagatgcggctcgcagattgaatcataaaacatgtgatattgctatcaattgggctggtggattgcatcatgcaaagaagtgcgaggcatcagggttctgctacattaatgatctggttttgggaattctggagcttctcaagtaccatgccagggttctctatattgatatcgatgttcatcacggggatggagttgaagaagccttttatttcactgacaggttcatgctgtttccaataaagtcatggatatgtagttaatcatttattgctgccaatatttttccaatccaatttccatctctgtgcattttgtgaattttggtggtaccataatatttatactaattccagtctcgggcttttgattttgcagggtatactaatattgtatacttattttgattttgcagggtaatgactgtaagtttccacaagtatggtgattttttcttccctggcacaggtgatattaaggtaatgttccactaacaagctcctgaatattttttatgtactttttggtatgatgtggttggtgattggcccttctctgcattctgttttatccttacccttttcgcatgaagtgtgtgtgacatgcgtactctcatttgtgtgaaaagagaagagacagattaaccaaagatggtccccagttgattttgtaatgcacaaaattgatagcacctgtaggtaattgtttatgagcagttaatcttgtttctttttagttctacccgccaagaggctgtaaatatgtaacatcatagagttgaactttggttttttttactggagattcttggcatgttattctatttaaatatcaaccattgtaattgggaattcaggtggttatgtatttgaaaaacgtcatactagaatgcatcataattcgtatacgcatgcttaattgtcatctgggctgacaaaaaaaaaacatgtgcacatatacgcccgtcatttgaatcttgtagtatgttaatttgttatgtatccactgtactactaggcaactttattaaataaaaatatcccaaataactggaaggtagagcaagtgtgctacaaaaagggcaaggttgaaaatgaacataaaacatgccatgttcttctcagtaacgatgatactttatatagcttcgttttaaatgattgtgctgcttcatattgatttacctgactctcatttgaaggatataggagaaagagaaggaaaatattatgccattaacattccacttaaagatgggatagatgactccggctttactcgcctttttaaaacagtaagcccactttacattactttctcatctttcatgtcattgtttagtcttatcaagttatgcatgtctattatgtaggttattgccaaagttgttgagacatatctgccaggtgctattgttcttcaatgcggggctgattccttggcacgggaccgtctggggtgcttcaatctgtccattgaaggttctgtacttcttaaatctgatgtgtacttgttgattcagcagaactgtgctctagatgtaaagttagtgaactgtgctgcatattcttggatgagctattagggttcaggcggtatcttcgagataatgtgaaaccttctctcaagtctcaattatttcttaccatagttttgagattgttattgcactaatagttctgacttattttgaaatttaaattttgtttctttgagctatacttagtgaatgatcttttaatacttgcatgtgtacttgcaaacaggccatgctgaatgtgtgaagtttgtcaagaaattcaatatccctctactggtaaggagaaaccgttactgcgtgtgatttctcttgttcctccttggatatcaatgtatttcccatcatgcaggtgactgggggtggtggatacacaaaagagaatgtagcacgctgttgggctgttgaaactggtgttcttctagatacggagctcccaaatggtattcttttcttttgcaattctgtacttctcggtccttttggcctgttgttttagaggacactactagtaatccctcaaatgcatgcaacagttcatgtattcttttcctcacatttgctggcatatcaagttgcaaacagatctatcaagaacgggattgactagtagagttccttaataatttctaaaacagcagtctgtgatatgagttttgcatgactttcctttgcagaaattccagacaatgaatacatcaaatactttgctccagattatacattgaaagtatcgaatgtgaacatggtatggaaccttttctcattggcctttgtttgtcctacggttgtttggtgcattgatatttgattgctattaggtgcatcaagtaactgtccttttattactgagtatggtctaagcatttgagctctgtagtccatttggtatttcggctattcaattggtttgtgtttgctagaagtttaaaacttgcgttcctttcttgagaatgtgcaaatgccatatcacatgttgtgttttaaccggagcaggacaacttgaatagcaagtcatatctaagttcaatcaaagtgcaagtcatggagagtttgcgggccatacaacatgcgcctggtgttcagatgcaagaggttagtttttgattcacttacacgaggaaacctcccaactggaatttgctatgtaaaaaaaagggatacaagcaggacactataatattcctttccttttgttgcctatctttttcttcgttcaacatatttctgaacaagaacaatattaacatttttgcaggttccaccagatttttatatcccagatattgatgaagatgagctggatcctgatgaacgtgtagatcgtaagtgaaatactcctgggatgcattaggatgctaatatgtctgggtgtctgctgttccaagaaaacgaacggcagacagttgttttttttagtatatgttgtgtgttccacattatgctagtcctttcttcgtgttgttttcagacctttgaactttatatcgtccttatacattaactgtgtaaaatgttgcgcagagcatacccaagacaagcagattcatcgcgatgacgagtactatgaaggtgacaacgacaatgatcatgaggacggggcccgttgaaaaaggttctttgtatgatgaaactggatagagaaagtctggtgctgttgcgcggtttaacagcgttaggtgggaaatactgtcaattgacttgttaggatctaacacctttgcctgcatatagtgcgtgtacgttcctactttttaatcagttacatatgctagttgcatgcagagattgcaaattcttagtcggtggtaatgattcatagtttttggctgcacacatttttcctatctttttttgtttaaacccggcgtatgtggttatcaggttggacctactctcaacgtccttaaaaagaaataaacttctataatttggatatactttgtgttagctttttctttaagatagagggagtcagctggtgcacacgttttcctaagagtgtttcgcactgctctgtcaacttgagccagatcgttctcgctatcaaattgggcctgatcggtaggttttgggccaacctgagctgaacgcagaggcgttcccgggcagtaacggctggcccacctgtcacgttcactcacgctacgtgcgcttcgagcgttcgacggtcacggggagtcggagtcgctgccaaccaaagcgggcgtcgttgcgttgcgtggcgtggcgtggcgtggaggcagggggaagcatcgcgcgcgcggcgtggacatgtgt

SEQ ID NO: 67818 - DNA, 595 bp, Oryza sativa
aatatctttacatagagtagtatcggagtattagccgatacatgctagatccatctgattggctatgctatgaacatatatagtctcgttgttaatatatatttcgatctaagtgatttatactatctcggcatggcgaccgatctatcccaatcacttgatttaagtatatattgacataaggattatatatcgttaatatctatagtcgatctagtagattttgttatttcttacttattaatgattgccgatcgatgcatatatgacatcggctcaaagataaatgatatgtcatcggcacttagccgatcggctatcgtttatggattcaaccgcagtttctttgtctttgttcttgttgattgcaggatcaaatcaactggcacgctagcacacccgaaggtgagttttggacctacactggagttaagcagatctcccaggccttgtgttttcacatcaacacgctttggcacgcccggtgggaccgatcggaagtcagaatcacaacagctgtttttcctcatggcctagaaaccgccagcgtcgccgtctttggctggtgagcctcgctctgttaaagctaagatcc

SEQ ID NO: 67819 - DNA, 602 bp, Oryza sativa
ccaagatgacaatgaagacaggaagactcaatggtgtccttctggtatctttacaaaaaatcagaagagaagggtttaaaggttgaggaactggaagcgctttcaggaggttgagcaagaaatcaatcatcggttgaagaaggcgaagccgagacaggtgtggcgtgttagaaatcaagctcctgtagccgatgaagccgcagccgatgaagcgaagatgttggctaaaggaaaaagtgttgtgaccgcatcggttacatggttttcatattgcctgctgaatttggggtcaagcaagccgatgtcgatgaagttgaagaagaatcggctaagttgattttatcaccagagcaagcagtcttcgagaagccagaaggaacagagaatcggcatcttaaaccattgtatataattggctatgtcaatgggaagccgatgtctaagatgatggttgatggtggggctgcagtgaatttgatgccttatgctacatttaagaagttaggtagaaatgctgaagatctcatcaagacgaatatggtgctcaaagattttggtggtaatccatccgaaaccaaaagagttttaaatgtggagatgat

SEQ ID NO: 67820 - DNA, 3007 bp, Oryza sativa
atttattagtaacacgtgcacagaaaagtccaatgtcttcttttaaatttgttatatgaaccttataaagttatactatctgctaagaaacaaatatgactattcatcttcatacactttcaaggcaaacaatcatgttaggaaacctcactaaaaaaataagagtaggaagaagcaaaacctggtagagcttgacaacaggctgcagattggctgttctcttccgcagagcatgtgtcagacggtcaatgtccgacattcttttgagttggtacctaagtccctgacgaagctctggatcttctacgaaagcctgaaccatatctaatctgttattgatttcatttacatctagcagaggttgtttcagccatctgttaagcagtctctttcccatacctactgtacaggttctgttcatcaaaccaaacaaactgaagttcttgtttacatcagttttagcttcggcaatattcaatgctcgcacagcagcagaatcaagacgcatgtagcggtccaaactgtatttctcaattgtgtaatttccgtagtttgtatcatctgctagcaactcagcatatgaaactagagctccaagggcacccaatgcatagtcaaactgagatacaagatcacgaactggctcaacaggacctctgattattctaccaagatcctgcacaagatctctggatttaaattcaaccttctttctttcagttaatagaacattgcagttagtgatagcatcctgaagaggcttcaaatctatagatttctcacaatctgctgggagaagacactccttgcaacctaatgcaacaagggctgactctacatttgtgaatcgactatcttcgggaaactcagacaacccaagcttcctgtttgtcaaatcaacaaaactaagacctacatatagttgtgctttctggaacacaggaaacaatgccacagttaccggagaatcttgcatgtcattgtttgcaaacagaatatcttcaaaactgccaatatttccaggtgttccagattttgttaacctccaactagacccacttccctcatagagttccaatgtacggtctgtcctctctaacaaaaggttgcgggcgatggtctcaaacatagtcttgctcacactgacacttgagagtccatcagagttgctacctaattggcgtaaggcagacattgtgtgatagtatatttttgcaatgaatgtggcattctctccatgagcagtgtaataatcctggtcaaatatttcagcattagtttactggtcacacttttaagagcgaaggcagttttacataggatgataggaataaatactattgatcaaaaagaaaaaaaaactgatcttttttgtttgagatgaagaaactgatatcaagctcagcaagaaactttgaccatgatttttgaacagtggataatactgagaactccacaacaattatgaaagcatgttgtgaaatagatcttacaatgcaattttcaacctacaaggcataataatatagaaattgagtttgaacaggtgagtcagagctgtcagtatttgaaaaacaaagagagtatatctcaacagctgtgattcattatgaacaccaactacttctgatgatacaacgcgtatactgtgaagagaagtgtgaaagtgtctgtgcgcgtgatttatgaaacaccaacacacatgtgcctggctcctgaaaggggacacacaggtaaaggggtaaaattactttccaaagctatttttttagaatactgtacattccactaatttgttagataaacatttgtgaacattcggccattttatcaataaactgagaagatactagacgtgacaaatatattcaaataatatatagcccgaatttatcaacaaagcctatgtcttatacattggctaatggtggcctaattttccagtgcatgtaaagtctacatgaaactgaagcgtagcatatcatcggaactatgatggagctctgaaacttttgtcaagataaatcttaagtttccttcaaatgacaacttgagttatccggaagggtaaactgacactgacaacttggattgaaaaaagaaaaaaaaaaactgtcactgaaagcctgaatagagacaaacaatctacagtcgtattaggggaagacagatatgcactacttctcataatattacaattaatggaactaattccccattaggtttgcacagtggctcatcaagaaaacaaaagcatctacatgtatcagaagtcaatgttaactgcttacccgccgatcgaagagacgaatagccctcgaatcctatacatccaaaaaaagaatgaacaggttaggaaaagaagccccgaaaatttgtccaaataagggaagaaaacaaaaaggaaagagggagaaaccaaggggaaacggacgcacctgcggcagtttcttgaagaaagagatgaagccctgcgcttgcctcgcatctattgaaccaaacaacaccaagtgagcgaaccaaagaaagaaggaaacggatccaagaactgaagcgcacggacctagcttgagctcggggagcttgccgccctccggcaagaagtcgtcgccctccatcccgccgcagatcgccgggctggatcgggcgaggtggtggcgatgggggacgcaggcgatgtgttcgacgaaatgcgtaggtacgcgcgggcggggtggggcgggaaaagggttagtgttttagggggcagtggagaggatggcgcgcgcccaggtgggtatttcgcggcaaaaaggagaagattgggggggttttggagggtgagcgactgatggggtggtgatggggtgcgtgcggtgcgggagccgaggcggtcgacagattggccggcagcccggcagcagtgagcctgtgttccacggtccggtccttttggggcgatgggctcatggccgatcaactgcgcaacgctccggtgcagccccgcacgatcagttttttcttctag

SEQ ID NO: 67821 - DNA, 5510 bp, Oryza sativa
ctgcggtttgtgatttttattctcggcaaaatggacatgtccccggtgatcacagttctttgtgcgttcagaaaaactagaaagaaacacgcgctacgctgcgtgcgatgatgattgtattaacatacaacaatgcataataagtattctcctgcactttaatgtgtaaagagcagtgcatagtcaaaatctttcactgccaatgtacaaaatgcatacatgactcatggccaagcaggcctttatatgttactgcaacctaaaagatgatacatcaatataagaactgggctataaaatgaccaccttatataaaaactaaataaattgataattgcatctttcatgtacatatacttgcatagcttaacaattcagacatactgtagatttctcctgcttcgtggaagaacacggatatatcattgtaatatctggaaatccagatgcccaccaattcctgacaaagcataaaggtaaaaataaatctatttgtttgggttaattaaattcaagatgtgtcaaaattgacttaagagtcaatataacagatcattaacactggtcatatgtaaattgagatattgaggtatatttgaaatgggattttttttcataaaaaagtatttgtagctatggttaggaaatactgtagaatcagactgcaagtggtagagatgaaccatgtgctgattttgaacaccacctacaacaaaaagaagcaatccatgaaaattggtcaactaagataatgtccgcaatagaaggtcaaaatgaccacataagacatcataataaagattggataggatctatgtgttagtataaagcaaaatgagttaactaaaaagttcgcatgtaaaccacaaagaatgagctgaatagaagtgtactaattattgcagtagcaacttaaggagcagcaaaaaaaccacatttagctcatcaaatattaccaaactattgatgatccaatactgaaaatgaaactattcctcagctaatcggtcctgcaatgcaacgcaagaaaaacctaatccaataactcctaataaattagataatatgttttaagttttactaatgatgaattagatatattgctggactttaacatattttcaaaaacatggtaaatttatctcctagagttggatgtaaagattaaagttagactttctatgcaataagatgtactatacagttcatgaactgaacaaatttatagaaagcacgacctaggaggacatgacccatgaggtctagagaacttttgggttattcataatctctagatcaagattcatggtactaaatgtgtaatcctctatgtggaaactgcaaaatagtcctggcatgttatagtatccaagaacaattttcgtaaactcctctcgaaaaagtaaaaaactgaataattgctattacagctgaatacataacttgtatgtttagagaataagttatataggtgacagaatatgtgcgccatacaaagaggagaacatggggagtccatgtgaacggttcaacttagtactgcaagcactcgtgtaaacaggtaaaaccgatctatatagactaccgagcagagaatgaagaagcacatctagactttcccgcatgaccaagaagaaaaaactgaacacaacttgcttcacatttgtaatttgggcatgcaaaaacaaatggtttgctcaacatagagcaaatgttctagcagcgagaacaattgggttgcaaagacaaaaggaagatctaacatggagcaaattttatagtagcaagaacaattggttcgcggagctaattcaggtaagaattgctctcaaaaacggtaggatttagctatctaaggtatgctcaaatctgacaacatggctgcagaggcaaattagtaaagataataattcacattacactcagtaaacaataattgaagaacttgatgggttttaccttgaatcaaaggtttgatgtaggcaagcaacctttaatatatagaagctaaactcttaataatcatgcggagtgaaataagatgtagtgagataataatatagcttgttatcatgagaagtactccgtcgtatacatgggctgctagcaatccctggctgcgccaagctgccattgcatggatggccaagcaaaccagtttagcagagcttgttgtggcactccgtcgcaggctgcatttgcacagccacacatgcctcttggagaacagcacattcgtatgggctgctaagtagcttgttcttctccatatcaaaacatcaaggagagcattccagcgagcaaaatgtagatggatatatgcactcaactacaaactttaaaatttaagggatccatttggggaaaactcaccggggttggcagaagtttcttgagtggattaagacatacgtgctaactccaactatttgattgtaatgaatatacaaatgatgaggacaacaatcatatgaacacggccatgcctgaactaacaaaagcagaaacatatatgcgcatcttacctgcaactggtagaaataaaatccaagcaacctatggagtaccagcagatcttttgccattagataggttgctttgaaccactgctgcaagaaaaaaagggggatcgaaccaaaaaaatgaaatccagcaagatgagagagaaaattagatggggaaaattacctgttgtaaatgcgatgagatcttgccgcagaaaaagaactgatgcgagggggagggagcgcactgccacagagaaaaaaaaaaggtggagggcgccgtggggggattcgcgtgcccgtgccttgcccccatccttaccaagatgtgaccgtcctcactggcagatgaggatggtggccggtggcggctcacgttcctcttctccaggcggatggattttttattgcagatgcggcgacctgattggaaagagcggcagtggcggaagcactctgttcacgattagaggagggcgacattgcggcggcagcacacgtaagggaagaggcgggaaggcggtggcgaggcagagttaaaagaggagaagaggcggcgacggcttgcatcccctccaccgcggaggcagaggtggccaaacgggcggcacggcccggcccggcacgggcacggttccggcacggcccgtttcggcacggcccgctaggcacggctgatgaaacgggccgtgccgtgccggcccacgtgccgagccgccggcccaagcacggcccgtggatggccgggccgtgcccgtgccggcacggcacgcccgcggcccacgggccgttcgggggcacggcggcccgtgtgcacagtttttttttttaaaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattatgaaataatttaaaggtaaatccacacttgcgaaaatattgcaaaagaatttgttaaaaatagtaatgacctttattgatgtttatatcattacaggatacaatgatacatgctgcggtgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaatgttagagtagaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcaatgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctaaggttatgagattgctgaatgtaatgttcaaaagcaggggactccccaaagttcaggggtaaatcttgcctggcgattaaccggacaagagattcccgagcaaccatgggatcgtactccc

SEQ ID NO: 67822 - DNA, 5777 bp, Oryza sativa
catggcgcttgaggtgacctgtaccaccagaagaacgagcagataaaatttgcctacatattctacaacgggctttcgatacgggcccttccgtcggggcatgtttcctttatctcgtcgaagctttgccacacaccggaggtctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaatgcacacttgagaacaaagagagcacttaaaacacttgagagcacaagatgaggagtgtgggatgaggagaaatggctggggttcatgccctatttatagggcgaaatttgagattttttggaattttttcggaatttttatgaattttttagcctcccaacggttattttcaaatttcaacggtcaaatagccgttagtgccacgtgtcgccgtcccattggaccgccgcccgcctgccgcgcctgacgggccgccgccgtgccgtgccgggccgtgccgcgggccgtgccgtgccggcccgctacagtagccgggccgtgccgtgccggcccgcgtgctcggccagcggcccaagcacggcacggctaaacgggccgtgccggcacggcccgttactgtagcaggccgtgccgggccgtgcctgctacaggtccggccgtgccgcgcgcggcccgtttggcccggcccatttggccacctctacgcggaggagaccggggtcgccgtaggtagagggcacatggacggttagatcgagcctatcgtgagatcagacggaggacgttggcgggaactgtcgcgtagttaatagaaagcgtggggttttttctgcaaaagatcggctgacgtggtgtgctaacttttcaccgatcctacggggtttagagaggttaatatacttacacacgtttattcttttcattattcgttccaaattgtactatagaagacaaatgtattccttagaagaaatataagtactccttactatagagggctaatgtactacatagtaaattattatatatatgtttttcgaagaaaatataattttcgggctatcttctttgacatcacatttaaatttactgtcatgcgacttaattcataacatgtttattcttcttatcattctactccctccgtttcacaatgtaagtcattttaccatttctcacattcatattgatgttaatgaatctaaacatatatatttatctagtttcattaacattaatatgaatgtgagaaatgctagaatgacttacattataaaacagaggaagtatataattttggttccttgaaacattgactagaaaagaaattgggtatttcatctatagtctttttttagggatatgtagctttttttttatttcatttttttggcagctatataattcaaatgcggatcatgcggatcgtacattggtcatatattctcaacaagttgtaagtatatttaactagattgttttcactaatattacacattgacaattactcttttaagctcgcagcaacgcgcggggtatcaactagtttatattaggaagcaactaaccaacccaacaccctatttttctagattgagaccatccacttctgcgcctattttcctggatcgaccaagagggaaggtttttccctgtgtgccattaaaaaagatggtgtctgcccttgtgccactaaaaagtttgagcctccctttatgccatcgtcgaattttatcgtgccctccacaccatttcgtcgctattctgtttgggtttaaccatttggtagctctgacatatgggccgggtagaaaaaatgtcgctcctgccctttcactttttcttctccctcgattcccctcttctccctcaggccgccgccgcgcaggcccgaccggcgcccggccgccgcccagccggggcaccgtgccgccgtcgcctcggcccggtcgtcgtcgtcctgatcctcgtcgtcggtgcgctgttcctcatcctcggcccgaccggctcctccagcttcaccatgccgcggatccgcacggagttcaacgaacccgtccacgttgcggtggcggctccgcctccgccgccgacgcagatgcaagccggcgtcaacacgagcggcgaggaggacagtggcctcctgccgacaacctccgcctccgccctgacggcgcgctcgtcgtgctccacgtccagccgccgccgagcatcgccgccgggctcaaccccggacccatccccttcggcggcccgagtaagcaatctcttgcactcgtcttcgcggaaatcaggacggacacttggtcctgtggctgtgagctgtggttcttgcgaattttttcggtcgagctgatggcttcctggatgtgccgcgcggctgatcaggcgaggtcgctggcatcactagtagcaagcatcaatagtcctcgccgccgtcgttgtgctggtcctggcataactagtagcaagcattactagtagcaagcatcaacagtcatgaacaccagtagcaagcatcaatagtcctcgccgccgtagttgtgttggtcgtcgtcgtcgttgtcgcagcgctgccgccgccgctgtcgtcgcagcgccgcccccgtcttcgtcgtcgtcgtcgtcgcagcgttgttgccgccgtcttcgtcgcgcagcgatgccgccaccgtcgtcgtcgcagcaatgccgccgccgccgtcgtcgcagcgctgcccccgttgtcatcgtcgtcgtcgcagcgcccgtcgctgtcgcagtgccgccgtcttctcccctccgctcctttgctgctgctgctgctgctgctgcatctgaggggagagaggagagtgctaggagagagcatattggaccaaagtgcaactaagtcattttacaacggaatggtgtgaaggatgcgataaagtttaactatggcagagagatgcttgaatattttagtgatacagagacaagcaccatctttcttaatggcatttagggaaaaacctcccaagggagagggcacaggcggcggcgacggtggcagcatcctccaatggcgggcaacgaccaacgggtgatattggttggagacggcggcgctcgcgggccgccgctgtccaatgcgccgcgccatggagatccccaccaccggccgacctcatcctcgccatctctctccgctgcctggttgccagacctagccagcctcccctcggctcgtcagccccctgcggccccgcctcgacgcccctcctctgccggtcggcttcaggctcgacgacgccccaagatccagtctccacgagctctgcccgagagtgtcagaccttcagcgtcgcgtctgtacatccgccgggcgccggctgagagcgtccatcccaaatcatttttgctgtcgttattgttcaactggaattgttctcatgattttgttgccagcctaggtgaaatagagcaatgctacacgtactaaatttttcttactaaacttttactaacaatcatctcaaccgtttaatttaaatatatagaagttacaaaaaaaaaatctaaatgcactcataacatgacacatcagtgttagtaagaatttaataaaaaaaaagttagtacgtatagccttttccggtgaaatacatccaccgcagcagtcgacaatcgatgccgtgtctggatccgctcgtctccatcggcaacgtcgcctctcggtcaatctccaccgtttcaggtttgcagtcaacaagcgcataataggagcgtttcaggtttgcagtttcagagtgccaacatcccgcttttacttgcttcatgtttgtaatagtttcatatttgcagtttgattctaaactacccaaatcttttccactgcaatcgatgactgattttcttagacatctgtagatgtctcttcacaccatataatccttgataaaattgcttggatctcattacaaacggttcaaagtgatttaatctcagaattttaggattatgttttttaaatgtgcacgtgctccattatgcacattttgtgctattttctttgtttgatcaattcatgggtgttgaagctctgcttgtttccatgttaaaaactagagttcatctatttattaagaaatcctagttttatcagtattaatttggtcaaatttgagtgcattaaattggaacagatgggagtacatattcagatgctatcagataacatcattatactttgggcaggtataaaaacaaatgaacagtggccagaatttcgaatttgagctccaaaaaaaatattaatggatttggtgcctgcgtcaggtttcaggcttggatttgtccggacgagctctctacgactgatgatcggctggctccggcggcatacgatggaagaatcttggcgactaatgtcctctgcattgtgattttttggacgatgagtgtgtgtttgtaacggtgatggcatgaccaattacacgtgtacagtaaaatatttactgactatatatcaggcctgatgactgctccctccgtcccacaaaaattcgattcctagggtcgatcgtttgtcccacaataaatcgatttctatgccagagattgagaaacactaattgcatctttatcatttgccctgtgttgtcttgtccaccacccaccaggtgaattaaaaagaaatgaaatcaccgtatcatctccagtgaagggaggctttcaggaagtagtttggcacgaatttcacatgaacttttttttaatgaaaagtgctaatcgtggttgtacttaatgagggtgttttggtcctttgttgcttggactaaaactgcatcaggcatcaggcttctagggttcgactttatctgggatggaggaagtatgttgtaatttttctactcatgtaaggctgtgtttagttcctgaaaatagttgaaagtttagggaaagttaggagttcatgtgtgtaggaaagttttagatgtgatgtgatatgatgaaaagttgaaaattgggagtgaactaaatacggcctaagtaaggtccagtaactttgtactcccttaatgattggatgatactaatacatgtcagtaactcttttactccccttcacgactggatgattctaatacatgtgagcattcaagtgattgtagtaaaataattactaaagggactttcttaaggctcacggccactgtgaggctcaattaagtatagtaaaaacatgtcatggtaaatattcttgcgagtaaaaatattactaaaaggtattaaacttatgaaaatacctaggagtaaaaatattacgagttgatcagcctggatttttcacattttggtccttttgaaaaacttatttcgcaaatagacccctgaaaaaacttatcccagaaatggtcctttttggggcgccagattagctggcgcc

SEQ ID NO: 67823 - DNA, 5363 bp, Oryza sativa
  unsure (1)..(5363): unsure at all n locations
gccataaccgtcattaattacttgcctatttaaggagctcactctctccattcctccacacacctcaagcaagaagttcatttcatctctcaagtttagtatagtttctagagtatagtggaatagaaatagaatagaatcttcagccctcagagtctttggaagaatttgggtatggctctagtagcttttccttcttttgtaagacttgtactttatttcgaatactcttctttatactactctggtattgtattactttccgagtatatgaataccagctttactatatattcaaatatatttattatgatgctagcttatctgggagatgcaatggtgtgggtataatgatcgtatttacgatggctctatgtcatgatgatgatattagagtagtatttggtaatttaagcgtggtgtttagattactggatataattatttggggttatatgctgtggaagcgaggtgggccgctgatggtgacagctcagtacgggtattcctccgcgcgtgtatatagtcctaagttaatttcctggggagggtactcctccgtatttagcctcggttgtatggtcaagacggattgtcgtaaggaactcggcaatcaggggtggcttctcgaaacaccaagagggcatcagatagagggtattagctaagtagtaaaataattaggatgtacgtataatatgtatgtatactagaagtataggaatatgatgtttctatgttctttctacttagcttagataatcatgagtaagaggatgaatgcttctgcttagtgtcactctaccttatgaattatattaacccctgcttagactttggttattacaaataatatataaattattactacggttctctctattataatcttcccaagggattaaacaaatacgatacccttggaatactctcgggtgaaatgctaaaatggtatatccgtgcgcttgcagatgaaatctgtaaccataatataccaggagtatttctgcgccattactgggaattatatttgtagtaatatcattaagaaatatcatcaaatagttagggggtgttgcctacataattgtacaatagcaagtgtagactaaaatgactatatactagaagtatagaactgatgcttttcttattcttagtccacttagcttagattattattcatcggagcctattttaacacctggctatgaaatttgtcccgaattcataagtatggtttgggataaatctttctctagtctagaccaggaaaacctctaccatcacctccgagagtttgagcagctgtgttcgtgcctcctgattcaaggcatgacacatgagactgttaaatggaaattgttttcgttctctcttcaagagagcaaaacaatggtacatttacaccgttgggagtgtgagcagtagctggaatgaattgcgagacagattctgccttggagggaatagttaggggtgttggctgcataattgtacaattgtaagtgtagactaaaatggctatatactagaagtctagaactgatgcttttcttattcttactctacttagcttaaattattattttagtgagagtattctagttgttcttctgcgtgccaacctatctttatccttgaattgatcaacccctacattagacttcgatatgcataactgacaaaaattagggacaatcgctcgtttgaccctattttgaagtttaatttccaatctgaccctactttttcagatttgctcatttgaccttgtttttcaaaaccgtacttgccgactgaccctactttcactcccccgtcaaatttcatttaattaaaagaaaaaataaatttactagtccgaaaatgactaaaatgccccctgattctacaacattgtccccaaccttatctaggcggctgccacacacacggagggggcgatgcctgctgcatgcgcgaagggggtggcggcggctgtggcgtgcgtgggagggagcggccacggcggcgcgagcggaaggtgggagcggcggtggtggcgcgcacgaaggacgggagcggcggcgcgctcggagggcgggagtggcgtttgcagcgcgcggagagagagcaacggcggtcatcgcggcagcacgcgctgagggtgggagcagggtggcagcggctcgctcgtctcgtggcgctgagaagggaggtgtggttcgccgctgtgccgcgcagtcgatgcagtgctgagaagtgagaggccagcggctcgccggcgttcttcatgatggggaggagaggcagcggctcgcccacgcacggtgctgagaaagtataggctagctgctcgccggtgctctttgcgattgaggagcacggctcgctggtgtgctgcatggtcatgggggaggctgcatctcacctagtgcggtgcacacggggacctcagcataaggcaggcaaggggcatggctatgagacctccatggctattgcttgcccatcttcatctcctctttgttggattgctgctcaggaacattgttagacactaatatactacatgtgtgtgtttatttcttcagtatatgcaatttgggatggatttgttaaatttttattaaacttaattcatatatttttgtcaaataaaattttttttcaaacatctaccaacttgaagtgaaagttatcaaattatagtaaaataatacaaactgtagtcaactttgtcaaatcaaagtcgaatttgtcaaaaagatgacaaaaactaagtcaaatttatcataaatctatcaaacctacaataagtacataaatttttcgcaatatctttgccacgaaaaaactggaccaagctaacaaaataaccaaaaataggtgacaatgagaaagggcaaaattggcattgtgatttttgtttacatggataagtgctcttgacagaagagggtcaaaccgtagcttcagttttgaaaaagagggtcaaatgaacaaagttattataacagggtcaagttggtagttaacctttaaaataggatcaaatatgcaattgcccctaaaaattattagcatagtactctcttatcatatctttcattgggattaaacaaatacgataccatggaaatacttccaggtgaaatgctacaacggtatatccattcgcttgcggattatatctgtaaccgtaagaatactgagtaatatttcgagcaccattactaggaattatatttctagtagtgtagttaagaaatgtcacgctcagaaattcactagtaatttccgaactaatttgtgcatgaaatcctcgtccaggaatcagccgaggtaacaaactgataatttaatatacagattcattataataataacgttacatacttacaaaagaaaagaaaaacagcagcggaattacggtctatcaaagctccggctccactcccataggcagctcaactaaggtataagccaaacgtcttctccatctggatccttttcttcaactgaggtttgattgattattgcaaggtgagcatatgacatactcagtaagccacacagcaaatatgcaagtgcacaaggataccaaagaatggcataatatagggttcatttgcaaaagcagcatttagcaaacatttgagaattgtaaaacagtagagtaattaatcattaatattaatcaacactgaacagcacacccatgttgcacaggcccaaccatcctgaacaaccatacccggctgtacagatctatctccaaaccaggaatgcaccattccaaaccaggagctaatcaaattattaccagttatagcatcatttattatgatgagaagtgtgagactaatcacgaaagacattgttcgacccacccataaccgcgggcacggctattcgaatagttttactctggctaggggtgtaccactatacccacaagacacagccccaaaacatgtcaccatgcgcctcaataacaccacggtacctcggaaggagctgtgacagtacccctcgcacaacacaatccaccacagtgcaccattcctggatcataatcacccccttacaaacaaggcatggactccccagcgacccccgtgggcttgtctccgccacttctcagtctggtgccccgcaatgaaccatgctatacaaaagataaagccgttgcccatgctggcttgtggttggcacggttaatggttcacaaccgaaactcgtcaaccggtccttaattgtcatgagcacgaccatcaaaactatgtgctcacaacccaccattatcaagttttaattggcaagtaattaattaaccaatcacgattgaccatcgtgagcttccattaaatatccataagtgatagtgaagcatgatttatcccattagtgagctattgtttctaagcatggctaagcatctattataagcatctagctgaaccaaaacaatatataagggtctagctaatcaaattataacccataggaaaataaagtcatcttcggccataattaaatgggaaaggctcaccacccaatgacattcgaaaattaatgcacaggttgaataaatagagaattttaatataggatcagcatggtcaaaggaattgtgtntgggatctgtgtgactgccttgcaataatcaatcaaacctcagtggaagaaaaaggatccagaaggagaagacgtttcgcttataccccagttgagctgcctgtggaggtggagccagagtttcgctagaccgtaattccgttgctgtttttcttttcttttgtaagtatttacgttattagtatgatgaatctgtatattaaattgtcagtttgtgtaccccggatgatttctggagagggatttaatgcacaaattagttcggaaattactagtgaatttctgggcgtgacaagaaatatgatcactcactaaaaggcatgttagcatgcaagttcttgcaaacatgtgaccgaagtgaaaaaagagagttgcgaagtcgaacacttgtctgttggatagtatagggaggagagaaatactgcgtaacatggatcagtacttgtattgagcctcagggggccggtatatataggagtacatggggagaagataaggaaggattacagatatggaaggagtccacacaaatcaatcctatcctaatatgactctaactaccatatactctagcatccccccgcagtccaaccgtgagcaacgcggacacttggactagagaagaaactggcaagagtgctcaacacgggatagccctttgtgccatagtcgatgtagccaaagcgaagggtgcgagagagccgtggtcgatgaagtcgtgcgtagagtagctgtggtcg

SEQ ID NO: 67824 - DNA, 11482 bp, Oryza sativa
gtcccagctcgctgccgggtccgcgccacgaccacgccgtgaagaggccaggcggcgaggcggcgggcgggaggagcgtcaacggcgccgctccggctccagctcccgctcccgcggaggcgccggcgaaggcgccgcagaggaggcagaggcgcgggcctcatgacgtggaggacgaggcgtgggggctgctccgggagtcggtggtgcgctactgcggcagccccgtgggcacgatcgccgcgtgcgaccccaacgacgccagcccgctcaactacgaccaggtgttcatccgggacttcgtgccctcgggcatcgccttcctgctcaagggggactacgagatcgtccgcaacttcatcctgcacaccctccagctccaggtgatcacccgccctttcgtgtctcaacactcgctcttagatttttggttgggtcccaaactgtcgaaagagaaggactaatcactaatgcttatgcaattgatggtgatgctcctaataattgtactgcatactagtagtactagtagtagtgaagagggatgatttgaaattgacaagtgagaagtaaagaagcaaatgtaattatacttgcaattatggccagcatagtgactgcagaaggactagccaacgaggaaccgcctaccaaaagaatcgcaacaattttatacatcgagttgcatagattgctatagacatgctttcatttgctgaagtcaccacccacttaacagtagtgtcaagaattgtgtttctaagcaccttcttgcttaaataagtcatgtgtttccaatatttaaatctggagatcttcttctcttaaatctgattgttaacatctgcagagctgggagaaaacgatggactgccacagtccaggtcaagggttgatgccagcaagtttcaaggtgcgtgttgttccacttgacggggacgatgatgtaactgaggaagtcctggatcctgatttcggggaggctgcaataggacgtgtggcaccagttgattctggtgggtatagatgacgttccttatctcctattttgcgcacagcataaagatgtggcactttaacaatggttttcaggtttatggtggatcatattgctgagagcatacggaaaatgttcaggcgatctgtcggttcaggagagaattgatgtccagactggaataaagatgatcttgaagctctgcttagctgatggcttcgacatgtttcccaccttgcttgttactgatggctcatgcatgatagatcgtcgaatgggaatccatggacacccattggaaattcaggtagcatgaaaatttaacagagtgaaatatcataagttcatatagcaaagcaaacttatatgatcggagttaggcagtaaatgcattttgaattatggtatttattacatgctggacttgcaacaattacagttctgctctataacagcacatataggactacagtgtgcaaatgtcattcgggaaatggggcattatacgtttgctactaatttatacatgatgttcatatttcctttcttttgtaggcacttttctattcagctctcttgtgtgcacgtgagatgcttaccccagaagatggatcagctgacttgattcgtgccctaaatagcaggcttattgcactctcttttcatatcagagagtattattggcttgacaagagaaagctaaatgagatatatcgatacaaaacagaggagtattcttatgacgctgtcaacaagtttaacatatatccagatcagattcctccctggctggttgaatggatccctcctaaagggggttacttcattggatacatgcagccagctcatatggataatcggatgttttatcttgggaacttgtggtcaatagtaagtagtttggcaacatcccaccagtgtgatgctattttggatctggttgaagccaaatggtctgatttagtggcggatatgccaatgaagatatgctatcctgctcttgaggatcaggagtggaaattcattacagggagcgaccctaaaaatacgtgagccctatgattatcatgtaacccgtgtaatttagactgtttggatttcatcttatttgttttttttctctttcaatgcagggcttggtcttaccataatggaggttcctggccaacactattgtggcaggtacttgtgtttcattgctgataagtgttcatttgtccagtttagtgccatgaaaaatgaaaccttgtccatgttttgtttgaatattggaaccagttttttcctcctgtttaaagtttccaatcaacccctcatttgcagctcacagtagcatgtatcaaggtggaccggtcagagattgcagcaaaagctgtggaggttgctgagcgacgtattgccaatgataaatggcctgaatactacgataccaaacgtgcacgattcatcgggaagcagtctcggctttttcagacatggaccattgccggttttctcgtggccaagcagctgttagaaaaccctgataaatcgagaatactgtggaacaacgaggatgaggaaattctcaacgctatgaatcgcatgactgatgcatccaatctgaagaggcggcgtggcaggaaaggactcaagaagacttatattgtgtaagtccagaaatagtttcggcctatcgtcatatgtgtagaatatgttataggaatgatgagttcttgttgtacataagtacatttttgaagatggaaacctaatctcacatttttgtcatttcatggccccagtttagtcactgtctcactgatctagctagctctgggtcgtgtggtaagtagtactaactgaagtactcaacctatttctggaggcttcttgatgatcacatcaacatggtgatttactgcagtaatgaattcatcataatattcacaacgcaacacagctataagcaacagaacagagtgccttacggtcatcaacgaaagcacacaatggtgtacattccgtcggcaacggaggcctatattgtgcggtcactactagtcagtactcagtactcagtagcaataaacagaaaatgcacacacatagctgttgaatccgtgctgcccaactttatggtattggcaaggaataaagttacgcaagttattacccgccttcactcgggctggtagtacttcccagacttaacaagtgacagccaattccagatgccactgaggcaatatgcaaatgcaatacaacatgttctacttctatcattgcactcgtacaagatgactgccgaagccgtgctaatctggtattttgatggtattaacaaggaataaagtagtagcaggtttaacagccgaacatacttcacttccccaacattggcaggtgacccaagattttactcatttccaacagaaagctgcagggaagtgaaactacctctagctacatgctatggatgttcttccgaatacaaagtaatattattaccaccactagaagagctcaaactcaatgtcgtctccattcagcctgaactccaggcacttgccttccttcttcttccgtgccgtcgtgaggcttgccgcgtcgaagcttttcggagtctcaggcggtgcagtccatcggatcaatgcccagttcaggccttcgaagaagggatgccgcttgatctcagcagctcctttcgttgagcctagccggtactccggatccttcacaagcaaccctctgatcaaatcccgggcatggaagctgacagcagggttatcagggaacttcagcccctgcgagaccacatttgtcagtgtctcctcattgccgggtcccctgaacggtgtcctgccatagagtaattcatagagaaagatgccaagagtccaccagtcgaccgagctaccatggccatctcctctgataatctctggtgcaagatattcatgggtaccgacgaacgaatttgaccttgcatcagttggctcaacaacaagctgtggcagtgatggtttcttctgaggctcacccctcggccgccgtggcctggaaggggtagaggaaactagccgaggcgtgaagcaagaagaattggcccatgacggttggatacagagtggatcaatgcagctttccgcacaagggccagaaggtctactaggttcatctcttcctactgatgaggcccttacaagcattggatttactgagcacctcagggacagatcgaaatcagagagcataatgtgcccatcttcacgaacaagtatgttttctggtttcagatcgcgatatatgacccccaacatatgtagatattccaatgctaggagaacttcagcaacataaaacctgcaaaataaaaaggtaattctccctgtgagttacatcgctcaaagaacatacaccaattgatcagttaaaaacatcaatcagatggcagcaagcaagactgtatcagtgtctgttaaatgagactatagctcggttagtgtgaagcagccacatggcaatctcatgtatgttaggacatcaaatgaaaacacgattaatagaacttaagttccatacctagcagcagcttctgaaaaggtcctggtaggctgtttctgtcgtagaacatgcaggtcaccgccagggcaatactccatgactaggcaagacagattatcggtcgtgaaaaaagaatacagagttggaagaaatgggtggtcgagcatttgcaggatctccctctcagtttgtgctcgaagcatcttctttctacttatcaggtactcgatatccataactttcaatgcgaacatgcattcagaacccaccaattcagctagataaacagtcccaatatctccacaaccaagttgtttgagaagcttgaagttcttcagtcccaggctcccttgttggattgccatgcgcctaatggccccccatctcacatcttttgacatgtgaggcctgcagccattgccactgaaactaccataactatcatcgcttatgcttgtgctggtgctataatcacccatgctgctctttgagctttgggagcattcacccttttccttcgatcttgacaactcactgggctttgaaccatggatctcaccaacaccacatcctttggtgccacaattagctccatcagtgctgatagagctagccgcagccttcttgttgattggtgttggagttctgggttcatcctgtagggcctcgtgcttcttattagcttgagaattggaactttttgcctcacaagtcttgtgagataccactgcagcagctggttctggtttgaccttcttcttggtggaggttttactccggaacaccaggcgtgaaccgcccacaggaactgcacgggggctagatgttttcattttgccctttctctgtttagccaccgcaggacctgcaggcaaatcttcacttgcctcagatgacttattactgatcacatcttggattctggttttctggacctttgttgtggttggagatgctgaacgcacatttttcttagctgggcttttgttccgtaccttgttcttggcttccgttgacttcaccgatgaacttattacatccttctcaggcaaaacggacacttttccaaacttattcttttcatcccgctccttgttggtttgaaccacaacagatgtataaagcttcttaattgccccagcttctggggtatttgacaccgccgtcggcttcggcatcctcttcatggcggccatctccgacgcctgcgagatgcacatcttcctcagggcctgtttcaggctcacagactcaacaatctccgagctcgatatcggcgacttcccgagcgcgataagcctcctatccgtgctcgtctgcccagaagcccgtgcggatgtgcgcacattaatcgatctaatgagcctatcgagatcatcctcgacggagcacgaccgcgctccatgctcctgacccaccggcttcactctcaccctcaggtgggtgacaccaccaggacgggcatccttcgactcatccaccaattcgactatctctgagcaacctgaagaacccatctttctcaaaagccctctgctgcctccggagctgcgcctagtagagcattaactcatgcggcctcacaactaacaaccgcatctggggaggccatccaaccgctgacgcagctcaggttaggaccagtggttgcctgcagttcggtgaccaaagaggcagctttcctggatcaagaagcggcatcacggggccctgcaagaaaatcaagcacaaactggatcagatagagcaaaaaacccatctttgctcagggaaaaaaaacttagcaatatacaacaaggagtaagattaacactaacgagaatggagaaaaagcagcaaccaaatcaagtgaatctgcagcttgaaccagagccaatctcggtgccctcctcctcaaaatctccccccacagctctccttttccccacccaagagtagaaatttgaaaaacacaaaagaaagaaagcaaaaggaacacagatgcggtaggtgaggtggggttttgctctatccccagcaaaatgatgcgagatccgttaacccctggaggcaaaagcaagaagaggacacaagcagctcagccaaaaccaccccaaaacttagggccagccaaaaacaccagcatacaaaaaagaaggggaaaatgaagaaaaagaacaaagatttgtgcctattagatgcggggttttgccctggagaaacttaccggcaggagaaccgcggtggcggcggcgacgggactagggtttagctggagcgccgccgacgagtaggacaaggaggcggagctggagagagagaagggaagaaatgttgggttttcctttggagaagagttgaaacggagagagctcagcttcagcagcagcaatgcgcgcacatcacgaggagcaaagaggaagacgaaatgagagcggctgcctctgcctctcccctcactcactcacgcctacacctatgccctacaaacttctgtcacacacacacacacaaacctatccttgctctaccattctctctctaccacggtgaccaccgcaaaccgataaaggccccaccgggggcaccaccacccctcccaaggattttacgcttctttatttattgggtcacatttattaatatctgtagccacgtatcgcgtgctgctactgctgtgcccctcctctcccctttcacgtctctctcctcgcccttttcatgtctctttctctctctccagactaccgagcttttctctctctcttttttttttctttttatcttgttttgtcacccacaaccctgatgaagaaaagggcaaaaagaaacgaacggaacggaacggcacggcccgtagataaaacaattcatctacgaggagatagtaggagtagagtggtagaggctgctgtgtctggctatgctccgcctgcggacaccggacagaaagggcatcaaagaattcacggttccccgtactacgatttcgatttcgatttcgatttcgccctaacctcagcgcgcgcgtggcccgcagcgtcagcggcgcattatcctgccgcggcaacatggctggagtaatcaccggggcgctgcgcgtaacgtgatgagtggttttggccaagctcatcactgcggccgcgcaggcggacgggaggcgcagcggtgaccggtggtggtaccgtggtaggcggatgggtgaacgtgagacggtcagctactgaggtgggctcgtgatatcgtcgagccgtgcggtgcgtgacgcgcgcggccggccgcagctggcgaggcggcccacgggccaccgcaccaccccaccaccacgtacaggtaccaccaccaccaccacagccgcacggtcacaggcgcctcgtgcgcgcgcattgctgtgcgcctccctcccccacaccgcctcctcccgcctcagctgcattcactcgtccggtcgttgctcgtgcaccatgcgtccacgcccatcgccggcctattcgcttctctcctcagctaagaactttcacggtacgtttatgtgccattcagcctcaagcggtcaggatgggaatggttaggatatggattgaacctaaaccgttttaagtgagttcgtttatccatggtttaatagggttgatccaccatgagtctattatatcaataggttatacatagatatccaaatggatcggttactcttattacatatgggtaaaactcggacccaaaatttttaaactcgcgttcacactataaaaacttatcgaattcagttgaattttggtgggataatttattgtacagagaagcaactttgtataaattttgagccctttatacaagtggggcccacgatgcattactaggacccaaaaattctagttatatgtgtaaaactcggacccaaaatttttaaactcgcgttcacactataaaaacttgtcgaattcagttgaattttggtggaataatttattgcacagagaagcaactttgtgtaaattttgagcccttcatacatgtggggcccataatgtgttgctaagacccaaaaattctagttacatgtaaaactcggatccaaaatttttaaacttgcgttcacactttaaaaacttgttaaatttagttgaattttgtaggaatgaattattatatagcgaagcaactttgtacaaatttttgaaacatttatacatgtgaagtcattttagatcgaaccccttgaaccttaggttctaatggtttgatccgtttgatccatttatatttttggagcaaccctacaaatccgttaggacaaattgatccgtttgatccatttatatttttggagcgaccctacaaatccgttatgacaaatttacggataggtttagtgcataaatggatcgaccctaaccattcccatccttactcaagcttataagtaggagattctcagccacgtcaatattttctgtgaccaaactaagaacgcgtgaccaaactaagacacatgttattcataaaaaattggcagcatcgttaaggcagcccacactcgtcgctagggaaaggagagagggaggaaagaaagctcggcttgtctcgacgactagggagggagaccgtcaacggggagggaaggagggagccaagaaaatcgtcgcccctgcttccacactgcaccgtcaccgggctcgttgctgaggaggggagctcaaggccaacgccggccatagtcatggacgaggtagatgagtcagcgctagacccgccccgtcgccccctttttgtacgccaccaagctcttgcagtgccgtaccctgccagtcggaggaggagaggtggtgccgtcgccaaaccggccgcggccgcctcacttcctccaccatggaaaatgcaaagaggaggagcaccgccgacctcgccatccctcgctcccgtgccgccaaccttgccactgcttttggggacaaggcgagggatggatctggtcgctcgtcaactgctcccgcgccaccgaccttgccactccacctaacgtcatcgccctcgacgcgtgggccgcttcgccggcgttgtcgccttgacctcgcctcgctttatccgccattggggagaggaagataggaaaaaggggagatgaaaagtgaaaaaaggtgatattagtgggacccactataagtgacttgctgtgaaacatgtagctaacattattctttgctcacatggcacgttaggttcggcaaaatgtggtggccaactgctaatgctctaatcctcgacaagggtccatgagttggtgcaactgcgtggcaacgtcagtacgcctccgccctagcaaggtgtcagggtgggctctgtctcattggtcctgatacaatacacacgaaactttttccgtcccaaaatgtgcatttttttaaggtagaggggtttatatttatgagtatatgacagagataaaaattaatgtaactatcagttttactactacattcatcccaaataaatttatttttcacccatcacacaccaatataaaacaaaaaaatagaatacctttcaattaaactggcccgcgcagattgtgcagctagcattattatattttctctcgtataatagtatatatgttttctcattatattattaaaatatattacaatgacaacataattttaaattttgcaataactttacgaaactattaatgtgtaatattcatattgtattttatatacatgttagttattaattatttttaatatcaaattttagttatttgtaaattatatatattcctatatggactctagactcgtcttttaatattttcttttttttaattctgaatttttattatttctaattgtatttctatgtggactctaaactcatctttcaatattctttaatttttaatttcaaatttcagttacttctaaattgtattcctatattaactataaactcttcttcccatgtttttattaatttcaaattttagttatttgtaaattgtatttttatacgtattctaaactctacttttaattttattatgtttattctgaattttagttagttttaaattcctatatggactctatactctacttctaatattccttatttttttaattccgaatttctattttttcttaattgtatttctgtatgaactctatactctacttctactattccttatttttaattccgaatttatattatttcctaattgtatttctttatagactctatattctacttttaatattccttatttttaattccgaaattcagttatttcctaattgtatttctatatggactctagtctcctcttctaatattccttatttttaattccgaatttcaactatttctaaattgtatttctatatggactctagtctcctcttgtaatattccttattttttaattccgaatttcagctatttataaattgtatttctatatggactctgcttttttctttttctccgattaatgtgagaatttctaggccatgagagcgaacgtggaggctcatttttctattcctttaataatataatagatgtctctcgacttttctagttccaatgaatttatcatctactttcatacttaactctaatgtaataattatttaaaaataaatgtattttaagataaatccgagacagtaaaaacgaactcattttaaaacgaataaaaacttgctctaaaccctttatataggaggcagctctccagtcacgcatagtacagccgacgcccgagtcccgaccaaccagtcaaccactgcctgtctgcttcgtcctgcatcttccttctttccctccagaaaatttgaaaacgaaggttgcctcattgcctgggcaccatcagacccaaatccttccgagctggatgcggctgctcactcagtctcagcagtcagcactcactcgcctcgcatgataaac

SEQ ID NO: 67825 - DNA, 552 bp, Oryza sativa
atcatcacaaagttacctggtatgttgggatttaggcaggagtagacatgggaagcagaaatggtaaaaagatacttaaccaacttcatccagattataacagcaacctaacacttgctaagcatctatttatgtgacttctcgaatacatattgaagttccaagaatcctagtcctgtgaatttctagatgctattaatcatacagcaacaacgagatgattaccgttgatagctccaattcatatttaaatccaaatatctcgtaaacataattgatgaagtccaaaacagccttaacttcgtccttgatctgcaacaaagaaagaactcttaagaaaagtaggcccttatacaatcaggggacactatttaaaattatccgaagcacagtgcagctgttaaaaggaggttgtgattaacaccatctgaaacattgtgaaaacaaatgggaatacaaactaccatccatacagtatgcaagtcatgaacatctaaatattatgagcttctggtgcctaaactaatttatgtcacacagtgtaaatacact

SEQ ID NO: 67826 - DNA, 5069 bp, Oryza sativa
  unsure (1)..(5069): unsure at all n locations
attcctgcagcccggatggcacttggaacctttgaccaaagtgaattttggaattaaactcatgttagccaagcgcgtcatacaatcgaaattcacatgacaaagtcgcgaatgccacacattggactcatcattctcgttaatatggttcacaacgttattattattacacatgtcatccaaagaaatcggaacaagcatccgctgtcataacctttcccaataaaagttccatatttagatacgacacatttattggattcaaacacaagtctaaaaccatctctacacagtagagagccgctaactagattcttctttattgaagggacatgttgcacgttcttcagctgcacgatctttcccgaagtaaacttcagatcgaccgtaccaacaccatgaatagccgcaagcgacccgtttcccatcaacaaggaggaacctctcccgacctgataagaagaaaacagggaaatattagcacacacatgaatattagcaccagtatcaacccaccaatcaggtgaatgaaaaacagagagtactgtaggtaaaaatttaccgtaccccgatgttcctccgccctcactaatgactatgttagcagacttcttgtcattgcgctcaggacaatccttggcccaatgtccaggcttgccatacacaaagcaatctccctttgcctttcccttgcctttcttcttaaaattggttgtagccttgggtttgacatcaggcttgactttcttgttgttgtgggatgcgtgagggttcttcttctgcaccatattggcactagaacctccctcgatctttttgccccggttgtcctttgccctcgccttctcctcaacacccaaagagccaatgagatcattaacactgaactcttgtctcttgtgttttagagaagtggcaaagtccgacaaaaaaggtggcaatttggcaataatgccacccgccacaaacttgtccggcaactcacagttgttgttctcaagttccttgccaacatctaaatctcatgagcctgttctactacagaacggtcatcgaccatcttgtagtcatagaactgctccatgacatacagctcgctgccagcgtcggaaactccgaacttggcctcaagtgcatcccacatgtccttccctgaaggcatgtgcatatacacatccactatattgtcagcgagtacactgaacaatgctccacggaacaggcaatccgaagcctcgaacttagcctcctcctcatgagagagaggcggttcacttcgtttgcctcgtgaaacatagaagcattgcatcaatgtcaaccacagtagtgcacgtgctttccatctcttataattagaaccatcaaaagcatgtggtttcagtgttgcagcaaagccaactaccgaaaatgacctatcaggtttttggattgttggaaatatggtcataaatcggcatattttaatccaaaatattaagacaataaacatgacttgcacaatgtgaagtgatctagtgataaaactaaacataaccaggagcatgcttaaggtaaaataagcatcaacattgagacaatgcaataacattgcgactgatagttttaacaaaatgaaaggcaacagaaggatgttataccctgtgaaagtccctccgctggattatgaggcagttttgcattcgttggtgttgttgatcagtgcgccacctcctattccttgcacaccacctcctgccgcaccggatgcgccaccaccagtagacatgatgcagaacgaaccgaacgacgatggagacgaagaagcgagcggagcagtcgtgcggaagcactccctaaaaatctgatcacccgcctagccgtgcagatctctggtgaaggtgtgggttcagaggccctgcttgtcccaatcacttgtgcgcgcaagcgatcaaaaccggggaagaacataacagaggcagcacaggcacacatacgagaaaccagcaacggaaagaattcgtagaatatctgatcgtcggtctctgtctcgtcctaatagcacagccttgcgcgcacaaaaccggggaagaacagaacagaggcagcacaggcacacatacgagaaaccagcaatggaaagaattcatagaatatctgatcgtcggtctctgtctcatcctaatagcgcagcccgttacagaggtaatctcgcggagttgaattctgaaccattgcaaaaggatcgagagagagagccgagccgcagatgctgcgcgtgcgcacacgcctcgcccacggcctcggcccggcccgacgcgcgcgcgcgtgtggctttccgacccccactcaacgggtcaacagggagcctccaataactccctctttaagttgaggtactccacttttaatccccaaggtggcattattatctttaacatttattatgggcccatgagattttaatagaaataaatcaggtctagcctattattctaacaatccccaccaaatttcacggttcataagaaatgttctcaaagttgaacctgtttgatataccagtgtttcggtggagactgttaagttgaacttccacctaggaaaagagctacaccagagcacaactgaacaatagactatgccttgaattgtcagtcttgtgtgatcaggtttcattcaaacccttgactggtactgggctgccgtttgcatcccctctgtttggagcatataagtcaaactccatgccctttcatgagtatctagagatcacccaaatctcatagactgtgactagcagtcgagctcatataggtgtgttccttctgagatgttctgcaggtcaacatctctacttaagaaaagccactcggatcacattaagccataagccatcctaccatgcataatagaagagaagtacaacatggaaatgagccctttaagggtctcttctgtcagccacacaatagtttgtttcgccatccaaattcacgggatctccgatcacaatggacaggtttccactattgtgcaaccttagatgggtatcaagcctatttccctcaatgcactgtctatcacattacgtggtagccccttagtaaactgatctgccagctttttagccgtctggacatagtccaatgctatcactccggagtttttctgctttctgacagatttcagtcttctctttacatgcctagatgacttcatgttgtccttcgaactgttcactttaataatcactgtttgattatcacagttcatcaggatagctggcactggtttttcaaccaccggcaaatccaccaggagttcacgaagccattcggcctcaactgtcgcagtatctagtgctgtgagttctgcttccattgttgacctcgttaagatggtctgcttgcaagacttctaggaaacaacgccacctccaagtgtgaacacatatccacttgtgcttttatctcatcagcatcagatatccagtttgagtcactatacccttccagtacttttggataccggtataagtgatttctatagctcatagtgcccttagatagggcatnactctctcttttcagatttgaaccaaactggctcagcttgttcccagcaaatgagatgtcaggcttcgttgcctagccaagtacatcaatgaaccaatgatttgggagtatttcaattgatcccttgctattcttcggctttccttaatagcacactggggtcataatgagtaggagctgccttgcagtcactatagccaaagcgactcaaaacctggtccacataatgggattgcacaagtgtaatcccaccctcatctcctcttagtagcttaatgttaaaaataacatcagccactcctaaatccttcatttcaagtcttttggacagaaagtcccaaagatcaatatgtcatcgacatataaacacaagatcactcattctcccccaccatagcgatagtacacacatttgtcagcttcgttcacaacaaagccagcagatgtaagtgtggtgtcaaacttctcatgccattgcttaggtgcttgcttaaggccatacaaggatttcaactgtttacacaccattccctcctgaccttctagtgcatacccgtctggttgatccatatagatctcctcctccagctctccgtttaggaatgctgtcttaacgtccatctaatggacgagaaaaccatgagaggctgccagagcaagtagtactcgaatcgtggtcaagcgagcaactggtgagtatgtgtcgaaaaaatcctcgccttctttttgggtataacccttggccacaagtcttgtcttatacttttcaattgtaccatcaggcctaaactttttgttgaaaacccatttgcaggcctaagctttttcttgaaaacccatttgcatcctacaggcttgcacccatatggacgctcaacgacttcacaagtaccattaaacataattgagtctatctcactgcgtaccgcttcctttcagtagttagcgtcaggagatgaatatgccttttctatggttcttggagtgtcatctacgaggtatacaatgtagtcatctccaaaggattgcaaccctttgtctcttactctttcgagtatctataatgttatcctcctcaggattttcctcaggtgtttgatcattgtgttctatcggtgcaaagtgttcatgggataaaacaggttcttgactagaagtgctaggtgtatttttcatgggaaattcattctcaaagaatgtggaatctctggactcagtgattgtaccaactcacatgtcgggtactccaaagtttattattaagaatctataacccacgctatgaatagcataaccaaggaacacacaatctacagtctttggtccaagtttacgctttttggctataggtacatttaccttggccaaacagccccatgtacgtaggtatgagagatttaatttcttcctttcccattgctcgaatggtgttatttccttatgcttcattggaattttattcaagacatgacaggcagtcaaaattgcctcaccccaccattccttgggaagtcc

SEQ ID NO: 67827 - DNA, 701 bp, Oryza sativa
cacattacattttggagtccgtgctgtagctggctatagatctgtagcccgctgctcttctctctcttcctttatctctttaaaatatgttataactggcttatagcctgctattgtacctgctctaacggtattattatgttttcccagatggactatgaatgatggtccagcctaagttagtcgtggcaatacctttttcagagcacacaggagattggcacatcttttgaataatcaagaacagagattggagcaggcacacggtgaaccagagctggtgaccggtacaacgacagtacaatctggtatgtacagtttttaaatacctgaaaaattttaatgcagggatacgggaacgatcttgttgctcttgtggcctttaaaacacttcctgtctaaagcctgagaaaatttcattgcacgtatggatgatgtacgtatgaaatcatattttcatcgatgtaatgattccctgtgacccggtagcagtagcgacctcaactgtcatggccatccatttcaatggatgcatggagtcgtctttgctttgcagttgcaagctgctgcccatggagacaggcaattaagattccaggggagtacgagcgtacaaccatgatcaccaattaaaagcaaagccatcatttggattcccagttcttgtgctcatgccaacctcacccttttcttttcccttc

SEQ ID NO: 67828 - DNA, 652 bp, Oryza sativa
agccctccttgtttatgtacttgttatctgttatacatattaaccaaatttctcgaaatttatatgatacctgttacagtgcaaacaggaattgcatgtgtgcatcatgggctgcttttaatttgacgtgtaagtacagtctcatcttccagttttggtgttatttttctaaaatgcagacaaagggggcaggcaaagggaaaaagggagtgcatgaagctgatggaaatggcgaggaggatgtctccacttcaaaccaatcaaatgagaagcaactcgaagaaccctctcaattgtcagatatgttgccagatcacttggtaagaactagagcgaaccaagatacataatgtcctacctcaaataacacacagaaaaactccctgataagcttgcaatatctcgaaagcagataacaaactggctgtcatatactgtacataaagtttaccgagaatctgctatttactgccaatccaccaaaccatgtttgtttgagtctttttactggtccatattcattttgcatcttatctctgctttgtgcaatcttgctcttcttccttgtgagttgtgatgaatgaaaactcctatgagcaccgtaatgggtccctaacacgtttgatgttgtacagtttgatgacagttccaa

SEQ ID NO: 67829 - DNA, 1359 bp, Oryza sativa
aattaaggaggtaccatgatattcagtaataccactttcagtttccaaatgccttgttctcaaatcttatcaaaccaactcatatatctcgtgaggaaaacaagatcctttgtgtgtgtgtgtgtgtgtgtatgtgtgaaaatcgtctgacttaaatcagtcccataccacattatacatgcaatatatgcaaactataggtaacactcttttatgttaacattttcaaaatcacccatgcacaaacacttcaaaaatattttctaataaagaacttatggttatttttgaggaattccattagatgctttcgtttgttccttatagaactatgatttactagctttatcttcaaaacatctccattcttttccttaaaatgacttacagacgagttagcagtgccacttgaaactaattggaagctttcttaggtttgggagatcgaggaaggaaagcacaagccaggttctgtgattcatactgtagggtggcctttggactcgaaaacatatggaggatcatttatgtatcaccttgatgatagacaggtagttcttctgttatttgctacaatatccctttatgagttctcttttcttttgcaaatatatgttcagtgaagtctgtcatctgtgtaaagatgtaaaaatgtatttatcttacatgatagatgcatccttctccacaacctaagttcacagcttacagattataatttgggtttaaaggaggaaccattaattcatcccttatcataaggccttttgtttgcagagtggataaatgtataacttgctcagttttttccccggaaattttgattactttatcgcttagtggtgtttactttatctctgctctgatatttcagttagcgataggtctggttgttgccttgaactatcaaaatcctttcatgagcccatacgatgaattccaggttagtcaaatttctatgggtatgttcttttatgatggtagtgtactagtatagtcctgaactcctgatggtcgattttttttcttctaagcattatgcaatcatattttatatttcagaaattcaagcaacaccctgctgtcaggacaattttggatggtggaacagttcttcagtatggtgctcgtacgttgaatgaagggggttttcaagtaagtggcatgtcaaagaaatgaaaattttgttgtaaatagattcatatgatatgtaaactctgcgcataactatattgggcatctgccggtttatgacattacaagcattttacatcaaaatcaattcacctggtgtttccggttaactggtacatgaactttgaacacagcattggtatagtgttcttgttatgctatatg

SEQ ID NO: 67830 - DNA, 1681 bp, Oryza sativa
tgtaaaactacaccccaaatatttaaaataaggtcctatgcacttatacaatagaatatttatttctcatgaacgataatgtttagaaaaggagatcgagcactgctagttctatctcaaaaaataaatgtgcaaatagactacattcagctgtggcttgaccggatttccacagaagaaaggatgatccaatgagcaattattactgaggctactgtaactgaggttctatgcatgaattctacagcgagagtaattgctttgtgccatagagatgttactcaatttcttttagtgtgttcattataccttctgaatggcaaatgacaacaattgagttgaccatatctctccatgtccaacaacaaaatctaagaaagactcggttgcatgcccagctgcaaaaagggaaatgtatcataactcagctaagactatatttctgcaatcaaaccacaccgttgctacataatagtaaataagtcagcatatctaaaatgagggacagatatactatcacagaattctatgtggttgatttatatgttgtctcatatcattatgggtattaacatgctattttaacagagcctaacagattgattgttaaatcttaaatgtgtaaaaaacgaagatggacatcatggaagaattgttttgattgagtcaagagatacatgagttcaccactataatgccaatgatttcctctagtactacagtagtatataacttcactttattaggctatctgttagtactctctcagaccacaaacttttcaaaccatagcttcctttgtaagttagtatgcatgattttgttaatagtgaccagtaattagacattcctgaggttgtaggccaaatgcaagattaaaaaagcacagtgagaaacctctcaattaagcgtttatggctactgttacagacctattcgaaaataacatgacaacaaagcgaacagagtatttgacgtttttttttcagaaatattcttatccagtgctttgaaaatgaacttgtttttttttccgaaaacgcaagagccatgtgtttcatttcaagaagaagaagaaagagcatgtaagctatagtcataagctactctatgtcattaaaaagcagcataagtagtgtacagaataatgcaatttatttttgtgtttttcctgactgacgtcctagtattaataatttctccatgagccttttattttgacagagacaaattactattactcaccctaaatgggattattggagcagataattcagtctgccaaaaagacaagaatagagacaaattacaacaacttcacactgaagttgaaattcctgcacgattaatagaaaatatttcacaatggaagttaaattagaagaatgttggtagtccagtttttgtaagctgtgttgtacagcagtcagactcatcataaatcatgggcaggagaacaagactgaatccatgttacaaatatgtaatgcagtctgaatgaccataccaatttattcatagacttttatagacatgtgttaatatagctgcatattaaaatggagaagacaatgggttttcctttaatgatatgtgaatttgggtttcattggaaaatacctgagatggtatatagttcactttaaccccaccttaattgcggacgtccattacaacctga

SEQ ID NO: 67831 - DNA, 7971 bp, Oryza sativa
tgtaagctttcagggaactgtttatttagatgtatgtagttattctctatttcgatgcaagtccaaatgagtaaactgcaagtcagatggatgccttttttttatctaaactaattaaaactatagcacgacggtgaaccaatcaaaatcgcttaacaacacttaacagcccaaatgagtaaagtgtgtgtcagatggataccttgttgatctcatcctaatgcaccatcaccatagaagcagatcgggagagctaatgaaaggaggaggtgggaaagaggcaccagcgtaggagtaggcgtcggcggggggtgggcggaggattcggtgtcagtagcgggtgggcggagtaggcgtcggtagcgggtgatggggagaacgatgatgcggcggtggtggacagtacgacgcgaccggcattgggagcggtggagaaggatctgacgacgatggcgtcaccggcgaagggaactcggcgacggtagccaccgtgcgtcattgggagcggtggagaaggatctgacgatggcgtcaccggcgaagggaactcggcgacggtagccaccgtgggatcgatggcaacgcggagagaggagatcggcaaggcaaaggacggtgcgacaggtgatggggaggaggaggacgcagcgacggtggtgggtggggagggcgatctaggaggaggtgcggctggtgtcgcggcggattgcgagcggaggcggggtgggagggggtggcggcgatgggtggtttttttctcgttgattgcggatcgtgatccgtaggaatcgcgcatggatcgtgacccgtaggaatcgcacgtgggtggtgtggaagtgtgtcgcttactcgttcttgaccgtgtcaatgtacgtttttatgttggatcgcacgtctacgttggcttcaccatcaccactacgaatttttaaagtagtagagattaatttgttttcttgagaaagtgttagttaaattggatttgactagtgtgaagaagatgcatgctacaagaagagaagataaaattagactttactagttccttaaactaatacatggttagcatgtatttatttaccagtaatgatggatttgaatacttgaatgttatagttagcacttaggttatattgttgtttaaccattagttgcaaaggacattatacatcctagttggggtgttgtttagttgtacaagtgaactaggaattgactaatattaggtactgtcattgatggagttgtcttctgcgtatgacgatttctaaggtcctaaattatggatatgtaaatgaatataggctagtgtaataaatgaaaatgtagcttcgttcgttgctataataaggactgtccttagctactcacgattttttaactgttaaagggtatgttttgtggaaaaaaatatgtagaagttctttttagagacagtcatactacatataatctattttttgtaaaatttataaattaatatttaattaatcacgtgctagtaaataattactaacaacttcagaaatcctctgatttcttctacaatagagcctcttgtaatttaactcatgctttggtgtgtgttgtaaatgaggcagaagaggagtatttataggcctggaggtgcactgggaatttggacatgctaaagcatccttagagcatattcattctcctcttgccaaatgtccagttgatgacgatttccaccggtagaaatggtcacaaccgtcataggatgaggataactgtcagctggtgaaattttgggctgtttgggctagctgctggctggcccatccagcccagccccactatgtgttcctctgaagtttgactcaaatgattgtatcttattgggtttgtgggctcaaaactccatgggcttagatatggaagttatattctcatccttcatatatatatttcatctcaactttggtggtttgtcttctacatgcaaatatacaccaacacttgtgaaaattgttaaaaataaatcctacccctatattggacgttttacatttatggttttatgcaattattgacggtgttaatttggtacttaacacaactgtgtgctgctgtttcggctcatctcagaattccaaacgaacgcatggcctatggtgtcccaagctccactgtttattaattagattaaaattagaaattggcgcgccggttggcgcactgtcaatgcgtggataaaaatcaaatatttaatacaacctcttcataatatttttatttttattttcttgtgtaacgtgtagcatatagtacttgaaaaaattagccaatgatatgagtaataatttgcagttttagcacttaagagtttaataaattgatttgtgattaatttatcatgtgcatataaaatattgactttatttgtaaattaatacaattggtcaaaataatctatttttcccattactataaggatgtgttcagcagcttaagattgaagctaatcacacatgcacataaaaaagagcaactcattagcgcatgataaattatgtgttagctatttttttctgaaaaagtactactatgattttttaaagcaactttcgtataaaattattttgtaaaagacgcatcgtttagcatatttggaaatgtacacgcggaaaagtattatcaatgccttataaaacatgaagacatttattttcccagtcctcgagatgtcttatagaaatatgaagtatgattcaggtgctaaaaagcataagaagagacaactataatacttttgaccaaaagtatgccatatttgtattagacatataaatttctcaatatttttagaatctcaatttgtatttcgttccgatgcctccaaaatcctgaacacagccttgatatcatttgacttgctagattttagaagagtgaatccactcagtaccactaagttttccccacttttacaatctaccactgactttgttaagttgaataatatgccattgtgttttcttgaatctctattgcgtgccatcaccatccatgagccgttagttggcacccgtttgataaattgaattttttcttaatgcctaaaatacccttagactaacataccctaggactgaaaaccctagccgtgaacctccaaatcaatctggcagtgtgaggcggcgctgactcccatcgatggaaggccggacgcccaactccccgacgcgccgccagccgccccagcccccgacgcgcggccgagcacccggctccccatcgacgcgggccgcaacgccgccgccacgggtcacattcgcgtccgcgttgctgtcgccgccgcaggcagctgcatccgcgccaccgccggtgtcgcaggtcgtgtccgcgtcgctctcgccgcgggccgcaaccgcgccgccatcacaggccgcgtccgtgtcgccggaaccacgccgccatcgcaagccgcatccgcgtcaccgccgccgcaggccgcaaccgtgccgccatcgcaggccgcgaccatgtcaccgccgccgcgaagggtttgagagagctctgcactgctagtgtctgattgtctgaatactatgcaaaacagttttggcattatcccatcaaacaatgtcgatagattactatacatttctccctggaaaaaaaaccatgtacagtgagttaggggcaaataggtctttttacagctctaacagatgtccaactaacggcttgtggacggcaatagcacacattagaggttcaagaaaacacaatagcatattatttaacttgacaaagtcagtggtagattgtagaagtggggaaaacttagtgatactgagtagattctctcattttataaacttattttaatatgtagaactgaataatgaaaatccggtttcagatacacaaataaacatgaaatgacttttgttttttaacaggtacgtcttccgttatataattatataattattttgattttctttttccaagttaaacatttttaagaatgatcgagtttgtagaaaaaatatagtaaaatttccaacacaaaacaaatgttttataaaaaaaatatattcaatgatacgttcaatgatacatgagtattgtagatgttgctaaaaaaatttatataaattatttaaacctaatatatagtttaaaaaaatcaaatcgactttaatatggaacggaggagtactccagtaataacggctttgcagtttgcacggagacggagacggcaacgggagatttaaagcggccgtcgaatccggaccggaaacggagacggcaacggcgttccccgcctccttaaacagttaaacctacccaaatccccaaattccgccgccgcctcctcctcctcctctcgccgccggcgagaaccacggcgaggtgaccaaccaaccccaacccccatcgcgccccccgccactgcctcttctccccccgcccgcccgggattccgtccatggaccggccgaggaggccggggagcgaccgccggtaccctccgctgcggttcaggaagcggaagaggagcagcagcgacagtagaagcagcaagctcaacaacaagccagggtctgataaggtataccctaccacctggaacgcgcccctccatgcttggtgtcgccgtcttgttcattggattttgggggtggggggttagtcccctttggtggttggggtttagttttaaaaaaaggattgctggaatcagaggtgctagatgctgaatcaaacctcgaattgcttcagtgaggatgaaatttggttcaagagaaattaatagtgtcggttcgtttacttgttctatggaaacaaaagtatatgttaatgtgcccatgtttcttccttcagtttttcttttcctttttcctctccaagtattataggtttaaggagtcaggcaaaggagctttcaattttatggcgcttcgtagttttgctcaccttagcaagggaagatactcctaagaataagaaaatagtgtgacccttgagagaattgctatcaacttttttctgtttctaaaatggcttgaagttttctaggataggggatagtttttgttttcttttacttttgtagattgtcatgccagggctgtttgtcacgagtttaagtattgtccatgtaattactctctatgagactatgaaatctttgttttcgttttttgtcctctgaccaattacaataacacatgccttcttaaactgatccatagaatttctttttgttatttattaaactcaacctttttatggttattttctgctggtctagtcaattccgctttgaacaattaagataatcagattaatctactattttgtgcagtgggaggatgtctgttcaatttgtgatgatggtggtgattttctttggtaagtgtgcttacaatcaagttcataacatgttgcaatttagcttgttgcataacttgttctcaatgaaaaacagtagtggttaatgttattgcttcttactattacttgccctttcttagctgtgagggcagatgtttgaggtctttccacgcaacagagaaacacattacagaaataaaccagtgcacaacccttgggctaactgaagaacaatggaagatctttaggcaaaatgatgaaaaggtatatcttatttgagttgccccattctttagaatgaacgctcttttatgtctaatattgacatttttttcttgtttttttgggtaattcagagtgaaccgctatatatatgcaagaactgtaagtataatcagcatcagtgtttctcgtgtggattgctgggttcttcagacttgtcatcaggggctgaggtatgacaacaaagccatttgattatttttcatgaaggctttacacttgattgaaatgacaatgtggtatctagtacaacaaacaaggaaaaataggaggagactcaatttttgctaataaagaatgtactagggtctaggatatgcattttctttcttctttttattttgctaggattaagatgccattttctcattgtcatatgctccaaatgtctgttcaacttctaatatatgtatgctatcatatgagcaagtccaattatttgctaacttttgcatgtctcagcaggtattccaatgtgaagatgaaaaatgtggacacttttaccatccgaagtgtctagctagactactctaccctgatagcagtatgcagcccttaaattttgaggaggaagttgcccgtggactgaaattcctttgtccggtgcataaatgccatgtatgcaagggaggagagaacaagaatgacatggaaaatcaatttgcagtatgcagacgctgtccaactgtataccacaggaagtgcttaccaaggtttgacttcacattggagagatgcctctgccatcttccaaacattctactgttgaaacatggttcttcttttcttttgctcacgctttgcacttgttttgcagtgacatagtctttgaagatgatgaaagtaatggtatcgtgcaaagggcgtgggatgacgtacttcgtgatcaaattttgatctactgcatgtgtgttaactatgctacttttgtcaatcatatgaactgctcctcttgcccacccaaaactaaatggattattctctttacaggaagcatgagattgatccagaactgggaactcccgcgaggaaccacattatctttcctgattgcaaaaaccttttaacacgtggtccttcgaagcccaaagggcaagaagacgcacccgcagtactagatatacctgaagaagacatgtcgcctgatcattcctccgaaccatcccagccgcctccacagccggcagctgaaactgatcaaactgaccaggatctttccaatggtttcaattcgtttgcgccgaaggccttgttcccacttccatatccaggctcctgtggttggcttgatgactgaccatccaacctcactcatctagataaatcctaacacatatatacgccagcagattggtgtaattcctgctagaacactttgttcggaaattgggaagttagaatgtgcaacgcaatctactctgttgaactgtcacgtgctaagccacttgtgtgtattgttatcattattatgttattattttaatggaagataacattgcggttgaccagtgtccagtagcctgcattatgtttctgatgtttttgtttccagagatgtccaagtgaagcaataagctggtgcatatctgtgctattatatttatgtatttcgacaggcaattttgtggctaaacttctctatatctgttgtgtattattgaatttaggtgccgaaaaggattaaaaaatgttcgaaaaaaatattttgtattgaacaggaaaaatctgtgtgttaccctttccttttgtcatactacctttctgctgcagctgattcattcattaacatatctcctagcttaagatgatttgtgcatgcgttttccactcaagggtatattggcagcatagcagactgttcataataaatatcggtgccgaatttttcttcaaatcatggccgttgacaccgttcctgcctgatccaggcatccagctgtgctcggtcaagctgaggaaactaccagggcttagtggctagcagcacagttaggctgcgttcgttccagttcccaatccctcttcctcgtttttcatgcgcacgctttttaatttgctaaataatgtttttttaaaaaaaaatatataggaaagttgcttaaaaaatcatattgatatatttttgaaaaaaatagcaaatacttaattaatcacatgctaattgaccgttctgttttccgtgcgcactgttcatgtctggaacacaagttaacgaacccagccttagtgagcttgccatcttaggtttgatttctcctttctataaaatatttagggagggacgtctctcccttcaaatctttttttttcttagcc

SEQ ID NO: 67832 - DNA, 2455 bp, Oryza sativa
acgagaaaggtgaccagaagcttcacataaatgctcaaaattgtcttcattgcaaggtatttgcctccatgttgattcagttgtccatggacatttgcatcttttgtttcctgtaactgaatgaaatgttgacggtatctgcaggcttgtgacatcaaagatccaaagcaaaacatcgaatggaccgttccagaaggtggaggcggtccagggtacacagtaatgtagacgatagcaaaatactgcctgataccatgaaaacattaaccgaaaggcaataaattatcatcatgtatagaggacatcatgaaataatgtatggtatatttcttctggtcaatgtgaattcaacctatacttgtcaattggtcgttccaaagtataccaaaggaaaaaaggaaatacatgacaaaatcacagacagactacatcaggactagataatttcacagtgacttttgttcagtgtagtttcaaaatattcttgttttgaagaaatttaaatgccgtcaaagttgcaacatattttcctgttacaaaccataaaatgcagtggtgcgatgcgatggcccacaaggcccacttcgctggccacgtccaactctgtcggtccggactggattgcgaattacttttggcccatttgttgggatgcaacacgtgcggcctatatagtaattgggccgaaaagggagtgcgggctacgtgcggcccgtacttgttactccggaaatggaattgagagtttttgctccatcgatcagcgcggcgactcgattggaagccggtgggcggcggcgacatccaccggccgcggagaagacgattggcctccgccgccgctatctttcatttgctcctcagtcttcagctgcaacacgctcttcctctgctgtccggatgcctcaactccactcttcaaggtttcaaggtttgaggtactttatcgatgaacataatgtgttttagcctcaaagatgcaaccagctcacaatgatcaattcctctattgaagtttacatgtggtatttctgaatggaaatttacacacgttgtttggaaccacatttcaggaattcaagcaactcatcagattccaaccattctcaggcaggaaccaatgtactgatccattctggctgtgctttctgtgatccatacggcattttgcaacgaattcagtattcagcttacagccaagacatgtgcacatgcattacagtgggctcaaaacagcaaacccaacgtttcagtacacagttgctgactactgacaccaattgctgctggttccaagcttcagagttcagagagaccagatactttgctttcagatcacaagttcacaacatgttgagaaaggcattgatcaatgggataaattgttcagcaatccatccagcatgatgctttgcttgcatccttggactgaatacttaagagatagctaaagtttagcccctctctcccaaacacccccttatgttttttgtgaaggactaaagtttaggtgatgtttggatccagggacttaactttattctctatatttagacactaatttagagtattaaatatagactacttacaaaactaattacataaataaaagctaatttgcgagataaattttttaagcctaattaatccataattagataatatttactgtagcatcacataggctaatcacggattaattaggctcaatagattcgtctcgtgaattagttcaagattatggatggattttattaatagtctacgtttaatatttataattagtgtccaaacatccgatgtgataatgacttatttagtccctcccacccaaacaccacctcagtcagctttggattctcttatcaagagagaaaattcaggcgaccagaatacagtgatcaccagaaactgcagtgatcactgagatctaatagtagtactgtattgtgtacactacacgtgattaggagtacaatgtacggatgacaggacacattttaagctggtcttgtccaatctccaaagaacatgcatctgtgatctgtcactgagctttaatttaattagtagtaacagatatataaaacgaaggtatctcttcagattatctgtatcggctgtacggaacattctgaggttcagatcaccaaatgaaaatccaatctcctgaatcggttgaatgcagacatcaacatatgaacataatgctacctgcaaactgatgaaatgggcacaaaatcttcactgcaaaaggaaaatgatcacatttcattccctcacgggacactcgagacccaacctgatttctcaattccagcattagagaaggctagccagtatgatcagtattcagaaacagcaaaaacaggtacatggtcaattgatcaaaggccaaaagaattaaaattcctgaacattgaggactcatagatagattgatttgccgctacac

SEQ ID NO: 67833 - DNA, 6818 bp, Oryza sativa
attaagaaagaggttaaaagaatatatactatgcccttcattagtagggagataaaaagagaaggggagaaaacgaggaagaggaaggagtacttttggttcaatgactaaaaatgagaagaaaaagatgtagtgaaccactctaaaattatgccgaaaaagagagatatatttctactaaataaataaagctaacaacggtaattaaataactagttatacatataaatatgcaaagataaacagtttatccaatatgtatgttgttatttatttattgagaaaggtggtcaaattcttcaaaaaaaaaataaaatatatctcttccattccttccttttgttcattcttcaatgatcagtggctgtgtgtacggatcgaatccccttggcaaaaactagtataacattttagctgtcaggcaaagccagatcatcggcgctcttataccatccaaaattcatgagaattagccctcttcaacccattttaaaattacaaataagaatctgatctcttttaattatttgacaaaatgatagatgttgataactgataagcgcattcatgatgctcttatatccaggtcccagctactaggtacaggtagctggcaatgcaagtcagaaggatcaagaatccgtcaatgctgcctttgatcaaattaacaaaaatcacatgatgcaaagttgaatcttgtgcccgtggaacccgttacaaaataatcacggcctcgatcatgatctagctagagagagaactcatggagattggaaactctggtgattattctaatctgcaccttaatgctcactggaatctgaacaccaaccctctagacgactacttggaatcccaatgagcaaatcttattgacaactcaagtcaattacagggatggcctattgaataatgattaggaatgctaaagcaaaagtaattgcgacaccatggactaaaaatactgtcaagctgcagcacaaacaagaaaaaaatatagtttcttgaagaggtgtgtgtgtatactactttgtgtttttggatccaacgaaaccatcaattttttttctctgtgactgaattgggcacagacaataagcacactgttctaagtgatcagaagtgcacctgaaggaacagttttgctttagatttagcagctcaccgtgtgatctgatcttcgcagttccaagaacttttaatggtgtgtgatcgatattcacaaggaaaattaaggttcgctgaatctccaggcacgcaggcagagcaattagctagttgtgtaattgaaagaagaaaaaaagggagtgcaaaataaaatgcagctaaaatataagagaggtttatatatacatgcatgcatgcatgccataattaatgttttgtgagatatatcttttgttcaaatcagggtactgtcatatatttcttatacacgtaatctatacattgttgcaagttgcgacgttaagttttccccgcaaaaaaaaaaaagttttccaaaattccaagttggcaaatttaaatcaattatattattgcatctcccagctgattttatatgtgtgaaagaccactatatacctgcagcaactaaacatctctcgcacacattgatacctatactgattacaaactgagatatatcataatgacgtactactgttcatactatcaacgtactgatcttaattagatcaagtgctgacttaatcaacatgcctcacacgagtggtcatatatagatcacacacgcacaaccatatatacattcaacatatatataaacaattaaccacatatacacactactcctcaactgttgattttaaaacttcatgtaaaaaaaaaatctgataacaaattaaacctgcaggatcaatgaattaaccctagcagggttagactttggatgcacaattattttttaccgcgctgcaacttacatcagacgcaacatagacaatgcgtttgtgcagaacgtacagtgcccgaagatacgactaccccatacttaactgatcagtagctacaaatgctgacacagctaggttaattagcttaagttaattacatttttttaattaacaactaaaaaaattaataaatttaacccagctgataccgtacgtacacttgtggtcaatgatcacataaaataacaactaatttaactcaaacccctagcaattggtctcccctctccttcttaaccttctcacccaattaatggatggattctttgattccaccatcacccttctcccctactaaaccctccacccccatggatgctctcctctagctatagcttgttctaagctctagccgctgccgtcgtggcgtagagagagacattttggccgcagcgaaaatctgtttttctagtagttgcgccgcccccatggaggccaactaccccaagtatgtcctctatgggctcctcatcgtcggctcatggctgctctcctgcctcctccatttccaggtcttccacctctcgctcttcccctacccctcctacctgctgtcgcgccgcgtcgtcctcccgctggcgctcaacgccagattcctccctcctcggcccgatgttgccggcgacgacgatggcggcatcgtgaggaggcgctcgtcgtcgccggcgaaggctgcggcggaggcgtcgtgcgatgggcggtatgtgtatgtgctggaggtgccacggcggtttcagatgctcaccgagtgcgtcgaggggccgaaggtgttcgacgacccgtaccatgtctgtgtcgtcatgtccaactccggcctcggccccgtcatccctcccgccgccgccggcaacgccaccgtcgacggcgacatcattcccaacaccggatggtaaggaacgcgtcgtgtcagtcgcctcgccgtcgccgtcgccgtcgccggttggtgatcatcttggattccatggatgcaggtataacacggaccagtacgcgctggaggtgatcttccacaatcggatgcggcggtacgagtgcctcaccagcgacatggcggcggcgacggcggtgtacgtggcgttctacccggcgctggagctgaaccggcacaagtgcgggtcgagcgccacggagaggaacgagccgcccagggagttcctccggtggctgacgtcgcagccgtcgtgggcggcgctcggcgggcgcgaccacttcatggtcgccgcgcgcaccacgtggatgttccggcggggcggcgccggcgactccctcggctgcggcaacggcttcctctcccggccggagtccggcaacatgacggtgctcacctacgagtccaacatctgggagcgccgcgacttcgccgtgccgtacccgagctacttccacccgtcgtcggcgcgcgaggtgtcggcgtggcaggccacggcgcgcgccgcgcgccgcccatggctgttcgcgttcgccggcgcgcgccgcgccaacggcacgctcgccatccgcgaccacatcatcgacgagtgcaccgcctcgccgccggggcggtgcggcatgctcgactgcagccacggcctcgagggcagcatcacctgccgctcgccgcgccgcctcgtcgcgctcttcgcctccgcccgcttctgcctccagcctcccggcgactccttcatgcgccgctcctccatcgacaccgtcctcgccggctgcatcccggtgttcttccacgaggcctccacgttcaagaagcagtaccaatggcacgagcgcgacgccgacgccgacaacgacaacgccaccgttgatcgccggcgatactccgtagtcatcgaccccgatgatgtcgtcgaaggccgggtgcgcatcgaggaggtgttgaggaggttcagcgacgacgaggtggccgccatgagagaggaggtgatcaggatgatccctaggttcgtgtacaaggaccctagggtgagattcgagggcgacatgagggacgccttcgacatcaccttcgacgagatcatggcgaggatgaggaggatcaagaatggcgagatcttgggatggaagctagatggtgacgacgatgtggttgcaaaagattcatgacacaagtgaaatggagattttttttttgtgttaattagtagtgttcgttttgttaattgttgtgtttttttgttgatgttaaattgtcactgttgccgtgtatgttagtgacatataaatataaatataaatatatcagtgcgtatattggcggtatgatgagcgagagaaaattagaataaaaaaacaatcaactagattgctttcagtttgtatatatgtagattttattaattgtatcttgtcaagcggctgtgtgcccaatatatcctcaagctttgaagaagagaggctttcagttttacatattagtatagcttgaatgcaaattacttatatggtttggcattggtataaaataaatagccaaatttcctgcacaaactgctaggagctagatcgattaaagtgtatttgatatacaattcttcttctattcctattatttcaaaacaactttgtacatgtatatatatacactagaaaatgcccgtgcattgcaacgggtgaatgttattttaatcttattattgttatacggtttagtgaaggtgaaattcaatatgggaatttgctttgatatatatttttctagaaaatcatgagctgcaattaggagtccgatcatctcaaattagcatgcgagtttttaaagatatttcttatacgactcattttgtattccaaaaatgaacgaacttaaaacccgacttaaatatggatctatatttccaaaagcgaatggatttaaaaaccgactcatacacagatgacgtaccaaagtaccagcaaaaatatcttcaatttttataatggtagagaattgtcaatttacactatataataatctagaacaaccaaatgcacatgatcaacaataacatggatttttttttctctctctattaacatggaagtcttttagacttggagagcaaacacaacgacaaatagataaaggctcgcaaacacgacgataagataagcactcaaacatatatcgcggttatcaacctatgcaagacagctcaaattggtacaactaggttgagttcaacataatttgataaaatttgagtcattaccttgaattttgagcgtttatcatcaatttgacccagttcgatccgttcaaatttcataaaccctatagtagatactccacgtgatttagtcaagtaggcgagaacatttctcagttggatggattaaagccaacaaacagattcccttacaacctcaattatgattttacccaagtgatcgaagaccctagcattgtatgcaccaataagactaaaaatatactacctccatttgttttataaaaaagatgatgttgttgacttttaaagtaacttttgatctttcacattatttataaaattcatgaaaatatgcaagtataagtcattcttaaagtttatttaataataaaacatgtcacaataaaataaatataacatttatatatttttttttaatagaacgaatggttaaacatcatgtcaaaactcaatggcgtctattagaagaagaaaaaagagagtagtgataattattgatccaatgttttgggcaaaactagttcctagggtgtgtgacaagaaaggtgtgtgtaacagtgccaaacaaatggcatgcatgtgctggggagacttagtaataaatccaactcaatcaatgacttggagtcaaaaggaaaatagatttgagtattcagagtagtctgtatataagcagggccaagctattgtagtgaaagttgtggaacaagctaagggtgactatatctcatttcatttaatcatgaagctttacaaatgttaagtaatactgtactagtttctaacttgattcctttatgactccattaattggaggactgttatcaagtctgaggttacagaaggccaacgtgcaagatcaggcttacgtgctattaagaatgtcatgtcatcatgccaacaagacagatcagatcactcaacaaatgagtgacttaatttttttcttaatcaaaacatgacactgtttggtaggtgattcttgacgtgacgaatgggctcggcatgccaacctacaattgcatgacccatcaacaacttttcattgattttcattcacttccacatcgcacgctgaagtactgatgaacctagagcactcatatgatcatatcgtgtaggtcgctttattctaaagtgctactattattgcggctcacactttttaaattgataaacaatttttttaagcaatttcacggttcttgaggaggtaccaccttttctatagtaaatttggtacttcttgatgtctaagttgagataccaaattttacactaagtttttttaccttatggtatcttctcaaataccgtagaattgctttttttttataaaacctttcttagtcaatttttttgggccagaagttaaaccgtgaagtataaggaaaagcaaatcgatttctgaatgggccggcctgttatgtaattcatgggttgggccagaaggaataggtccattttgcctccctcatctcttgcgcttgtgtgaataacatccctcaaccgaaagacagggtataacgcctccttcatctctgaaaactagagcaaatcatttccctcagtggttttgctggcggttttgtccgacgtggcgttgttgacccgttgacaagctgactcagcgtggtgggacccacatgtgagtgtgtacctctctctctcccttatctct

SEQ ID NO: 67834 - DNA, 4946 bp, Oryza sativa
  unsure (1)..(4946): unsure at all n locations
gtgcgctaaatataaggcaccgcctgcatagggtcactgccacacatcgtagggtgactgcctcgtgggccatgtggtgcgggtcggcgacgtggacccacctgtcagcgagtgtggcggtgaaggataatgggttgacgcgacgacagctgtggggaggagcccgggatcgcggtaacagcggcggtgaagtctgtggactttggaccgtgggttgcgtcggtgacgggagcgggcgatgcggccgcggagatgtcggttggattgcatcggattggatgccatggcagcatgggccgcacgcccgcacgggacggagtgcggccaccgcgtggaatccatggcgcggccggtacggagtgggccgcgtgcggcgtgccccgtgatgcgcccgagctggacggccatgtgcgtcggtgaaggctgtcgcgtcgtgtgactcgcgtcgtcgtcgtgtcaacctctgacttgccgaatggaaaatgtctattgtaactcccttaaatataggccgtatttctcgatcgtaaagctgctggatacaacaactctactaaccgttaaaaccggaaaaaaaaacttataagacactactccatctgtctctataaatataagggatattggttgaaaataacacatcctaatataacgaatcattataccaggatatattatatccgactaaaatctcttatatttagatacggagggagtatttagaatggcattagctaacgtggcaaattaaccacggtcaaaaacaccaagccaacaaggatgttaggatatcaagtggaactcacatgtcattctcgcttaccctccttcctttctccttcctccctcctccccatatctctctcctcttcccgcaatactatcttagaaatctttttcaactctcttaatagttagaggggttattatatctgattttatggttaaaagacgaattagatccaacctaagaaaaattagacattttccgcagcgaattgatgcccgctagtcgcatggatagatctagcccgcttatcctaatggatgcggcccacggcctcccgtagttggttcccgtgacatttcggcctttttcccccacgccgaagatccatctacacgggctccttcaccactgaggccaatcaacggtaaccggacgggcccatctacacgggctgcttctccagctgagcttcttgctgttgggcccgtgacgaagcacacggcccgctgaagcctctgctcgtggggacggacggagcgaggcgagcgccttcgccgtgccgcgtcgcgcggagcggcggccggccgaacaagccggccggcggggcgcggcgtgcgtgcacccactctcggcacggcggtgagctcctcctcctaactcggctactcccttcaaccgccgcgtcggctccgctccggccgccgaccccttctgcaccgttgggttcggggggttgccgggttgggggaaggcggctcctcctcgccggcgctgctcggttcgattcggagggggaggagaccagccgcgagcactgtagtggcgatgtgacgccccttcccttaccagtaaccagtactcactttgtgcctctgtttatctattattcagtttcactagatgttaatttgagaggtagggcgctaggcctgtaaaattttacccaataaggtcagttgatattttttttattcacttcatgtagtgattaaccctaacacgatcctagttgatggctgggcatgggcagaactgcacaagtagtgcttggagttggcaagggaattttatagagggattctgcgaaatcgagtgaaaggaatagttatgtttgcatcgtactttgattggtacaatcggctctctcttcaaagtttttatcgattattacccccttattgcagtgcctcacttggtcatagctatcttttgttcatttattagataagtgatgtcccagcattgtcgtttcagacattctgtaagtattccactgtctacctctccaatacacaatcacttgattttgagttctctatggttcccggcagttgacttcacagatctagtagtgctatgctttacacttacagctgctgtgcaatagatttttgttttggctcctactattgtgaactcaacgaaatagtttccatcaaatagaaagtgaaatacaggggtcaaataatttcaagggaaataaaagatattggagttcagtactttttgcagtaacaataacctgtcagggttgcatgacagaagtcatattccctgaagggctgaatggggagatgaatcttccctgattttcatatactcttaggctttataataatgatagcctctgaataaacccttcaaaatgttaagtttgactaggatagtgattgacagcatcgatgtaagtgaatgattattttgtttttgaacaatctttcatgcatcacatccagcttgcactgtcatcatgtaaacgttatttaggtcagtagtcaagttgttaagggcatgtaagtttgtttcattattgtttaaagtaggctttagcatatactgcaagttatgtctggtgaagcaataataatttatttgatgtgacgtgtgtaaaatatgataaggaggattaccgtgtgaaactcaagtaacatagttttttcagtttgttttatactttatatgtgggacccaaactagtaatattgaacttatttctacatgcttcaatacatacaactgaaaaaattttaaacccccaaannaannccaaanaatgacttccatatatttattattcatttgtaagccagttagtcctaaaagaaacaaggaaatatgtggagctattttgatcactgattcctctgattctgttctttttcctttttttctttaccccctgtgggtaattatatatataagaattgatgatatgtgattcgatgacttatttggaataatcctttgagtttcatctgttctattgatatctatactacatcagtttctgtccaaatgtttatttcaggtgaagaatcttacactggcatttgctgttcgagtagctgcgtgactcttatcagaactccggcatatcaattgatgaggcccaacttggtgagaatcttcctattttgggctatgcggtgataatctaaagatttcctttaatggttaatatgtaagcggcagactccttatctaacttctagtttacaatatctctatcaaagttgtggcaattgtaagtatggtctgtgaaaatgacccctcaaaggccaacccacttgtatggctggaaagttacaggaatttttatgctcatatgttcctatcagtcaacagtaacgtttcaatatattgggattctttattgcagttcctactgtagcgtgcaattccttatgggctctaaagcctcccctgtgattatctaattaaccacctggcccgctagcccgaatacttttgtcatatcttagtagatgatattatgacacacctccaagattgggctgacaacgaaagatagtgtagatggacatgaaagtaaaatgataaaacatgtccttttcgaaagaactgggactccaccaatttcgaatatttatcttctacagtagctgtgactaactgagctgaagtactgtatatggtacagatgctcattataaagatccccttaatctcacaattaagcgttaggcatttttagcatctgtatattaaattgcatgaatttctttatccttagcttggttcctgtttataacaagactatttagtccatgcaataattcataaaagtttgcaatcagattcacctcatgaattgattttatagtggtagagatattgctatacaatgcttagaacagagcactgttccaatgcagaagtctagggtacagaggagttgggaaaaggaaggtggtgataattgttctgtataggaatggggtcccatggcaatgttaactataggagaggaggggaggaagggttggttatgaggccatgtgcaacgggagggcacaagtggggaacaggggttgcacgggataacatgggagccatgtctctccatgttgcctagtgagtatttgtgtatagctttcgttcttggctggactcctctggcatgggaataactatcaacaactcacaattcccccacttctactttacattacttacccttttcctaccaatattagaaaccaaaagaaatggaagctttactattttttccttttccgttttacttttatagatccgatttcaattggcggtcatccctgtaggggacatggaagagaattcattccctcatatgtgatattttttagctggtattttgacaaagtgaataaaatctgattccttgatttctaccaagtaatcagctttaaagtttaagtatttttcccattgtaccattctgttatttcttactggaaccagatggattgctggggtgccatgtgtgctatggtcatggaagaaggattttgcacgctgtaaataaagttttttcaccacctaacactaacggatatcagaaagagtttcctagtgcactacagcatcggtgcgctcgcctaatcatgagacaagacaaccagagcaacggtggcaattctacatgtaattgagcacattaaggtgaaatggacttctgactgataaattcttttgtggtttggtcactttgtactgccctgtaatgacagtaacactcaagtgtgtgctttaggtgatggtaccttttgtgaaactgtagggaatctttgctggaaccatgatgtacaagcgaaatgttggcactttaacctaatgagaaggaaactagtagttctgattatcacatgggtcaggctcttatttgagtatggatgagatgcccaagataaaaataccttgggacactggaagc

SEQ ID NO: 67835 - DNA, 6256 bp, Oryza sativa
gcgtaattcttctgacggttctgtgctgtcttcaaacgttctcgtatcagcttaacttgttcttctgctaacttgagtatgtcaggaccgaataccagtgcttcgcccacctcattccagcataagggagtgcggcactttcttccgaacattgcctcgttcggcgacatctgaatgctggcctaatagctgttgttgtatgagaactcagcatacggcaaacaacgatcccaagtgccttcgaaatccagggcacacgcacgtagcatgtcttctaggatttggtttaccctttctgtctgaccatcggtctgcggatggtaggccgtactaaaatttagatcagttccgagagcttcatgcaactgcttccagaaccttgaggtgaactgagtgcctcgatctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgctctgccttgactctttggcaaatgtcacacaaggctacgtattccgcgacatctcgcttcattccggcccaccagaagtatgccttgatatcttggtacatcttcgtacttcctgggtgaatggagtaggtggactcatgagcttcctttaggatgagatctcttaactccttcttggccggtacacagatgcgtggaccgcaccaaactgtgccttgatcgtctatggagaaattggtgtctttcttctcctgtattctttttatcaactcttttatcccttcgtcgtctttctgagcttcccggatttgcgactctagggtaggctgtactgtcaagctggcagggacacctgactgtaccacggtcagccttaacttctctaattctctgcacaagtgatcttggtcaggccgtatttgagctacattgcaataggccttgcgacttagcgcatcagcgaccacgttggctttaccaggatgatagtggattccaagatcgtaatccttaattagttccaaccatcttctctgtctcatatttaactcggtctgtgtgaaaatatacttaagacttttgtgatcggtgtatacttcacatctgttcccgattaaataatgcctccagatcttaagagcatgaaccacggctgccaactcaagatcatgggtgggataattgacttcatgaggcctgagctgcctggatgcataggccacaacctttcgttcctgcattacgacacatcctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcataggtctggctagcttagagaatccttcaatgaatcttcgataatatccagctaagccaaggaaactgcgaatctctgacacattcttgggcgggttccaagcaagtacagcttcaaccttgctgggatctacttcaacaccgttgggggagatcacgtgtccaagaaatgctactcggtctaaccagaattcgcatttcgagaattttgcgaatagttgatggtccctgagcttttccattatcaacctcaggtgttcagcatgttcttcctcgttcttagagtatatcagaatgtcatcgatgaataccacgacaaactggtccaggtattccatgaagattttgctcattaagttcatgaagaatgctggagcattggtgagtccgaaggacataactgtgaactcatatagaccataacgcgttgagaaagcggtcttcggaatatcttcagatctgattttcagttgatggtaacctgacctcaagtcaatttttgagaagactcttgctcctttaagttgatcgaataaatcgtcaatccgtggcaacgggtacttgttctttatagttacttcattcagggctctatagtcgattaccattctctcagagccatcctttttcttaaccagaagtactggggctccccaaggggatgagctaggtcgcacataacctttactctccaactcttcgatttgtcttttaacttctgctaactcattagctgccattcggtagggtctttttgcaattggagctgtgcctggtgccagttctatggcgaactcgatctctcggtctggtggcattcttgttaattcttccagaaatacgtcgggatattcatagactatgggcaccgactccaaggaggtgacttgtaaacaggttaggatagaccgacttgcggtaggggtgttaggggtaaagcggacttgctttcctgcaggtccttgcaaggtgatggacttttcggcacaatctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattcctcccaggggaatgtactatcattggtacacgcaatttttgggttttccaaccatttcttttcacaaaagcttgcgatatgaaagaatgggaagctcccgaatcgaacagaactattgcgggtacggagtcgacagagaacatacccatcacagcgtctggagcatcctgagcggtttcagcttgaatgtgattcacacggcctcgaccaaagtggttggaagcacgagaaccttgtctacttgcctgagagctaggacgagactgagctgccgctggagtaggagttctggcagtgctgccattagcatgccctgagttggtgttggtaggattctgaggacactgtctagcatagtgacccatctggttgcaccggaaacactgaactgctgacggtccctgcggtgacttgaaagaggtaacactgttaggcgcagtatcgctactaggggcacgctgctgtggctgaggtgccggacggtttatctgaggacgaggggcgtagcctggctggcggttagcctgggtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgatttctttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggtaggtcctcttagttggtgagaggcgtagagcgtcttctcaacaggagtacactgcactaagttgagttttctatcaacatctttcaaccaatcgtcagcctcgacgggctcgacggtctgagagaactctagcggacgagacctcaaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgtgttgcgggaaacagtacgatgcgaacggttgctgtggtgagactgctcattagctgattcatgattttcttctggctcaactctaccatcctcaaaaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggtgtggaagctgccggaaggcggaacctccgagacggtggctgtagtcgtgggccaggcgacgaagcgcagtccaggagaggtcctggtacgcgatctggagagtgggcctggccacagtgaagtggtgggggcaaaggccagctccgtgtatacctccacgggggtaaaggtacaccgagagctcacagtgagggggaacacggtccacggagtaccccgtgtactcgggacatgagaagccaaggaaacgggcgaggtcacgaagctgggcgacgtggtgaccctcaccaaaaccgtgggaactgaagctggcgttcactgccatctacaattttgaaagagggagaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgctccaatttaacctgttaatcgataccagtcccaggaaacagtgctggtatcacagggagacagaatatcacagcaacagaggtctctttattatagagtagaggtacagtcatgttgggctgcggacagatcccgagcttacaactgcattacaaaaggaaaacggaagccaggacttggaccaatcaacacaggcgcgacttgggaactaggccgaaaccctaaaactcatcgtagccgacttgctcctagaagaactcctcatcagcaggatccacttcatcttcttcagcaactgggggggattatttatatagagcaagggtgagtacgggagtactcagcaagccaggggaaataagtgtttaatgcaggcttcaagggaaggctgctgtttttgcaattgattttatttgaactcttttctgaaaacaactaagtgcttctcaaacgacacgaatgagacagtgcatctcgtccggtcggagtatgtgcaatgtatcaatctttaggaatgaacaccgttgg

SEQ ID NO: 67836 - DNA, 10505 bp, Oryza sativa
tataataatccgcaaatctccatataacagcattaaacttcggatgatcatatcttggtcatacccgctccgaaccgacccgttcaagtctcttaatgtttgttataacctaaagaaccatgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatccttgaacatattgagtcccagtttataaaattatgttgatttaaattattgcattatcgctttatttaaattcccgcgttatcactgttttatctagccatgcctatttacctttgttatgaccttattattgctattgttattattaccttgttcaccctaggaaaacaaaaccccaactagtgggtactctattcatggttccactagtatgaatttaggtagatgcttcgctgattaataggacaacactaggtggtttttataactttagactttgggaattctcatatcatttgaacactatggaatggttggcttatggtggaattggacatacacctctcttcctctttcaaaacccctaaaacctgttttccggtggggtttgggtgcatgctagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgcccttggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacgaccttgattaataatactgtgtagctttaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgtgacagcgcggacgttgtcgcggcggcggggcggcgcagcaccgagagggcgtggccggggaagaagagaggggggcgtggttgagacggcccggtgacggtgaggcgacgttccagatcgcggcagtggcggccaacgacaaaggagacatccgtgcgccgtggttggccgcgcgacggcgatgcgactttgtggtggtgcggcggcggagagtggaggcgtgggttttataggcggcggggagctttgagaggaagggactaagcacgggcggtcggttcaaaccgaccttggggcggtcggttcacgggaggcgcgagaacgagcgacggcgtggatgcgaaggaccatggaggcggtggatcggatggtggaaatcgaaccgcgagcacgggctggcatggctcggcgtggtcaaggtgggggcgtcgagctgctgcagcggcgttagcggctctgcctccgagcgcaagcggccaaggggtggagacagggcgccattgcccgggaggggaaaaggaagggaggacggtggaaagggggacttgccccttccgtttttgggcgaggaagctggtgtggcgcggtttcttggtcggccacgaccgtttcgtgcgcgggaatcgaaggcggtggccgatttttgggcagcgtcggcgggagtcaacgagagagagagagaacgaccgagaaagaaaaggggagagacggcgctctctctgtggggatcacgtgcagcacacgcggagatggagtgggacgaagggagagttgggccggggagggtgaaaacggcccaaagatcaacggaggaagattagactttttcagggaagtcgatattgagggatttttgtatttaaaatcgaatggggatttgaattcaaattcaacatttgaactcagcaaaatacggaggagccaaggaatggattcaaggtggactcagttatttctggattcgggagaagtatttggcgaggattcaagagaggcgattgacctttggaataattaaattggaattagaatcttgaggcgggggattttgatatcgatgagagggaacgacgggaatttgaattgagatcttggcacaacttagactcgcacacaaagaacgaaaactttcgcatataggattttgccgaattagtttttaacgtctcgcgaaaagtggagcgttacactcgtcccgcccggatccggcagcggcgtgcctcgtcttgcccggatccggcggcggcctcgggcgcagagtgccacggcgacctcgggcggcggcgccaccaccatctcctcctcaccgccgccgccgacgacgtggaggaagcgacgggccatattcggcggcgccggtcctcgtcccactcggatacggaggcggtaggactcgtcccatccggatccggcggcggccttgggcgaagagtgtcgcgatgacctcgggaggcgggagcggccagcggtgggagcggcagcggcaccggggtgggtggcggtgggagcggggccgggtggcggcggtgggagtggggacgggcggcggctggagcggccagcgagctcgggtggcggctagggtttcttgtttttttgaattttttttgaattttttttggtgatttttctctttgcatgtggtcggcttaaccatctgcatacgaaaatcagatttttcgcatgcgggtgccctggccgcatgcaaagatgacgatctttgcagacaatttggcgcatgtggctggcccagccgcatgcgaaaatcgttgccggccgtatgaaaaaacgaattcttgtagtagtacagtgttactaaatttcactgttaacatcaggatctagatctcgagcatagccggggaagtggtgtgggaatgatatcctccaagatcattctgctcctgccaccaccgccttcctcgtttgcaaccgtcacaactttgccgctgcggacgcagtggtggggcacgaccaggcctatatatgacatcggtgatcagctttagcattctcaaattaattagaaacacagtctttttagggaaaaaatttaaatgatagaaaaatatataatgtttttcgatggaggtagtacaaacgttaaatttcgagtgtttggttgtcggtgaatgaacaccggtagtgagaatccggtgaaatttcgtttgggtttggctaagggatgaacacattgtgttaccttgggtgcctcgatcggaatgaaaaggtagatggagaattaagtacgtgttgcacgtgcagcttcagcaccaagattcggcggcggaataacctgctctactctgtacgtagcagcaagagatttgaaggagtgtaacttgcttgctcagtggtagcaaagcaggccaaccgctggagacgcctgtcaccgtacgtgtaccgaccgcgtgaacccgagcctctgagcagagtacaccgcgcgggcggtcgtagctcgtctcgccacgccacgcccgcaccacgagcaacgcaaaccgctttgcatgcatggctcaatcccgtttcccgtacgtacgtgcatcgccttgatcataagttgataacacacaccgtacgttcctatataccaaaaggtctcgtccgtcgaccataaccgatcgaggtccaagctggtggagaaaggggctttactctcggttgggaaccccctatagtcccagttatataaccggaactacgaatccgggactaaagatagtctcggttgattctttttttttttgttgttgtttctttgctcaaatcgatctgctccctaaatatctcaaatcatccacaagcatcacagatttgggaagaaatacatcacatattgcaaagaaatgcatcacagatcacaaatacatcacatcacaaaatctcaaacaaaaaatacatcacaaatactaaaagaactgcatcataactcaaatacatcccagatcacatccaatatcacatgcatcacagatcaaatctaatgaaacacaaaataaaaaaaaaatcggcagagcagatggggatggcgccgccggcctcccggtccccgccctctcggcgtccgcgccagctgtcacgccccgaactagtcccgaccggaactagcccgtgacgctccaaattaacctgttaatcgataccagtcccaggaaacagtgctggtatcacagggagacagagtatcacagcaacagaggtttctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactccttgtcagcaggatccacttcatcttcttcagcaactgggggggattatttatatagagcaagggtgagtacgggagtactcagcaagccaggggaaataagtgtttgatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtgtcagtctttaggattgcaacaaggttggcacccggccaacagcttttcaaacggccacccgggccaacaacttttcaaacggccacccgggcctagctgatcccatcagctgcagatttttcaaacatcgaaccccttttcacaacagcaatttcacaagcagtggttagacaaaactatgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactgggtggttacaaggggacatggtataacaattaacaaaggaaggatccaatgcaacaaattaggtaggtttgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaatcctcgcacagcgggtcttcgggctctgaaactatacgcgaaacagaacaactcaacaaacggcgaaaataaagccctattaaagacctctaagcgtgccattagatagatctcgagatttgaggaattttggaagttgaacggagtcaatcggatttacggttgggaagatattgaatttctaagattattggatttttggtctaaaggaaaaaggatttaattaaatcctttttgaaaaagaaaagaaaagaaagaacagagggatggaaattagacttttcctcgggcggctagggcgcggtccaaggtaaatggagcggcttggccgagcttaacgggccggccggcccaagacggcccaagcgcgcatgcgcgcgggagggaggagagagaatccggtggaccgggctcaccacgcgcggtcccgggtgggacccgcttgtcagcggctcggctcaccgtgcggagggagtacgtggctcatgcgcgcgggcggggaaaggacgcggtgcacgcgcgcggtccgtggtggacgcaggtgcggcgggcccacgcgcagcctcacggctcgcggtggaacacgcgcacggagagggactgaccggggtcggctcgatccggtctaggctaagctggcgccgatgtggcgcctacgtggcggccacgtgggctggcgggaggtagacgacgacccggccgcgaatggacggcgggcggcggcggcgagcggcggagcgaaccacggcgatacgggcaaaagcgtgcacaccgggcggttgctcgtgacaaggggagacgagccaacagctcggattcgccggaggttgctcgacggcagcggattgcggcggcggcaaccggcggcgggagaaaagggaaacggcgacgaggtcacgagaggtcgattcccggcggtgagagcatctatgcggcttcgggaactcgacgctagcgtcggattgggcggaactacgccgagcgaggccggcgacgagcgggtgctacggagctcgagcggcgacggtggcgaacacacggcgagcgacggcaacggtccgggcggcgccggctaactacggggaggctactcaagctactaccgaaatctagggggggagatggagcgaggaggaagaacggagagaggcactaccgtgcgggtcggggcgctgtgacgagaggccgacggcgcgggagtaatctctccggcctcgggccgaggaagaggaagaagagggcgcggccgaagtccccttccgcgtcctcgaacgcaccggctatcccggcgcttggcgaaggacggcggaggcgagacagagcacgggggcggcggcaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaagtgacgccggcgagaggggaaaaaggggagaaaaagaggaaaaggagggagagaaagggggctcgcccctttgccgattcgggaaaaggaggagggagcggggcgactcggcagagggagaggggctctctgcctccgccccttggaggctagcgcgcggagtggcgggggccgggcgatgacgacggcgatgacggcggggcggtttggagcggcgcgacgacacgggcgacaggcgcgggctggcgcggcagagggtgacggcggcggcgaccgggcggtcggccactcggcacgcgcgcgcgggaaacaacgggtggcacggctgggcagcgggaccgggcgacgcggacggcgtagacgacgcggctcgggcgggaaaccacgcgggcgcgcgcgcgagcgacggcgcgcggggccggttttgcgagcggggagctcgcgcgagaggagggggcgctcggcgtggctctcgcacgcgcgagcagcgagcgggggggagaaacgcgccggggaaagcgagagagagagagagagagagccggggaagagatgggccgagcggaattcggcccatcgaacccgggggaagcaaactagacttttgcggagggattcgatttggaaggaattggattcggaattgaactcgacgatagatcggggattgagatcttgagatggcacggacactagacaacaagcaaaaaaaacaaatttcgcaattagggtttttaagagatgattttcccgctaggcgccacgacggaacgggcgctacagaccaacccccctaacaagaatctcgaccccgagattcagcacctaagggagcaggtccgggaactcggcgcggagaagatcttctcgctcccaggttgtctcgtcttcggaatgattgctccattggactttgtagaacttgatggtcttccttcgagtctgacgttctgtctcttcaagaaccttgatcggtctttccttgtaggtcagattcttttctagctcgatattacccaggggaacttgctcttctggaactcgaagacatttctttaactgggatacgtggaacacgttgtgcatatctgcgagaccttcaggtaactcaagctgataagccacttcgccacgtctggcggttatgaggtaggggccgatgtagcggggtgctaacttgccggacatcccaaacctcctcataccacggaggggtgatacccgcaggtatacatgatctcctttttcgaactcaaggtcatgccttcgattgtcagcgtaattcttctgacggttctgtgctgtcttcaaacgttctcgtatcagcttaacttgtacttctgctgacttgagtatgtcaggaccgaatatcagcgcttcgcccacctcattccagcataagggagtgcggcactttcttccgaacattgcctcgttcggcgacatctgaatgctggcctaatagctgttgttgtatgagaactcagcatacggcaaacaacgatcccaagtgccttcgaaatccagggcacacgcacgtagcatgtcttctaggatttggtttaccctttctgtctgaccatcggtctgcggatggtaggccgtactaaaatttagatcagttccgagggcttcatgcaactggttccagaaccttgaggtgaactgagtgcctcggtctgacacaattttcttgggacagccaaatctacatacgacgtgggtcatgtagagatctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccggcttgactctttggcaaatgtcacacagggctacgtattctgcgacgtctcgcttcattccagcccaccagaagtatgccttgatatcttggtacatctttgtacttcctgggtgaatggagtaggcggactcatgagcttcctttaggatgagatctcttaactccttcttggccggtacacagatgcgtggtccgcaccaaactgtgccttgatcgtctgtggagaaatttgtgtctttcttctcctgtattctttttattaattcttttatcccttcgtcgtctttctgagcctcccggatttgcgactctagggtaggctgtactgtcaagctggcagggacacctgactgtaccatggtcagtcttaacttcaccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcacatctgttcccgattaaaaaagtgcctcca

SEQ ID NO: 67837 - DNA, 763 bp, Oryza sativa
ggcgcaagcgcggcggcgtggcaataggagggcgccagccatgctggcgccgccccagggaggagccgccgcctctattcctgtttctctgtatggagttgcaacggtgtcatttttattttattttttcggatgttttttcacactcaggatcacgatacaaccaaccacaaaaaaaatttaaactcaaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatataagttaaacagtacatagagatgcaatttttttatttttatttcatttttttgatatttttttcacacttaggagaacataggaaccaaacggacaaaatatgtgacatgtataattttccaaaactctaccgaaacggacaaaatatgtcatctattaaaataggcgtaactttctcatacggactcggaatcaggcaaataatatatgcacggacatctacagaaaaagttacatccgattctcccccgctttgccgggttcggcgatattagaacctccaaattccgcttgcaagattgtgttttcgaggagagaagtttttcgatggagctttggaaaattccacatgccacatatttcgtccgtttgagtttattttttacatgg

SEQ ID NO: 67838 - DNA, 1475 bp, Oryza sativa
aagatttactgccttactggtagtaaggagcatgttttttctaagttgctaaataaacatgttttcatctagaccagcatggttcatgctagcatattataagggatatgtttctcaagtataccatgcaaaattaatttcactcaatcatacaaccctaagggacaatgatttgattaaggtaatgaacgaccaaaattgtgcgtggatcggagaagaggacgatcaattttaattaccttgaggctggaagaatctgagagcgaacttgttgcgctccaagaccagcttcttgtctaccgtgagtgtgtcagtggtatgcaaacgcagtcaaacagagataaagtacataaacttcttttttcataaccaaactcgcattcttgaatgcaagaaggcgctgctggaagagcaggaattgttcatcgtacatgttgtcatgacaaaccatcagaacatgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgggtgtattatagatctgacgatctagttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttatcatggtcttccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaa

SEQ ID NO: 67839 - DNA, 2253 bp, Oryza sativa
ctttacggggaataataattggtccagtctttgagcatagaagatagactcatgactatgaatccatgtggaatgtatccggaacaagtcccaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaaaacagtgacaccaatcaaaggtaatgaagttgcataaccatggaggcgaagaaacagtcggtgatgacaaaagccaaccgacgatgaagacgtagacgcgcatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagccatttgcatagtaggtcaaccatgaaggtgaaataataagtcggcgaaaacataatcatccattagcaatagcggagatgtcagggccgatgaagcagaggtgctggtgatgatgtcagtgacaataatccatcaaattaatgttatagctgttgtagatgcttcacttggaggagagttgatgttgttgtccaactcgtccaaaccgaaatatttcaagttgttgaagtagaatgtctgctctatatattatcaaagatgaagataatgactcctggagttgactcgttggttgatgaattgatttcttcagcttgacataaaatttgtcaaattttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcacatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaagcactagtcggcgacagcataaccagtcggcgacggaagacgatgatgttcatcagtagtggtagctgtctaaaccagacgtagaggtgagagcactagtcagcagcagacgtagacagcttgtgttgaagatgatgacgcatattagcggtgacggcgacgtagccaaccgtgaagaagatagcatcagtcggcgtcataacaggccagctatgcaggcggaaacaccagtcggcggtggacgaggcggccggtcggtgaagacgtagacgcccaacaacggcggcataataggccagccgtgcaggcggaaacaccagtcggcggcagcgaaggcaagccggtcggtgaagacgcagacgcccatcaacggtggcataaaggccagcgtgcaggcggaaacaccagtcggcgacggtggaggcaggccggtggtggagtcgtagacgcccaacaacgacggcataatggccagccgtgcaggcggaaacaccaatcggcggcggtggaggcaagccggtggtggagtcgtagacgcccaacaacgacggcataataggccagccgtgcagacggagacaccagtcggtggcggcgaaggcaagccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaagacaagccggtcggtgaagacgtagacgcccaacaacggcggcattaaaggccagccgtgcaggcggaaacaccagtcggcagcggcgaaggcaagccggtcggtgaagacgtacacgcccaacaacggcggcataataggccagccgtgcatactgagacaccattcggtggcggagaatgcaagccggtcggtgaagacgttgacgcccaacaacg

SEQ ID NO: 67840 - DNA, 3186 bp, Oryza sativa
ggatgggaagggaggagggggaggagaggaggaaggggaggagttggaggagaggggatgaggaagagagttagagaggatagatttgaggagagggggagagatttgatctgggtaagttgtaattgtggaggagaggataagtgatagggattatatactatgtgttcaattttagtctcgggactaaagattatattgatctttagtcccggttggtaataccaatcatgactaaagcggtaatctttagtcccggttattgaccccaatcgggactaaagatccttgcccccctgacatacatctgataggggttagtcaaccgggactaaagatcaaaatttttataaccgggactaaaaacaatctttagtcccggttctttttggaaccgggactatcgtggattttgccagaccgaccaaagatggtttctccaccagtgcttcttcctcgaatatgagctcatcaagatcagagatagcgctagatccctcttgtcagcctccgcaggcaccacacggggtctgtcaagacttatccctgatgttgatgtctggcgacgtgtgttggcttgtgtattgtgtgtcaatctgttgttgtgtcctctttcccccctagggtgtcttgtaagttacacgcgacttatccgatccggttacacggagtggagatcgtgcaggcgtccggatcaagcatcatgatatctatatataagttgagccgccgcctctacgcaacatacgtgaaatcaatctagggtttgccacctcctctatactgcgccgtcgctcgtagtctactccatcccactcgtcgatgtgcaccggcgatcgggtgagcagatctccagaaccttcgtcttcgacgtcctgcaccgggagaaggcggcaataaggattttgggaagcgcttcgcgcgattgccccctatttgaccacaacagctcatcttcctcctcgctcgcgtgctacgtgccatcgtcaacgcccgcaaccgcgagtacttcctgctgagcaaccggtctttcggtaccaacgctacgtattcagcatattgtgcatatttgatctgttcatgctttactgtctagtatacatgtgtagatcttacgatgtgtttacactagtttacatttgcaatatcatgatttatttatggaataaattaaatcattatgtgcttttaaattcaacaattcatagggattgtactaattccaacaaaattatgtataattcctgcattctaatgagatcttaccttagctagctttgtaccttagttcaaaattaattgtgctaatttacctccttctctccttccaagttataactattttttctttttgccttggcctgtctcaattcagctccggagaactagcatatggctgtaggttatcaatagttcagctctggacgtctctcctatgcataaaactaggtgattccccgcactttgctacgggaattactaagcaactttcaatacttgagggtttttcagtacttatcataatacttgaggttttttcaatacttatcataaaacaaacaaatgatacgcgtgatttaatgtagaacatattgataagtatgtgctgcgcccactccctctctctcctgcccacgcccgcgttcgagatggccgggattcaatttttgaatcccgcctctctctccacctccacctccccacgtcggccgccgaaatcgggccactcttggccacgtcgaaaccccttttcccctatttaagcaccaccgccactacctctctctttttccccatttcaccgagctcccctgtgccctctttcgctctagcagcgtgcacccaccgccgccgccacttttccgctctccggccgccgctagccatcgcaagccgccacgccaaacctcgccgtcgacaccaccgcattcgccatcgcgtgaagcaccctggccatcgcccgatcgtcgccgtccgtcgccggaaccccgtccgtcccatgcgccggtgagttcggccatggccacccccttcggccggcgttcctaccctcgatgatctctctctccctctctaacttcccccattttgttccttaggtcctctcgaagcccgtccgactctcgccgtctgcaaccgccgtccgtcgcgccgttcgccgtcggtgaggaactcccctcccatccctttctctctcccatactgccaccgccgttattgccgcaccgcctcgcttcggggccgtgccgccgtgcgccgccgcgctaccgccgttcgccgcatcgccgccgccgtctgccggtcgccactttcaactactgtttataaatgctccctttatgcaaatgtaccgctctagctatcctttggttatatcctgcatcataccccctattacggtatgacttgctgagtacggtggttatacttagtcttgctctacttttccccaaccccagagtttgagtatgcgtcagatggtggctattccgaggagtaggcatcgtccgtgccgtcgaggatgcctgtggagtggtgttcccactgcaatccaagtcaaggcttagctccagttatcttttatttttccactgcatttatgtaagacttttataatgtttttaagacgtggatctgtatgtcaactttgtcttttgtgtaccctagccagtcctggacaggggttttaatgcacattctgcttgaaattctattcgggaatttctgggcgtgacagatctccagaaagaaatttctgggttcgagaaaaataggttttgggaagacatttctggtgctccaatttgcaagaaatctaggatgaatgatgtccataatcctatacttaggctaatgcacaaatggattgctatgactttgtttcctagaggtgatctgagacccattaggggagatgaattaattatcatgtttgccatggttagaaagatcaaaattgctcctgtgaaatgtatgataaggcaatggttagaaagtataaagttctctgctcctgttgagtgcacttctctgattactcggatagcaaaagggctaggggtcgttagcaaccaaattgcttttatctcagccgctcgtccacgtattgatgaggcttatctagtgcaagggcatattctgaaacatggagtagatggatctttgatatacttttttcccggttgt

SEQ ID NO: 67841 - DNA, 2663 bp, Oryza sativa
atcgccgcgccacccgccgggtgcactctcccgcatcaccgccgccgcacggctacctctctcagtcgcaacgcgccaccagccgcattgtgcccgacccacgtcgacgaactgcaccggggtgaagggaaaggccaggggagggagagataagggagagagagagctacacactaacatgtgggtcccaccacgctgagtcagcttgtcaactgggttaacaacgccacgtcggacgaaaccgccagcaaaaccaccgagggaggtgatttgctctagttttcagagatgaaggaggcgttatacccggttttccggttgagagatgttattcacggaagcgcaagagatgagggaggcaaaatggacttattccgggccaaaaagaccggttgtttggacagatcaggggcatttaagtgaggaacatacagaactactgggtgcagtaatccaaactcctgaagccaaataaatcagatggatcatatatatatacgagttaatttgtgaattgagagcatttgattaattcagtcagagaagccagccttgaattaattctttgagagagagatagaaggggcttatatgctgttggagaaattgaccgcgacgacgcacacatgaggggtatttgccgcatcagattttagtatagttaaaggagcaacataagatgaagtcttctcagagatgaaatagtttgagcgagtaaaactgattccttttaatttcttaataacccaaaacttggaagccaatcaaatgaatcatcgtgtggttttatcttgactcgagacttgagaggataattgatggatgctttcgtcagtttccaacacccaactttgaagtgcaatcgcctacatgtatttgactatctgtacttctgaatccataaaatgtacgtcataggatttgcccaaatgctgtacgtatataggagtatatgatagcgagtgatttctgactgcaaatgctgctgttggagattgaccgtgatggatgagcagaagctactcctgcttgttcaagtcttcggctgatgaatcccggccctgactgaaccagacgtcagatgaatatatagatgatgaggtgcagacttgactggaacagcttgacatctccgtctctgagactgagaggtatatactccatctgaatatctctcgatctgtggaattggtccatgttgttggattttcgtctgttgtttctgccgcctccaactctgtcaatttcgtggatccatattgtcgcatgcagtttgacctctacaatgttggttactcgaggacgtcaattttctggggccagtagtcgagcaagttttcagtagtacacgcttggtcgttatatccgttcgaattaatagatgagataaggtttatttggagattaattttttggaaaaacacacaagtctatcttatggaagacatatgtatgagatgcttagaatcaccttgtccatcctaggaaagaatgatctccttaaaaaaagagtgatctcctagctagtcacttgagacatgcgtaacggagaaaactagaaagaataattcggtgtgcgaagtctgaagcattgcccacagatttctaatagaaggaactcaaatcatatatacatatacaaatcatccccactaccagaaattctctgcttcttggtgcttcccacgtcattagtttttccaaaaccgttcgatcgacaatgcatcccgcatccgcgccgtcccacatctcgctcgccggtcccactgcatcgctccccaccgcatcatcaagtatgtcttacccaacaaatttgtggttgcatggttatccgaagcaaatgcctatagatttttaacagaatgaactcggactcctcaagtgtatcttacttgataaatttagctgcttgcattattgcgaaagtacctttttcatgaaaaagtttcagtactacactaaaatacaagagacagttaagggaacttgaattcacttgacaaatttgtggctgcttgcattattgcgaaacttatctttttcatggaaagtttcggtactgcactcaaacacaagagacagttaagaaaactagtacttctcaattgtgtcttacctaacaaatcagcttcggttgtgcactctaacacaagagacagttgagggaactcaaactccaaactcctcaagtgtgtcttacctaataaatttgtggccgcgtgtattattgcaaaactacctttttccagaaaacataagacttattcggagcattgcctatagagtcaggacacttatcgggagcatattgcttataattttttaatagaaggaactcaaactccccaagtgtgttttactcaacaattttgtggctgcatgcattattgtgaaactaccttcttcatggagaaattttagtataatgtctcaaacacaagagataggagacaggagtactccattgagtggttgatacttgatagtataatgtctcttaatgttgaggagaaagcttaaggaaaagacgttgtgtctaagggcgatggtaggtagtctagtgctaatgtgatgcacaaagcccaaaacaagaacaaagaaaaattcttcaaagttcaacagaccactgacttcaagaaaaagaagaagaagaacaatccgaa

SEQ ID NO: 67842 - DNA, 1112 bp, Oryza sativa
  unsure (1)..(1112): unsure at all n locations
gcttaattagttatctctcctatgcatccaagcttgaagaggacaagggaaaaagatgtctaatttcagatcgtctctccagcaacacgtacgggaccatgataatgtatgggtttccgtttggaccatcatcgatcgccgcggctcaccggcgtgcacagtgggagccgccggctggaccatggttcacatatatagcaaggggccatttggacgcatctccctgtttaactggtttgattagtcatgccagacaaggtttgccttattaaaccctttcattggttgacagagctcacattatttaattttcttaaagaaatggtcacacccctggctaaaaagaattgttcaggtaatccatcaggtgctttgttttcctaattattcgcaaatttatatacaacatgttgtaatataatctactctagaatttttttatcacaatagctaggtatatggtccagttgaactatgcaatcagctttaacttgatatttttttacataataagtagtaattagagtttttttaacatttgggatattaaaaaagtcccaggtatccctgcggcaggccctnaaagggtaatntgaaatacacgttggtgaggcttcttttggtaaattcttggtgcacacagcagccatgcaagcatatataancttgtcagcattgcacttngcgtccctctngacttncannnnnnnnnnnnnncagagctcatcccgacgttggagggaacccttttttttaattattttcctatctttttatttgtttcagccgtgctgcactggaaaaggtccctggaatcgccgcaactttacaggttttttttttcctctcttctgtgcggttacactaatataataaaatgaaaagagatagagagataaaaaaacaataatatacgcaacagatcaaaagaaactagcacatcatgatgtcgctatcaggcggcatattaagctattaataatttagttttgcatacttgtgccgcttccaaacgcttctctttgttcttatcatttgagctgcgacccaatcattttaacatcaccttttcttgcactaggaaggatgccctttttctctttaccggtttg

SEQ ID NO: 67843 - DNA, 4056 bp, Oryza sativa
taaaatttgtcaggagaaaactaggaggagagaaggaggggttgataaaaaagtgattgtgacctatgggacccactaaaaatagtctgcacagggattttgtactgtgagttttgtgacttgtgaagttcctcatcctacctagcagcccaggaccagcaaaattgcccggcgtattgtaaacgccctaagagcaaggataagagtgagctataaacttacatggaggagagaggtaacaaaaaaaaattaaggatattggctctcacggaagagctagcttaacataagctccaagacaaatataataaatgtacacgtgagagatagctagagagaggagaagaaaattgtagccaatcttatagctaatctattatatatgttggcttaagatgggctaatagtaggaagtgagctctaatattattctcgctctaagtaaaataaaaaaattgaacaaacatctatctagattcgttttaaaaagttgatttttttctaggacgaaatgagtactactcatatttctgaatatgcaacgtacatctttcattaaaaaaactactcataaatattgttgagtttttcaaaagaagttgtttttcagattaaatatgtaagagcatcatcaacagtctagctattacatccccaatcctatatttttgggattttggttaaaaaaactggtccaacagattcccaaaagagctcttgatgttttaaagttcccatctccaattttctcggtacgtgtatttgagggcgagagaacgactcccaatcccctccttccgcgtgtttctcccctccttccgcgtttctcctctccttcccccgtcggggcgatctccttctgcgcacgggaaaagaaaaaaactagaatttctattggtagtttaacagaagggcccacttttagtttttgggattgaatttaggctatctcttggaggaaggggttttttcaacacctattttcagtttaggaatcccaaaaattaaattttggcgatagattattagtagactgttggtgatgcgctaaacatgtgcttggttgtttggtttagaaataaaacaggatgagttagactcatctattcatttggtataaggtatcgggttggtgctaatttttaaagcatgtcctacatgtcaccgagagagaagtggattggataggtccactagtttaaaaggcaagactaacccagatcttatagaatatgtcatgtcagggtccatcccatcctatccatatccaaacgaaacaccctcaacctaacccatctcatcccttaaaccaagcaacccacactagtagtacacccctactgccgatgaggagctattgttggcttgttatatgcgtatttcatcggtcggatatcagatcactcatcgatggtagcagatagtagctgggggtttccaattcatgagtatagtgggaaggattggattgaaggttgtgttgttgtggttgttattattgttattattattattattattattattattattattattattattattattattattattattatttgacaattcaggtcccgttctttctagtcttttttaagtttgaccaaatctatagaaaaatatagtagtgtttttaacacaaaacaaatatattattaaaatatattcaatgtaagatttaataaaactaatttgatattttatatgttactaaatttttctatagatatagtcaaacttaacaaagtttgattagaagaaaagtcaaacaatttatgtaatatgtaatggagggaataccagaaaaatacgatttctaaaaaacaaaaactttgattgcattgtgtaggtcacttgttcaaggtttttgtgaattttatttctcaaaatactaatgtattgttacgttaatcaattaaacaatcaacctcaacaattccagcaaatttttgtttcaaataggtactccctccagttttataataattgatgttttagacaagattgaggttaaacttttgtaactttgaccatcaataactttaaaaatatttactttaaagaaactagaacaacatatatagatttgtatttcaaaacactataataaaaataaacatgcatttatttattgtatatattataatagaaaataaagtcaaatgtatattttgtagaccgtgtcattgtccaaaacgccaattaaaatgaaaccggagggagtagtgctgtagacttttagtgacctcctttatatgaattcattcatgcacacccaacccaatacaacaaattgtcaaattattatttattaaattacttcctttgttttatctttatgttggacgtaataaaaaaaaagaggagggactacattggagttatattttctacatcttttcaaagaggactaacgtaactatttgtacttggttcgatcgtagtggtcacacatgaattttcaagaaaaaaatcattaaataattaagaaatgcacaatcctaattataaaccctcattactaccaaggttaatcaagcacttcaatcaaatcaaacacaagatttttttagataacgagtcatcgagattagggatgaaaacggtcggaaacggtcggaaaaaccctctaccatttccattttcattttattttctcgaaaatggaatcggaacggtatactcggaaacggtaacgatatcggttatatcggtatctcggaaacggaaccgtcggaacgggaatataccgatatcggacggaagtcgaaaattcatgtcggaaacagcgaactgtggtatcatcccgcatttaactatgtatgaagatgaccttataatttcacccttgcatcattacgctgccacacaacaccgttatatgatgattaataagttgacaataagattgataaataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatgttgacactgtataactactgttgtaattaagtttcatgctaaactagactttttggtatttccaggtcgatcacagagaggagtcaagatggtggggcccgccagtggatcccacagtctttcttttcctctctttcttttattttttctctctctcttatccttcccttctctcggttcctttttctgctctctcgatttcttctctgttttctctctcgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggcgcttggctcggtggcacggaagccggcggtggagcatgggggagggaaggtggccggctgcgacggaggccgtcggggcgaaggaggttgcggccggcgtcggcgacctggtggcggcgcccaacatggcgcggcggtgccccagcgccgatgaagacgatgatgcggtcaggcctagttggcttctttattcggaatgggctgctccttaatgcctaatgggctcctcctcctgctagccaggcccagccgacttccttcttcggaattttgtcggaaatttgacggaaattaccgataaaaaacggttaccgacaaaacggtcggaaaaaaccccatatcatttccgctaccatttccgaaagagattaccgtttccatttctgataccgacaattaccgataccgattgaaacggtcggtgcaaaccggaaacggtagccggaattctcggaaatttccgtaccgttttcacccctaatcgagatccacatga

SEQ ID NO: 67844 - DNA, 3397 bp, Oryza sativa
tcaaattcgttgtattaggagaaaaagttatattttcttttaagttattttttgttttgggaccgagggagtagagctagagctacgaagggcagcaaggtgaacgagcgcgcgccctgcaacctccacgttctcccataatttaaacaggaggcatcaatcccacagctccattctttttaaccttttatggcagacacatcaccccacacttcaaccgtttttatacggatccccagccacagccaagccagcctgaccccaaaactaattttgtatgcttgccaaaggatcagccatactcactatagctaggcaaccccccccccccccctgctggctctaactccgaggcatccaagcctaaaactacagtggtagggtatctcacgtactaggagcacaattttaattacaggactagtgctactgggagtagtatacagtagcatagtgtgtataaaagtgtggtttaagtagcaagaatttgtgcaagtgataattaatcaagtgtcactttgtagcacatgctctcttagctagcactcgaagttgtcatgatagggcgatctacacaagatccttctactagttgattttgtgctggcaatttaagttgatcaagatcataccgaattttatcttttgatctacctaaatttttgcaggcattttttttatttacatgcatgcatgcatatgacaacataccgtgacatctagcttggatgctacctagttattttaatgagtttacctcggttataatttgataattacttgctttaaattttataccctatatatcaagccttccttgtgctatactaatctttggcatgtgagggctatctccccatgcttatactaatcgtggcatagcaatttatattaatatttgaaagatcgagatcgatccttatgggatctaaaactaaaaagtttacaataaattaagcattggatcctagagtataaccagagctgcacatgtaatttaaatcgttgcatctgcctctaatccttcttttctctaaaaataaataaagtagacaaagagcatcacacttatttagaaagaatgctggtataagaatagcaagaatgtaacatataatatgtcgcgagtatacactgtaaaacttcggtaacaacagtttgggaaaggaagaaaaaaaaactcaggtaatacataatggacagtttaggtaattagaaaaaacaaaacaaaacatataaaagaaggagagaaaagagaaaaaaaagagaaatgggaaaaattccggcatacaccagcaccagctctcttgctttttcactgccacttcacttgatgagcacatctttaatttttcaccttcgatttttttttcaccgcgcccttgcaacatgccacagtagatcgagcagtagtacacatagccaaacaaatttttaccgaggtgtaataatttgtaacaaccacaaccaccgcaacattttgcatatatacccttgtcttcctttttttttaaccgcgagagcgaggtgttattaccgctcctctgtgccgtttttcaccgcaccaagttttaaaccctctccgtgaaccctcacgaatggagggtccttattaaatttaccacaacaaatcaataaattaccacgccaccaattcctttttttttgcttttaacactagctaagaggagacgcgagatgggagagaccactgtaattaacacaagaacgaatcaagaaatggatcgatgctactagctttttcttgctaggaacatccagcgacgaacgatcgatgggcatgcatgcagcttgaaatgggcgaatttttctttcttggcatggagatgtatagctgctagcttgcatgaggaatcaatggagaaatatgccggaggaggaagagaattcttgaggttttaggtttttgagctttttgatggtgttgagatatggacgagccatggaggaggcgacaggtaggtagatacaaatggtacaagagatggaggaggaagaagaagaagaagccattgacgcgcatggaggtatgcatgtgtaggaaggagagagagtcaccggatggatggatggatcactggaccattgccaagaaagatccggtggtcgtcgttgcggccgccgccgtggcgggggcggcggtgccgggcgggttgccgccggcggccgcggaggcggcggcgttcggtctgacgacgctctgctggtggcggtgctgcggcggctgctggtggtggtgctgatgctggaactggatctcgtactgcatcttgttgccgtcgacgtcgtcgtcgtcgtcgtcgtcatcgtcgtcgtagtcatcctcgtcgtcctcgtccatgttgtcgctgtccacgccgccgccgccaccgccgccgtccgttcggttgaaggcgttgttcgccgccgccggctgctgcggcctctgctccatcatctccttcataatgtcctctggctttaaatgcgcagcgttacgcaatcagcattggatcaccaaaaacgaacagcagcgtaccacatgtgtacgcgccaattcgctacggccacacggggaaatgcacacggatggatgcacgtagcttagcttaccttcttcgccgccgcgccggtgaagaacttgttgccggcgacgacgctgccgttgctcgcctgcatttgcatgcccccggagccgcctcctcctccttcgccgttcgcgccgtttgtactgctggtgccgttgccgttcttggtcgtcgtcacgggctgtggcggcggcggcggcggtgtctgcgagatcggcgcggcgactgtcaccgccggctccgcgtgctccggcggcgggagggccggtgcggcggcggcggcggaggaggaggaggagttgagagccgccttgttgcggtagagggcgtcgagctggtggaagtaggggcaggtcttggagtcctcggggcgcttcttgttgctctccttgaccttcttgaagtacttgttgatgttctcccacttctcaaaacacctcttggagctccggctgtagcccagccgccgcatgccggcggagatctcctcccacagcgggcccttcggcccggcctcctggtaccggttgtccaggttgctccgcagctggatcagcgcgtgcacctccgccttgggccaccgcgacgacgacggctgccccccgccgccgccggacccgtcgtaccccgcgtcgtgcgcctcggcggccgtcatgacaatgtccatgctgctttgcgtctgcggcgtcgccggcaatggcgacttggtggcctgcggcgatggctgggatgctgctgctgctgctgctgctggtggcggcggcggcggagctggcgcgacggaggtgatgggggtggggtgagacggc

SEQ ID NO: 67845 - DNA, 2784 bp, Oryza sativa
  unsure (1)..(2784): unsure at all n locations
agctcatcacgttccccatcaccaccgcgggcggcggctcggcgggggcgcgcaccccgccggacacccccacagctgtcgccggcggcggggccagcgacgtcaccggcgatggcgctgccacgacgccggcggcggtgccgtgcagcgcctcgagctgcgtgaagaagcggtacgtcttgccgtcgttgcgccccgcgcggctctccttggtgcgcttgtaatacttgtgcacgttctcgaacttctccttgcacttcttcgcgctcctccggtaaccctcctccgccagcttcctgcacccaacccaccaccacgccgccattaaaaacaacacgaagaagaagaagcttaagctcgagctcgtcaatggcgagccaaaatttgaaggaaattaagctgtaaccctcacaggaaagttgcatgcatggagtagaattttactcgatttgggcacccatcggaaaagataaagaaaggaaggtgtgtgcatacatgcagcaatagctagctaaactaggatgaatcaaatcccaagaagagactagagagaatgctgcagggggggagtaaaaattccatctttttttcttctcctgtgcttgtgcaaaagaatgcatttttatggccaattctgcttgcaaaattggaattgatgcctttcggatctgaagcgtatgggcgtgtgttgtattgtaccaccatcttgataagagatggccatgaaaaaaaaattctttggaaaggtgaggaaggagagtgatacccgtattattttaaaatggaaaaaaagtcactgtgctcgtgaacgatggttaagggaaaaaaagtgaaaaggaggtgtttattttagccggtaattaattaactgagcctaaccaaaaatcacaccaggctactgcttctggaggccgccgagatttcatgcagcatttcgccgacgagaattcagccatggcggcgagatcgacggcggagcaattcttgaggggggctcatggcgttgaattttttacctggagacctcctcccagagcgggcccttgagggtggcgtcccggaacgcggcgtccatgtccgaccggatcttgagcagcgccagcgtctcctgccgcggccaccggttcccccccgcgccggccgcttggcttttcccccccccccttttccccccttttttcccgcgaccgcgncgcgcagcgcctgggtaaacccacctcgctccgcctccgccgcctacgccgagctcgtcgaactgctgctgcgccggcggcggccggctgctgatgggcgacgcggcctccgccatggagatccgccccccgccgcctcctcccgccggcgagaatggcgacatctccggcgccaccgcgccgaactgctgcacccctccccctcctccccctggctgctgctgctgcatgctactacctcctcctcctcctcctcccccacgagtgttaccactggggaatggaggtgatggaatgatcagtacatcaggagagctagtagaggtgaaaaggatggcaggagagagaaaacccaaaaaaaaaagaagatgaggaagaagaagaagcacaagaaagggaggaaacaaggaaacaccagtacaggaagaagcctggcaaaaataaaaattatactcctgcaacagcaagggagagagagaggaggaggaagaagaggaggcagagaggaaaaaagaattaagataccatcacttagccttgaataaataatagggtggatggatgagagagaaacagccagcagcagcagcagcaagcaggaggagaatatgatagctgtgaagagagaaaggaagaagaagaagaagaagtgaaagttgagaaatgttgagtagagtacaacaaagagaggaggaggagagagaaagatgaagaaagagagtttgtgttgttgtgggtgcttgcaagaagaggagatgatgatgatgatgagggagatgatgtgggagataaaacaaacaagatgctgcgctgtcaggggagggagctttgagctttacctcccctcctaaccacctgcctaatgctagttaaaaccgaaaggacagagagagagagagagagagagagagagagagagagagacaaactggtgaagaagaaaggaggggtaggaaactgtgggatgagagagaaaggtggaggcttgtaataaaagggagaggagcacaaatacctctacaaaaactcctctacctcaatccccatgggggaatatattggattctgtgattcatgatctactgtactaagctggaggagtatttttcacactggaaatttagtcataaattatcctcaaaattaccctttttattttacctcaccatttctactctcatcaataccttttcttttgagatgaaaaatataaaattcatctgagttagaagccattggttgcactggtgaccagtactaaacccagggccattggaggatccaaggggcagcagaaaaacaattacaccaagattggttttactactttgcagcagcatcagcaacaggcaaaaaaatcattacaaaggcaaaattaaatccccaaaaaaccaaaaaaaaaagtttacatgtgggaacaaaattagttaggagaattggagaaaaacaaaaaaataataattaaaggagtagtagtaggagtgagaggaggaggcagacaagaccacattataacagctgtaatgtgggcccttccggagagcgaaagaggtgcagaacgtgcccggcgataacgcggaccccccccccc

SEQ ID NO: 67846 - DNA, 1876 bp, Oryza sativa
agattttatattcagataataaaattgtggaatgtctaaatacttttatttggttcgttcctcccccagatatcttccttttggtcatgatgcatgtcttgaagcaattaattatttatgggagcacaataagtttttagaaattttatgcgaaattttggtaaatttcattattatttttttctaccgaagctcatccgcatgttgcacaggcatggacactccttgctcccttgctatcacatttctatcacgtactccgtacgaacgttccaaaatatattatctatattaacggtcagacatgcttatatttgaaaaaattagagtagctatttttttctaatagtaaaataatggctagtctttaaatttggagtagagtactatctacatttatggattttaaaatgcacatctatgtctttaattttgatttaatgtatcactcagctcaaagtacagataacacaaacttagaaactaatttggccatccagtggaaattttacattcagcccctccagtacaatattcccctcccaaatcaactcccaccatgccagtgggagaggaggcgaagaaatggtaacgaggatagctgcgactgtcattggtggatagtccctagaaccgagaaaaaccacgtcacatagagagggttaatattgtaagttcagtgtggtgttattttcgccgtaatcctcgtgcaatatgatgttccattgtttgccttcacggcgacgatcacacgtgcatggctcgtgggacataattcctaattggcgcatatgcgtcgccgacgtgtacttccggcccacaagacccacgcgtatgcgcggcaccgcgcgtcggcgcggttagatttttttcgggattttttccatagcgcgtctagtaactaatccgttagttttagcatgtaaaaaaatccattagttttagataatgaagataagatttttttttaagtaacagattgaaaagaaatttatgcgtgaagtcaaattcgtgaaaactttcaacacaaatttgaaaactttcaacccaaatttgaaaactttcaacttgaaatttgaatttttaaaagtcaaattttgaaaactttcaacttttcatctcaaatttgataaacttcagcccaaatttgaaaactttcaagtcaaatttaaaaactttcaacccagatttgaaaactttcaagtcaaatttaaaactttcagacccaaatttgaaaactttcaacctagatttgaaaactttcaagtcaaatttaaaaactttcaactcaaaaatttgaaaacattcaactcgaatataaaaactttcaacccacaaaattgaaaactttcaagtcaaaattaaatactttcaactctacatttgtaaagaggtgtctgaagaattaaaaaacaatagaaagaaaccaaaaaaaggaaaaacgtgcccggatctgggcactaaaatcgtaaaaaggaatgtgagaaagaaaagcacgctgaaaccggggagggggccaactgccgtgtgcgccagctaaatttgctggcgcgtacgcgcattagccttcccccctcgtgggatcaccctttcactatggtgccatcttacctcggttttcggggacctcctatctccgacaatagatgccactctaatcgtcatctcttcgccacctctcccacatgtgtgttaggagtcaacttgggagtgatgaaagccggattttgggacatattgtattgaataggtgtaaatacaaaattctcgttattgtggacaaccatgtcagcacccgagctacattgtttgtactttatacatctcgtgatacattaaaccaagattttagtccttatattttataagtgcatga

SEQ ID NO: 67847 - DNA, 11995 bp, Oryza sativa
cggcgacagccactctggcgccccaaaaaggaccatttttgggataagtttttctaagggtctacttgcgaaataagtttttcaaaaggaccaaaatgtgaaaaatccagaagctcaaacacccaaatggaggaaccacactcacctgcacagccgggccgccacgtggcggaatcttcgcctgccgccctcttcgccgacagaatcccgcgggccccacacaccacacgcgcttcaattcgatcggccgtcggccaacccaccaaacggtaggaaaaaaaaagaaaaagacgcaggaaaatatcccgcacatgctgggcggccgcgagaggacggttggaggtgggccccaccggacagttgggcagttgggagttttttggttgagctgatcctgcatacctgctgcctacacaacacatcagccggtgtgtagttcatttgacaccttggaaaatgacgtggttgatcatgttagcggaacacttgggtggttaagtgggcaaaaatcaccctgctatcatggacttgttagggaagatctttctggaaacatgtatcatcgacgcacgtactcctgattgattagagaagggtcgtggtcgatctatagtgtcgttttatagtacgtgtgttcgctacgtataatgtacagtaatgcttattgatgtcgtgtcaatggtgtacacttcatgataatgaagttgtccattctaacatcccatgagttataggaggttcgtcggcatagtattaaatcattcgttgttataattggtaaaagatgccatattattaattaggtttaacgatagctactttaggcccctttaaattgtttgaaagtcttatagaatttcattcctacaaagaaaaaaaaattactactaacgcttttcaaacaaaggattgaatcatatattttaatttctataaatagatgataattaagagattttttttagaaaagttacctagagttccaagttctaacctcttcgaaaatttcttgagtctaactctcttatctaatttctgtgttttttattaaatattcaaatgattgtttctgtattttctcatgttttgtaataaactattttgcagttgtattcccgttaaaattatatgtttttctttgctatacttttgtgttattcaatcatgtgttttaacggagccttaggctctgtccgtttgcctgggttgggaacccatccctccagcacagaaaaagaagcagtccattagtacgtgattaattaattatttatttttttttcaaaaatggatcaatatgattttttaagcaactttcaaatataaactttttgcaaaaaacgcaccgtttagcagtttgaaaagcgtgcgcgtggaaaacgagaaggggggagttgggaaccttgacataagaacagagtattattatgagtaggtgatgggtacgtggatttcaattgaaaaatctctccagatcagtatcatgcgatggatcaaagagtgaagcaatatattgactcaaatgcaccggaaggctacgcaacacgatgtgagaactttttttttatcaaagacctggcttggtttctttaagaggaattgatgatcaggtttaattatcaagtccagtagtagtaattaattaattaattagctagagatttttgatcaaggtgttttatctcattaagctaggtccagaatgccgtgcctagctgatgtcttttgaccacgtaaaacaaaggccctcgtcaagaaaggaagccgtacgtaccctctatagattccctcgtcaagaaacagaggccctcgatcgtcaacattattacagggtttcttaatttaattcatatatttcccaaataccctaatctaaattttatagatgtaggtatcgtgaaggtatcacgaggtgtttttcttttttaatttctgatttatttggggtactttttaatgatttgtttctttttcatttgaaattctccgagattttccatgaatctctgtgatatattggtgataacgcttggatgatactatatattcactcattgtactggatgatatatatacctctatatgatatttcgaagagtcatggagatacaatacgcaaggcagaatcattgagttttattctataattataaaggtaatactaaaattttatagagatatacagtaccataaatattcgaggtatcatagatatcttgatttttttttataaaaaattcttccacggaagaagcatggtatcttgagtactagtgtagtatcactgggtcattgtataatcatacaaagataacagtacaatttgatagagatatagagatataatgatacttgataaaatattttaagtatcataaattcgtaatacctcgaggtattgtgctctctcatatccctttttgttttgtcagatctggccaggaatgcaagcattatagaggaatgcaagcattatagaggaccaaattttgtaagaactacactaattcttataaaattcccgtgaacttgaaaaaaaaattcatgtgtgtcaatgagccttaggacttctgtaccatatgagttttagtattttacagataccaattcaattctcaaaatattcctccaaaatacccccgatcaaagcaatcttttaatttgcaactacattaggggtaaatctgcaattaaccaacttgaaaaattcttggctcaaatttgtcgtccaaaagagttcgctatgaaaatgactgaatgttttatttttccgtgactgatgttaacctttgccttggaagtaggggactctctctctttcttgttaacttgaaccagctgctttgaaatggaatcaatcaaatttaaatcgagggttttctttccccaagtcttagggacgaagaatgcacggcaccatcggtggtgttgccctttccacctcaaaagctttttgctttcttcacgcgccggcctgcgatcatagccgctgctatctgtccttcttcgtgactgcactactgctgctgcagtccgtgtagatttgggacagaaagaaaaggaaaagggcagtgaaacctttttcctctttatttatttgaaatttgatgaaattgggacgaatcctttttgtgtttccgtgattagtttaatttagttttccaactatgaacttggtaggtgtgcatgtgttaattgtgtgttcaatttgtagtaagtaattttgcatgccgacagcctgaaaaatgtttttctttttttttcttttgaatggtactagtatgggttcgacagatatatcacatcagttcaggtatggcaaccggtgccaacgctgactactacgaccaaaaattatgctggtgtttagttctagggtgtaaagtttcagagtatcacatcgggtattatatagagtgtcgtataggttgttcgtatagggtgttcgggcactaacaaaaaaactaattacagaatccgttagtaaactgtgagacgaatttattaagcctaattaatccgttattagcagtgtttattgtagcactacattgtctaatcatggagcaattaggcttaaaaaattcatcttgcaaattagccgcaatatgtacaattagttgttttttagcccatatttaatactttatgtaggtgttcaaacgttcgatatgacaggctgtaaagttttgggatgggatctaattaatccataattaattagtgacatgtcttataccctgtttagatgcatagactaaattttagtccctgtcacatcggatgtttggacactaattagaaatattaaacgtagacaaatgacaaaacctattctataaccctggactaattcgcgagacgaatctattgagcctaattaatccatgattagcctatgtgatgctacagtaaacaagtgctaattatagactaattaggcttaaaaaatttatcagacgaattagctcttatttatacaattagttttattattagtctatatttaatacttctaattagtgtccaatcatccgatgtgacagggactaaaatttaaaacctgtattcaaacaccacctaacacaggcctaagttactattagcacactaactacaaactgacaaaacagtgaggtttttcaagtgttgacagagatttcttcctgctaccggttcaaattcaaacaagacaagtgccagctgaagaaagggagaaaaccttggtccttgttgtagcgccgtatcacattcacatctaccaggacaaaaggcagtacatggaaaacgaagatgaagacccgcataggagccatcgaaacgaatacgatggttacagaaaagcaatcaaaatccaaacctgcctactgatcactcggcgtcatttatttttttaaaaaaaatacagagacagtaattgtctgtttggttggcaaccgaatttgacacacctaatcatcattttagtagagaatgtatatggttcccgccacaactctacaggtgtccaaacgggcggcacggcccggcccggcacgggcacgggtctggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccacgggcctgcagtgcacagtgttttttttttaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttgaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaaaaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgttacatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggcaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgctgcccgccctgtcagtgcgccgctcgggccgccggcgtgtcgtgccgcgggccgtgccgtgctggcccgctacagtagccgtgccgtgccgtgccggcccgcgggctcggccagcggcccaggcacggcacggctactcgggccgtgccggcacggcccgttactgtagcaggccgtgccgggccgtgcctgctacaggttcggccgtgccccgggcggcccgtttggcccggcccatttggccacctctacacaactctactaactactacaaatgaacacagccatagtttgccaaaaagaatcacatcatagctaaataaatgttttatgtaatatatatcgagagaaaaaggaaatagggagaactccaattgccccgagagtggtgatctcacttaataggaatagccctatgtcaatatggtataagtgaactcaggataattttaaaccaaaacaaatacttatagaacctacgtggataaaataaaactgaaacgactaaattgaacttttggtgaaacttaaggaattagatctattcaccctaaaaaatcagctaaagaaatattttacgaaataatatatcaaacaataataataataataataataataataataataataatgaagaaaaaataaatatagggaggagaagtccaatccccaagagagcggcgaagaaagaagaaagagaaacacgggtgcacgcgctttcgcacccttcctttttaaaacgccactcccggccaacccggcctctccccatcctctccgtctcctctcctcccttccaccacgacgcgaccgacgcggcggagaaacccgcgaagccgcagtccagccagcgaggggccgccagccgaagctgaagcgagagctagggtttgctccaccccttgaacccgcccgcgcccccgccgccacgaggccgatcgaggtgcgtgccaccgtaatctccgcgcgtgtttgtcgtggggttgggttgggttgggtggggtggggtttggtgtggatcagggaatgcgggatctggtggggtttcgtgcctcgctcgctcggggatttcatttggtggggtggtggtgatcccatcctcccccactggattttgatggatgcgacccccttccgctgaaatcggagggattttggttgccatgcgctgctccttctgtccgtacggttcggtgaatcgggagttgtagattggtggtgatgatgacccagtagttggttctgatgctcaatactcgctgcgatttcgctcccctttatccaagggaagggaagggagaggggcttcctttgcgttcaaatttagcaaagtaggaattgtgtgagattggtggtagcgctcacttttttcagctctagatcgttagttctgcataccatgaagattcttgtatcaggagaagattattatatttattctgtggagaacgatatcagagatgatttgtgggggtgatttttggctgatttctgctctgcagggttctgcttctgaggctgtcaagcctggcggctaattgggatggaccttgtgggatcgctgctggtgaacatgactcacttggttgacacctcggggctccagttcttcggctggctcatcaccgccggctccttcggcctcgccgcgctcatctacgccctcctcaggctgcagagggcggcgtcgctgtactggatcaaggcggctgccagggagaagaaggcggcgtggaagtcgttgcggtgccccagctccggccacacctggaccgaggactacttccgcggcggccagccttcgacgtgctgcgtgtgcctgtcgtccctgaccacagctcagggtgtgggctctcggggtgccgatgccgttgtggtccaccgctgctcggtgtgtggggtggcggcccattctggctgctctcgtggcgccgagaaggactgcaagtgtgtttcacagcatggtgcttccaccttgcttcatcactggtcggagaggtgggtggagctggatgacaacccagagatgtcctctttctgttactactgcgatgagccatgtggtgtgccatttctcggcgtctctccaatatggcgctgcctgtggtgccagcggcagatccatgttgattgtcatgcaaagctgttaaaggagacggggaatacttgtgatctaggccttctcaggaggctcattgttcctcctctgtctgtgaaagaagttgcccaaggaccagcaattactggaatgctcaactcgatcaaggaaggtcttgtcacttcatcagttaggggcaggattaagaggcgaggcaacaagaaacgcatgaacaaccatcctggtggtaagacaagtccagtccccacaaacagctctatccttgattctgtgcttgaagggtttgctagactgcagaacttgaatggaaagtatgcgctggcaaaccataagtctagtggggattctgtcaagcaaacacatggatatgacagccctaatggagggaagaaaaagtatgaaatcattgatttgccacaagattcaaggccactgcttgttttcattaacggcaagagtggaggacgaaatggaccttctcttagaagaaggcttaacatgttgctaaatcctatccaggtaattttccttaattctttacttacgaaaatggtagcagctcattcttatcaactgctgagtcaattaaactgcttgctagtttctctagctttatatgcatgatacatctgctgaaaattgtagccagcagttttccttggttcattctacgatacttgctaattaataggcattttatacctatgtaggttctagattgatctatttgtcttttgatgttgccctcagagtgaagttgtactatttttgtcatttgcacactttattccgccaaccaaaatagtcactgagatctgacatcatcaaatgtttagttaatctactgttaactttagtattagccgtggttgattgtgacatatttgatactctattcttaacctggaaaatctcattcttgtttcagatatttgagcttagtgcttctcagggacctgaagttggattgcaatttttccacaatgtaaaacacttcagaatccttgtttgtggtggggatgggactgttgcatgggttcttgatgctattgaaaagcagaactatgaatctcctcctcctgtttccattcttccattaggaacaggaaatgacctatctcgtgttatgcgctggggtggaggtctgtcttctgttgaaggacaagggggaatatgtgcacttctaaatgatgttgaccacgcagcagttaccgtgcttgatcgctggaatgttgccatcaaagagaagaatggagcagaagatcaatgtaccaagcaagttaaatttatgactaattatataggtacgatgcatctctcaacttccatcatcttactcgatattatgatatatatctcacttcaaccagaagttgctgaatatgttattttatcatgtttggcctgtaggtgttggatgtgatgccaaggttgcatatgacttccacactacgagagagaaaaaccagataaattttgcagccaggtagggattgatttctacatatatttttctgcaaaatgatgtttctccatttggaacaagcaaaatccctgtagaaattgaaccttttatggaaacccctgaaatattgacctcccttagcatttgatcttatgctacctcctcttctatcacttttactagtcaaaataataataataattcaattttctactgagcagtttgtcaacaagctgatatatgctagagaaggcgctaaggatatcatggataggtcatgttctgatttaccatggcatgttagtcttgaagttgatggaaagaacgtcgaaattccagaggtaacatgctacgcatcttttatgtacctccacagtccacactctgatttatcatcggatgagcttcttatatatatgctatttctcatcaggacgcagaaggtgtgattgttctgaacattcctagctacatgggcggtgttgatctttggcaaaacgacaatgaacatgatgatgattttggtttgcaatccatgcatgacaaaatgcttgaggttgtctgtatatctgggacgtggcatctaggaaaactgcaggt

SEQ ID NO: 67848 - DNA, 2019 bp, Oryza sativa
tgtcctgttcgaattcagtacattttttagactcgcacttcctgtacatgctccccttttcttgttttgaatctctgtacatgcaaattgtactccactatttgaaaactaagcgtgtggtccagttgatccttctggatgaatcgaggacaaaaggccaaaattgagatcgcaaatactactaggaagtaattccatcgtttacaagaagtatcctagactaagggggtgtttggaaactagggactaaactttagtccctctcacaaaagtatagggactaaagtttagctcctctctcccaaacaccccctaaatactcgtagtgtggtatatatcatagttaagagatatatcactcgtatgtctactagccgaaaagtaagggctggtttggtttgagacctaaattaggcttaccaatatttgataatttcaatagtgtttagtgtctatttggtttgaagctaaattttgacatgcctaagaaaatatgtcatttcaataatgaacttaggctattttagcttcaatccaaacacaactttgccttaataaaattagtcatgccaaaacttactaaaatttgcactgacaaaatttggtaatgtctatttgaccacaaaccaaaccaaccctaaaacttccaatttaaaaaaccgtggttaaatcttattaaacattagtgcatgttttaattgacccttcttgataaatcgaggacgaatccgaaaatgagctcgtaattaagtaagaagcacaagaagcacctccgcccaaattaaacgttatggtatcaaattatcacggtcataagatctcgcatgcacgtctgccagtgtgaaaggaaacacctccaatttccgcaacaatagttaaacctaaatacaaaagattctgcacgcatacacgacttgccggtggaaaaggaacacacccaatttccgcaaccatggttaaacctaaataaaaggattcctcacgcaagcttgcaagtggaaaagcaaatacccctattttttgcaaccatggttaaatctaaacaaaacaagtttacaaggttaaccaaggtgaaggtgtaacctagagtcacagtcaccctctccatctctctctcctttttgagcccccagcacagcaatgatgccaccgggagacgagcaaaagaactaaactcaaggggatttcactgtcaaagtgtcaaagcacacggcagtgtcagcactgttaagtgcccagctttgcctaactgtctcctcacgcacacatgtggctctcccctcgccaagtcgcacgcgcgcgcgcgcggcttccttccacgccgcgcgcggaagtgctcggcgtttccgttccccgtcaggttgcagccatgcacgagaaagggacgcccgcggccgagctattggctgtttgctttctctcgttgtcacgacctgcttgaaacagattatccactgaattatgatagtaaataattaaatattttaataactgataacttaggataagtgatgttgtgcagtaaaaggattattcttttcttttagaaaaaaaggaatttttagagaaattagatgaatagcctgcgtcccaatagtgaattatctatatacaattataagttgcgatttctcccgttttcacgaccaaaactacaacagattattgaccaaattattatagcagattaactatacaattataaatataaattaaatatagtaagcggataacttataacaagcgatatgatataaacaattaaaaatgttctctatttttttagaagatgagtttttagagacgtgaaatgagtaacccgtaacaataactgtgaagtagccgaaaagaacggggtcgtggaggcgagacagagaggtgatgaaggggatggagagacgcacgcaggccacagggagggacagatcagagaagaggagaattacagatgctgactcttgacagtagtgacttggctggcacctggttacagagacgcgtccatgcaaacggctggtg

SEQ ID NO: 67849 - DNA, 1391 bp, Oryza sativa
atgcatatccaagtctcagaacttgtcatagtgtgtcacaacccctttaggatcctacgtgacgttgatgtggcatgccacacgaaatgacgtgtcatcattttgactaacaaatgggtctcgtttaagatttttcctttttctttttttcttatctttttttccctttctactgctttctctgtgacccgagcagaagaaagggaaaaaaaagaagaatgagaagaaaacgaagaagaaaaaaaaatggcacgtcacatccatgtggcatgccacatcatcgccacgtaggatactagaggtgatgtgtcaatttgggacctagatgatacactttgacaagttctgggacctgtatatatattttgagagtttagtgacctatacgacacaaccctacaagtttaaggaccgccaatgcactttactcttttatctataatataaaaaattataaaaatcaaataataaatagtacccgtacaatgcagataaaatttattattattgtttcttcatgtgtagatcgaatttagacttgcatatttgtatagcgtcttatattattatagtctatattatcaaattttatgatttttttatataactgtctaaagtaggtgtcatacatagcagtatggcaggtaagtgtagaaaataatttctaaccgtccgtccgttctcttcgtctccgatcgatcggccagagatctctataaattggcgccgagagtgagagctagccatgacaaacaaacacacactcagtagctcgtagtgttcgtacgtggtgagctactagctagctaagctccggttcaccatggacaacttgtacttgatcctcggtgcaatcctcgccgccgccgtcgtcccgttcattctgttccgcggcaatggcggcaagcgcggccgccgcctcccgcccggcccgccggcggtgccgttgctcggcagcgtcgtgctgctgaccaaggcgctgaccgacgtcgagccggagctgctcctccagaggctgatcgctcggtacggccccatcgtgtcgctgcgcatggggacgcgagtgtccgtcttcgtcgccgaccgccgcctcgcgcacgcggcgctcgtcgagggcggcgccgcgctggccgaccgccccggcgtgccggcgagcaggctcctcggcgagaacgacaacatcatcacgcgcgccgggtacgggcccgtgtggcgcctcctccgccgcaacctcgtctccgagacgctgcacccgtcgcgcgcccgcctgttcgcgccggcgcgctactgggtgcaccgcgtcatcgtcgacaagctggcggcgtccggccaggcaccccacgacgtcgtggacacgctccagtacgccatgttctgcctcctcgtgaata

SEQ ID NO: 67850 - DNA, 6190 bp, Oryza sativa
tacatggtccaataagcaggatgctaacagtaatagcaaggtccggcttgatcgtgctgtcgcaaatggcgagttctcgagatactttgaggactgcctggtggaaaatgtgataacaacatcctcagaccactacgccatctctattgacttgtcgagaaggaaccacggtcaaaggagaattcccattcagcagggattcaggtttgaggcggcttggttgcgggcggaggattacagggaggtggtagaaaattcttggaggatctcttctgctggatgcgtggggctgaggggagtttggagtgtcttgcaacaagtcgcagtgtctttgaaggactggagtaaggcttcctttgggtctgtgcgcaggaaaatcctcaagatggagaggaagctgaaatccctgcgacagtcaccagttaatgacgtggtgattcaggaagagaagttaattgagcaacaactctgtgaacttttcgagaaagaggagattatggcgcgtcagaggtcccgagtggattggctccgtgaaggggaccgcaacactgctttcttccatgccagggcatcggcgagaaggcggactaatagaatcaaggagctggttcgtgatgatggctctagatgtatttcccaagaagggatcaagcgcatggctgaagttttctatgagaatctgttttcctcggagccctgtgattcaatggaggaagtcttggatgctatcccaaataaagtaggcgactttatcaatggggaattgggcaaacagtacactaatgaggagatcaagacagcactgttccaaatgggatcaacaaaggctccggggccggatggattcccagctttgttctaccaaacacattggggtatcctagaggaacacatctgtaatgcggtgagaggtttcttgttaggagaggagatcccggaaggtctttgtgactcggttgttgtcctcattcccaaggtaaacaatgcgagtcacctctcaaaatttcgcccaatcagtttatgcaatgtcctgtacaagattgcttcaaaagttcttgcgaaccggctgaagccttttctcccagatattgtgtctgagttccaaagtgccttcgtgccgggtcgcctcatcactgacagtgccctagtggcatatgaatgtttgcataccatccgtaaacaacacaacaaaaatcctttttttgcactcaagattgatatgatgaaggcatatgatagagttgagtgggcttatctttcgggttgcttatcgaaacttggtttttcccaggattggatcaacactgtgatgcgttgtgtctcctcagtgagatacgccgtcaaaattaatggagagctgactaagccggtggtcccttcaaggggcattcgacagggggacccaatcagcccctacctgttccttttgtgcacagaaggactgtcatgtttgctacacaagaaggaggtagcgggtgagctacaaggaattaaaaatggcaggcatggaccccctatctcccacttgttgtttgcggatgatagcattttctttgctaaggctgacagcaggaatgtccaagcactcaaaaacacgctgcgatcatattgcagtgcgtcgggacagaaaattaacctgcacaaatcttcaatcttttttggcaaacgatgtcctgatgcggtcaagatatcggtgaaaagctgcttacaagtcgataatgaagtcttgcaagactcttaccttgggatgcctactgaaattgggcttgctaccacaaatttcttcaagtttctgccagaaagaatttggaaaagggttaatggatggactgaccggccgctgtcaagggccggtatggagacaatgctgaaagcagtggcccaagcaattccaaattatgttatgagttgtttccgcatccctgtctcaatctgtgaaaagatgaagacttgtattgccgatcattggtggggctttgaggatggtaagaaaaaaatgcactggaaatcttggagctggctttctactcctaaatttcttgggggaatgggctttagggagttcactactttcaaccaagcaatgttaggaagacagtgctggaggctgcttactgatcctgattccttgtgctcgagggttttgaagggaagatacttccctaactcgtccttctgggaggctgctcaaccgaaatcgccgtctttcacttggcgaagcttgctgtttgggagagaactgctggcaaaaggagtgaggtggggagtcggtgatgggaaaaccatcaaaatcttttcagataattggatacctgggtttcgacctcaattggtgacaacgctttctcccttcccaacagatgccactgttagctgcctgatgaacgaggatgccagatgttgggatggagatttgataagatccctcttccctgtggacattgctaaggagattctacagattcctattagtagacatggtgatgctgacttcgcttcttggccacatgacaaactgggtttatactctgtgcgttcggcttacaatctggcgcgatcagaagctttctttgctgatcagagcaacagtgggcgaggaatggcgtcgagactgcttgaaagccaaaaggattggaagggcttgtggaaaatcaatgcgccgggaaagatgaaaattactctctggcgtgctgctcatgaatgcttagcgactgggtttcaacttcgacgacggcatatcccctctactgatggctgtgttttttgcaacagagatgacacagtggaacatgtcttcctgttctgcccctttgctgctcaaatctgggaggaaatcaagggtaagtgcgctgtcaaactaggaagaaatgggttctcaaccatgaggcaatggatctttgatttcctgaaacggggatccagccatgcaaacacccttttggctgtcaccttttggcacatctgggaagcaaggaacaatacaaagaacaacaatggcacagtgcacccccaacgtgttgtcatcaaaattttgtcttatgtcgacatgattctaaagcacaatacgaagacggtggatggccagcggggtggaaacactcaagccatacctagatggcagccaccgccggccagcgtatggatgatcaattctgatgctgcgattttcagctcgtccaggaccatgggggtcggggctttgattcgtgataatacagggaaatgcctggttgcttgctcggagatgatcagcgatgtggtgctacctgagcttgcagaagcgctggcaattaggcgggcactgggtctagcaaaggaagagggcctggaacacattgtcatggcatctgattgtctcactgtaatcagacgcatccaaacttcaggaagggatcgctcaggggtgggatgcgtgattgaagatatcaagaagttggcgtccacctttgttttatgctcttttatgcatgttagccggttgtccaatttggcggctcattctctagctcggaatgccgagctgtctacctgtactgtgtaccgttctgtaataccggattatatccgggacatactttgtgatgatgttgcttaatcaatgaatggcatgccgcctttgtctcaaaaaaaaaaacaagcttgtgacttgtgagttgtgaggcttgtctttccgaggagagttgtacagtagtcggtcagtggtagactggcagtaggagtagtagtggtgcaggtgcagggccatgatgatactccactgtacatgtctgcatcgataccctgcgccgggcggccaatgattgcagctgggtgcagcgatagattattggagaggggggcgtccttgtcctgacgacacatgcccttgccttgcgtcatctcgcgtatggctcagaaagcctgcagaacatgtcagagctaggagtagctagctgctggcgtaccagtgctcgtatggtatggatcgtttttctaaaaaaattctgaaaagctacgccagttgcgagccttttggttaaggaaaaactgttataaaacatgtgccgacgtctgcgcaggagtaaaataaaacagtgcagcgtgtgatcatcagtactgagtactggtagtacatagaggtaatgtaggattaataaggatttgcatcgctcatgggctcgtttgctccgagattaacctgctggtgaaatggcacctcgacacacatcaacccctcccctctcatcagtcatcataaaccagcaaagaaaagcactctcaggagcatcgaatcagatcgatcggaggagtactacaactgggtataaagcgtactagtagtaggctgctccaaaggcagatcaaaggtgagaccaaagcgaagcaaactcgcaaaggcgcccaaccttttgcgatccatgccagcagcaacagcccccctatcttagctagctatccacgggatgcatgtgccatgtctgatgtcttcgctagcccgcgcccggtctgcgtcgcgcgacgccgtggacgagcggctcgcgccagcgtgcgtggctgctggctttgctggtgtaaaccgtgtaaaggcgtgcgcgcgagcgcggcgaacgatcacatggcgtggcatcattggcacgcgggggagggcccgacggccatcgagacgaacgaacgaaagaacgacggcgagctagatacttcccccatcccaaaatggacggagacagtactccctacatttcaaattgatctatatattttataggtacatcgagaccaagaaaaactaatacggagtaactctctcatactatatttactctagcaacaaactcaatgtatacaccatccctactatttcttagccaatagcaaatcaagatattgcatgtgggttataaatacttgtgtgcatggatgcatgcatcaatgtccatttactccaatgcacaaataacgaatagacttaataaatgaacacaaatatgtagataatttaggaataacataaaaaaaattatatgcagatcaatttggaatgtagagagcatatatctaggccgttggctctgtagtgatactaatttcttttcgttttctactctctccataaaaaaaccaatctaaatttatcccctcttaatacaacgaatctggataagagttgtctagattcgtcacaggttgttttctttttgggacgggggagtacgtaataacccacggcatcgtacgtactcctggtgttgccgtatgttgctctgcgtcgtgctatacggcctactaccggtacacttattcatacctcccccacaatgcaatcaatcatcgatcgtgcactaatgcactgtgcattatgcgtattgatgtgtatatatacatacaggtagtagtagtactggtagttgttagatgcgtacaaaagacaattcgtgctgggatttcttgtacacactcgcgacgcgttctcccccatcccgtggtattatcaccagcgactcgcgccacccaccggtcgcgttgcttgcgtcgttggcggcggcggcggcgagcagtcacgtgacgggcccgcgtgtaccggattctgtccgacgtggcgtgtggggggggggtgacgtggcggggcgcgggggatttgaatttggtgcgggcggctgagatcggcgatcggatcggggagggatggtgggatggggcgccaggctggcggtccaaccttgcggcgtgctgggtggagggccccacctgccatgacagctatactactacagtagctagcaaggactccaggagcacgatgacacggactggaggaactggagaaggacgattcatactgcatttttgccaagattcgtactagtagtatagcttttgctcgaatttcatctgtttttgcggttctgccgaatcaagcttggctcaccgacgcatttgcgaattgattggcgtttaaggtactgtttcaattaagatacagattttacatcggtctttgttagcacgttttttaaactgtcaaacactatatttcatgcgaaaaatttatatacatagattgatttaaaatatcatataaattcatttttaagtttaaattaattaaaacttaattaataacatgctaaagttttttttacgtgcgtacacttcatcttcacttaaagcaatctcaaatagggcctaaattatgtacgattgcagatgtaat

SEQ ID NO: 67851 - DNA, 9991 bp, Oryza sativa
gtgacaaatttacaattaaccatttttagtctgatgggcatttagttgattttttaaagggaaatttagttgatttgacgatcatagtctaggtaagggatgcatataggagaaaaccataaagaataaggaaagagctaagtttaatggattattttaagaacaaaagagttagtgtagcgggtagcaaaacaaatgatgatgatagaatataacgaggtcacagtatttatgttaggccgttagtataatgtttgtgaaacatttactatatttatagaattttaaacaaacataaagtatatgtggattgaaaccgcagaattaaccactataaaatatagtcacacgagtataccaaaatccagtgcactttctggtggggttttgcaattttcctaattgccgagaactctagtccttctgaccatgtgagtatgtgaatgtgacagcaaccacgcacgaatcctccacagtggaatgataacaagaaggagaaaaagggaaagcctcttcttttccccttttccggattttgatagatcggtagcgacgacatgtgacctgccggccggatccaacgtgctcgcacttgctatctactaacattagcttacattacatgtacatatgttcatgataataattatcttggtcatcaagacatcaacgtgtcattaatcaacaacatctgtagtaataatgatgcagcgacaagaggaccaaaagagctgatcactgcaattcccatcccaaacattccaattagctgcttacttactgctatacgtactcaactgctgtgctaagttcagaagaaccacacgtttatctgtatcagatacagagcaaatagttcccttgatgtataaagctcaaaaccaattattccgacgttgtcaggatgatttggtcagtgtttttttttattagaaagggaataaataaaagatgattgacaagtcatgttaactagataagggggggattaaattaaacagaaatagtgatgatcattgggctctgttttccagttgtttgtccactaagagaaaaataatgagcaagccactattctgttttttctcatctgtttcttaacttggacacaaagaataaaagtttagagaacttgattaattaaattaattttctccctgctcatgatgttagtcagtagtcaccgactttaacgacgttgttgttagatgaagccataatgtcatctcttccagaggaatttctacaaaacaacacctaccatctctttctcagacctttttagctttcccaatagacaaattaacctacgtgtgctagcaaactatgttatacataccgatatgattcaattggtatgtgaatgagttacggtggcccatttccctatataaatgaggttagaattatttgctaatagggtctatatgttaatcaatcacccaaatagctaattaactggtactagtaggaccaatctaattttcaatagatcaatgtagggccattttacttatcaacaataagcagaaagggaagacatgacagccaagatggtgtcacggagtcctctccagaaagcaaagcttggagacaagctcattcgcaagaggaggcgcacatggaaaccacaaacacaaaaaaaaaaaaacaatcaagaaagcaatcttgcaatggcgattaaattagtagcagtgtgttaagcattaaattaatggagagcacaagataaagaagggcccccatcaaaaaccttaggaggggaatcacatgaatacacatgaggctagccggcccatccccggcgagtgggcccccaccctgttcacatgtctccatctcaccccactaaacaactcaaagaaaaatcatattccattccacactaatcctcaacataatattttaccaaacttttgaaataagaaaaaaaaacttttaagatcacttgctttttataatacagaaggaatcatataagaaatctgtttaaaaaaacttgcatactaacttgagacgatcggactcctaactgcagttcatgattttctaaaaatatatatatccaagcaaactcccacagtgaatttcatcttaagtaaaccatataataataataagactaaaatagactttacctgttgcaacgcacgggtatttttttctagtaaaacataaaaataaatgataggattgttacaacttctaaagtgtagccaccccattgaaccaaagtgtaagtactcaactgcaaattcccccgaacacttcggtggcggaaggccaggcgtgaaatagtacaacaccaaagcagccgcgcgcactcaaccgcgacagcgcctcgcctgccctctgcctaccgcgaggcgcgactcatacctcgctcgtctcacctcaccgccaaattccacaccaaaccgaacgatcaaaaggcgaggcgaacaccaccaccaccaccaccacctcaccacgacaccactccccatgtctaatccactccgctaatcaccaccaccccccgcaccaaataagtacacccaaccccaactacgccacaaaagaaaagcttacctctctctctctctctctctctctctctcttctcctttccctctcctcctcttcccaccaccaccaccgccgccgccgcctgattggtggtaatcggaggtggaggtgggcgtgatgatctctacaggcagcggctcgtcgtcggcggcgtcgtcttctgcgtcgtcgtcgggggtgagggtggcgggcatggcgaaggtgcgggggaaggcgggtgcgggtgcgggcgccgcggcggcggcggcgacgaggaccaagtggaggagcggcgcgcaggagaggatctacgggcggcgcctgctcgacgcgctgcgggccacgcgggacggggctgcaggcgggggcgggggcgcgccgccgcagccgcgggcggtgaaggccgcggcggactcggcgctggcgctcaccgcgcgggggcagtcgaggtggagccgcgccatcctgctggccggcgcggcgtcgtccaggcgccgcgtgctcgtcaaggccggcgggaagatccgccgcggcggcggtggcaacagctgccgccgcccgcaggcgcgcgccgcggcggcggcggcggctaaggcggccgcggccgcctcctccgccggcgagcccccgatgctgaaggagaggaaggtgaaggagcgcctccgcgtgctgggccgcctcgtccccggatgccggaagctccccgcgccggcgctgctcgaggagacggccgactacgtggccgcgctggagatgcaggtcaaggccatgcgcgccctcgccgacgcgctcgccgccgcgcagctctcctcgtcaactccgcagcaggcggaggccgccgccgacgagaccgagatggagaggtgagggtttcgtggtcaatcgtgagttcatcacacgatcgatgatgctggattcgattcgatggctcggaaattggaacggctcggggaaaaaataagggcgattaattagtggattattattgcgagagggtttgggatttgaggagggtaattgcgatgattgatgctgctgataatgctgctgctgctgctgctgctgatgatgatgatgatgacgatgatgatttgtaaattcttgatacttgtataagtaatgctgctctgctcctctcttgtttttttctccttgattcttgaaatgtttttctcctcctgatttccaaatcatgttggggattcctgatttcctgtttcatcttgattagtagtattatgctgtgattggggattagtgtgttttgccctgtgttaatcagggattatatgttctctctttttttttttttgcttgcgaagaattggagagaaaaaaatgtgaattctctcaaaataggtattatctcccaatctcccatactatccacttgtcaggacgatttcttcgtaagataaggtacaaaaacatgcaaattgattgacagaatctgaaaaagaaatgcctatgtagctatagcaccagcaattcgagactcgattaaataccaaatcgatgtatgaacagttcgtactttgcttatcgcaaatctggatgaccaagaacaaagaagcaatccatgatagccaatttggtcattgcggggaaagaatcgcacagtgctaaccacactgcagctactgcactttcgcaaaatggatttactgttattaaatttctaacgattttgctagatatttgtcatcaaatttctccccctaatatttgtcagatgtaattacagtacaatcgtagtgtaattatactgtaacttgcatgtaattacactgtaactataatgtaacttgtatgtaactttcaagaatctctcggtaacatgttatttcagtaaaatagaggtcgtgggaacaaattctttcatatatgtgtgtgatgtgatttttttcttcctccatagaacaaatcttgtaatagatctaacgattcaaaattacgtgaaacttacatacaagttacactgtagttacatgcaagttacagtgtaattacatacaagttacattgtaattacactacgattgtactataattacatctgtcaaatttttagtagaaaatttgtcgacaaatgtataggtggtcccaatttctaatgccgtcaagacacggcaatagtgtgcggattgaactaataattgggtaattaaacaagaacgcgtaaggcgaaagcttcctctgattcctctctggtctcccctgagtcctgacccttctgctaccggatcagattcagaccgccctgacactcgttggattaccagaaagttgccgcatttgctgacaagaagatctctgaaatgccttttttgctggtaaaaatgttctctgcacgagcgatcgacagcacggtgatgtgcaccctgcatctccttatcatcgtcgacttttcatttttgttcttcaggttatagcatcctgcatcctgcatcctgctcttttcgatttgaagaatgggaaatggggcttgtcttgagcttttgttgcttgttcatctaaacaaacttcccgtcaaaatcacatcatcttagcagacttgtggttgaactaaagaaaatatgatttggtatgcacgtgaaaatcctgaaaaaaaaggtaggactagttgcttggataggaaattacaatcggttaaaaaaaagaaaataagattgacaaacattactctgggtttgctaattagcgcacgtgtattatcagtgcacatttattttcctttccaatagcactttcatacgaaactttcttctcaaatcatttttaaggcctcaaaacttttatcttggattacaaaattttcaacttaaaatttgaaaacttttattaaaaagtgcatgtgcaaacgcacctgcacaaaatagcaatttcggcattactctcaacctgaacagtacaaatatacaatgatcatcccatttaccagaaggaaaggaaaaagattgtactgtctcgtcactagatagttataaatgagtgggtatcttaatgattctgtgatcactgtttcatatatataagtttttttgttaaattaggagtaaaaaatgtgaccattcattgttccattccttaaaaatgagattgcttaggacacttaaatttgtgtaatttgcttgtaaacattaaaaaagtatcatagctaaaaagacaccttacaaattaccaatttgctggaagatactttcggctcaattaaagtaaaaaaattcttcagacgataatacccattgagccataggcttcttacatggtattggagtgaaaacttagaaattatacaagtctaaagtatcctaagtacattgctagcatatatcatattccaactttactctagcctcatgtttgaaacttttggctcttagagcattcttatctttttaaaaaaattcttcaattgagtctcaagtgtcatatagcaaaatttgtaaaaaaaaaaaaaccctaaacactaccagtgctcttgcaacgcggcaattcttaccgaagaggaaaaaataaaagaaaaagagtaatttttactttgggccactttttattaccggtgtttcgctttggaccacccttcaacaaatgttttcaaattggaccggttaagtttaccattgtatcactttggactaccctcaactctcttattcatctacatccaatttttcatatgttaaagaaacggtctaaatacagctaaagaggtttattgacaaataggatctggcatactcgaggtcgttcatatacttgagaagagaatcggggtggtccaaagtgaaacaaatgtaagattacccagtctaatgtgaaaatgttagttgaaaggtgacccaaagtgaaataccggtaataaaaggtgacccaaagtgaaatttcctcaaagaaaaataaccatttctaattgaacggtcaattcttacccattcatggttcgattaaccatgaatcggttaaccgaacggtccaaaacactgagccaactgccaaccaaggcaaaacgggccagtcaacggacacgtcacccggtcagcgccatcgagctcacgccgcgtgtctcctctcctcctcatgccgaggagacgacgagcacgagatctctctctctctctctctctctagcttccacctcctgatccacccgaaccctagaatccactgcgacgagcagctgaggaagaggaggaggaggaggaggcgttctcctgggaggggaccccgtcccgcccgtttccgccatggcggcggcggcggcttcgtcctcctcctcgccgtgggcggggcggatggcggcggcgttcggggcgccgttcctgtggctcgtctgcctgatctacttcatccaggttccgcttccccctccccctctccgcgcccaccatttcctgcgacgcgattgatccccgattcttttggaacgctctccgttcgttcgatcgttcgttagataagagttacgcggcttcctgggaggagtgacgacagctgtccgaaaacctcgcgtttggatccatcagcaaacgcggagcggaggcgagatgccagacgagtttgagatcgacatgtggtagtgtggtacatccgtgtgcaagaggccgaactggtcgctgtctgtatagagatcgaggagtgcttataggaatttgggttcggatgattacatggtccttttgcttccttcgcttttgtaaggcaatcttggattgtttttgccaggtcaaatcgtgctctctgtgtaggatgatattatggattgcttcttgtgtcttgggtttgcctaaataagtaattatgtcattcattttaagaattggaggtctgatggctgcatgaacacatttttcttttaaatatgaaatcgaaggtagttcatttgtgatccgttgtaaggattggaactcatttagggcattaggagggtagagttatttctatgatagatgactcaatatgtttcatactagatttaactggttggttggtgtgcagacttaggtagtgaaagtttctctaaaaagagcttaatgttgatggagaatctcagatttgtgaaactatggaatgctatacgagttcagcttcggactgtaatgtctgaaaacagcctagtgtgataatttcacaattatagcaaggattggtggtatgtcatatgtcttagcatgacatgcaatgggatggggaccaaatttgtttatttgtgttgtgagctcatgtgccatgctttggtgatatgtcaaatgttagcatgttcaattagttgtaaattccttgtctcaatcagaactcttcaagataaactgtattttgtagtagagctaactaaatataaagaaggcagttttggtttaccgaagcttattttcgccattagttgaaagcttaacaaagcactacaccttttactttgatagattttaatatttattctgcaattctttagggtttcaggtcttttgtctggacagctgtctcgtaccaaatgaaggacatgatgaaactgtcaccatcaacatcacagtttttggtctcagttgcatatttcccttggagtataaagcctgtatatgggtaatgttacttctgtttgcttctgctgtgaactgaaatttaatcatgttccctacaacctaattatgttttttttgctacagagtagtttttgtaatgtactgtttcaaacatcatgtgccttacacagttacaccttagtttcagaaatcttacatgtaattatacttcttacaacaacagagtttccctgacatgtttactgtggcttatctctattgcaagtgattaaagtgtagttgcttacaaacagatgggtgctcaatatttcctgagcaagcaacaattattacttactgccttcggacaatttgtcaattatgacaattataaatattcttttgtagcataagagctaaacaatttgtcaattttatatttactgccttcacacagattaacacgattaattctaaaggatgtttctgaatagggtatatatcaactaattttggaaattattttactttagtggaaaatggattaatatgtgcactgcatttggagacccgacagtaaatgtgaaagggcaaaaggaagtgctgcaagcactccaacatcgatgggtatttttttctgttggatcgcttagttttcctcatgcatttatacccactcaaatgtttgctgcatacttgctgtggagctgtgcattatggcattatgtaacagatagtcctgtgtaacattaaaatcacaggtcttagaaatttcttctatgttgaattgcacggcttgtcggcttctgagcactggctgcccattactgtaaaacatctatatgcgtttgtgtataactataatgagtttcagattgtactgtacaaaatccagatactcgttacttccggatgagtctcctctgactacgtcagagggactttgtcactgacatgtgggacccacaaaggttgggcccacacatcagtgacccacgtccctctaactttacgtcagaggagcgcgatccgttacttacacatgcatctttgtgcctgcaggattttgtcagactgtattcccatcaagcagaggaagcgtacgccctatttgatcatttctagctgtctatctctatttccgtggctaatccttgggatgtcagaacctttgaggagctcaagcaattttcttactgctttgctgatagtacagaacttgggatctgccatggcagatgttgttatagatgcaatgattgcagaagcagttcgatcagctgggtgagtatcttagtgtaatattttcactggttagcaactactatatgattacagattatctgaactcaaaacttgactatatttttccaggccagaatttgctggtgatctccagtcactatcttggtcatcaatggcagtaggggggatttttgggagcttattggggggatatgcactgtccaatctccctatacatgttatatatattattttctcggcgcttccattgtttcaactaatttcctgcatatttgttgaggaatctccaaaaggatttgagagtagaatggataatgctgcacctaaacatgtcgaggatcaaactattgatgcttctcccggaaaaagctctagtgaatcatataaatatgaagatactagaaggcgaaaaggagctaggagaaataataaaaggaaatcattgtccaaacgacctgaggaccatgacaagaacaagtcaactaacttaaggccatacttgtctctgaaatcagcattcttcagtttatgcacagcattcaaacaaccaactattttacggtaactaatcatgttatgatttcatttcctcttatgtttacccctgtcactgaagagactaattgatatcttctttttacctgccagacctatggcgt

SEQ ID NO: 67852 - DNA, 9643 bp, Oryza sativa
  unsure (1)..(9643): unsure at all n locations
atgcctcagccttcgactactccgagtggacccagcaggttggtggtgcggtttcggactgcgccactgtgtacagcgattgttgtgcgcgcgtatcggcggccttcattatgggccttctgcaacagttcggctgtgagcacgtcgccgagttccctaactatacgaagggggactgggaggttagtgcgcagaacgtttcgcccgcgctccgtgcgtggcgaaagtagttctggcagaaggacggccgatccaccgccaaggcgtgtcttctagagcaactggtgaaggctgaggcggcagaccggtgcaaagaagaggacgcggcggccgaagggggtggaggcgatgcccaggatcacccagaggtgtgaggccctccgccctttccttagattttcgtagttttccttcttctttttgtgtttgccggtagaggcgaacgatgtaaattcggtgagctgttcctaaccctccttactgtacccgaaaaaggccccttggatatttggaatatatgactcaatcttagccaccttttatggtcgacgcctgtggcgtatatgattacgccactttcgcattatgtaatatttgccctttttttacccgttcttactatgcaattcgtcttttgccctttctgcactgtctaccagggtgttcaccgaaaattgtgcattcggcccccttctgggagttggcaaagcaaaaactagaaatttgtggcgttgaagggtttgccgaaggtgcgatgcccagttcggcctgtttatcgcgaaatggtgataaacggccgcagctacaaggtttttaaggttgccggctagctgcgggcgcaccccgggcgaaccttagaagactgcgatcttgttcatacaagacgtttggaggatatggctcgcttttggcgaaatcatcagaagactgatcgggaggaggcaatctcccggcgtcgctacagtgtagtttgtgtttcgctcccttcccctcttagggtcgtgtatgatattagtagtgatgacgaacctagtgggggcaaagatgtaatttatctgtaagctgggctgtaaagccattgctcctttcttttatttgtaccatgttgatgggtttgtattcttcgatacatttttctttaaaatcaataaaaatgcgttttatttccttttcgctatttttgcattgtcacttcgcgtgctttcgttgggtcggaacgtgtcggcccctttgcgtatattagcgaaataggttttgacttttcagctttcggcttccgttttcgatccgttttgttctacgttgcaagaagcactcgtgctttccttttgattgagtgtaacggtgttcggttagttgtttcccgaaacaagttgttgcggtttcaacgttcagctagcgatgcttcggnccgnnattcgtttcgcgccccccttggcctttttcgcttgatcaggcgtttgccttggggtttttccacaaattatcaatcacacaaataaataaaaagaaggcctccatggtggataataacactacatccagttttttgtcttttttcattttcctctttttttctcttttttttctttgccgaaaggcttacatagtgccgaagggcttacataacgatatatacattttttcaagttggcgatttgggtgccacccgttctacacatagaaacgcttgagagaggcagcgttccaggaatggtcgaactcttcgccttccagtgtcaccagtcgaaaggatcccgtcctggacttgtgcttgatgaggtacggtccttcccacttcgattcaagcttgccaatggctatcgggttcgccttcttcgttaggacaagatgaccaggcaatagctccgtcggtcgaacttttttattgtaagttgccgaagtgcctgtggcatacttgcgcatgtgttcgagtgcttccactcttaccccctccaagagttcgagcgacaccttgcgcccctcttcgcccccagagaacatcactcttggtgaattagcctctagctctgtcggggtcattgcctcatcgccataaaggagcatgaacgggctgaacttggttggtcttgtgggggtcgtccggagagcccagagaacagatagcatttcctctggccatttgcccttcgccgccccctcaagccttttctttagtgcttctaggatcttaccgtttatgcgttcggctgccccatttgactgcgggtgcgcgtccgacgtgaacctgatttccaggttacgcccttcgcacatttctctgaacttgtcagagtcaaactgcttgccgttgtcagtgatgaactcttttggcactccgaaacggcaaataatgtttttccatacaaatttctgtattgttgccgaagtgattgctccaaggggttcggcctcaacccatcgggagaagtattcgacggccacgattgtgaacttgtacccatttcgcgccaccgggaacggcccaatgatgtccaatccccatctggcgaagggccagatgggtgagatgggccgcaacttatactggggcacggtttgacttcggccatggcgttggtagctttcgcacttcttgacttgctcaacacagactttcaacacggtgggccagtacactccttgtcgaaacactttggaggcaactattcttgtggcctgatgcgcgccacagagcccctggtgtatctccctcgccatttcctcgccttcggcaaaagagatgcagcgaagcaagggttgaagtacctcggagcgatatagctggcccgagaccatcttataccttgcggctctgagttgcaggcgttttgcttctgcttcatcttttggtagccagccagtttcaatgtatttcacgaacggagttcaccaatcgcatggatcttcgcccatattctcctgatcgattgccatgacctccaggctgtccatgggcacacttggtgcgtataggacttcaaaaaagatgccaggcgaatgtgggccaccataagcagcagattttgccaaggcgtctgcttcctcgttctggcctctaggtaaatgttcgactgttatgccggtgaaatacttttccataaaccgaacggcctctaaataccttttcattccatcttcttttgcctcaaaggatttgtcgacatggcctgccaccagcttggagtcggttcagattagcaagcgccgaatccaccagcttggagtcggttcagattagcaagcgccgaatccctaatgctttcgccttttttaggcctagaagaatggctttgtattctgccgcgttattggttgtgtcgaactgcagccttgcggcatatcgaatcggcacaccacttggcgaggtgagtactgccgcaatgcccgcccccttgtgcgaccacgaaccgtcggagtacatcacccagcgctgttcgacgggttcgggctcgggggcgaatgccggtgtccattcggccacgaagtcagctagcacttgagacttaacagcagtgcgggcaacaaaatgcaagtcgaaaggggatagctctgccgcccacttgataagccggccagtaacttccttgcctcgaagtatttcgcccaaagggtactacgttggcactatgactttgtgggcttggaagtcgtgtttaagcttgcgcgaagccatcaccaggggcgtacgcgagcttttccatttcaatgtatcttgtcttcactccttgcaatacttcggagacgaaatagaccggtttctggcctgactctgtttcttgcacgagggcagcactgactgccactagcgaagctgccaggtatagtagcagttcgcttcctggtgctggactgatcagagctggcgggctttgcaaatattgattcactcgtcgaacgctgcttggcatttgggtgtccaattgaatttttccgcgccccggagggccttgaagaagggcaaacctctttcggctgcctttgagaggaatcgactgagtgccgcaattcggcctgcgagcttttgtacttcacgtacgctcgacgggggcttcatttgctgaatgacatctattttctcgggattcgcctcgatgcctctttcagaaaaaaggaaatccaacaacttgcctgcgcgaatgccaaaaacacacttctcaggattcagtttcatacccgctgcgcgcaagttgtcgaaggtctcctgcaggtcggacgcgtggtcgaaagccttgcagctttttacgacgatatcgtcgacataagcttccacatttcaccctaactgcttgtaaaggaccttgtataccagcctggcgaaggttgccccggcattcctcaggccgaaaggcatcctgagatgacaaaaggtgccgaacggtgtgatgaaggctatcttggggatgtcggccgggttcatgtggatctggtgatagccggaatatgcatccaaaaaactcatgagttcgcagccagctgttgaatccacgagttggtcgatccgtggcaaaggaaaatcgtccttcggacatgccttgttcaggtctgtgaaatcgacacacatgcgccatttgccgtttgatttccgcaccagcactggattcgccagccactcaggatggtcgatctcttggatgaccccagccttgagcaatttttggacttcggcttttgctgcttcttggcgatcagcggacatcttgcgcagcttctgtttccttggcttggcatccggcttgactgccaggtgatgcatgatgagatctgtcgaaacacctcccacctcatcagggccctaggcaaagatatcactgtttttcttgagtacctctaggatgttcgcagcctcttcttcgcccatgtcgccccctagcgatacgagctttgtggggttggcgtcatcaatctgcatcttgattatcttgccgtgaggggcaggctttggcgcgtgcttcgcccggtcatgtggttcggcctcaacattatgcactgctctgttgattatggccagatcgcctttcgaagaggccgaagactgaagccccttgactacgatcactcccgccgggccgagcgtcttgagcttcggataattgtggtgggagatagcttcgaacttgttcaaggtcgcatggccgaagatggcgttgtagttgtacgggatgtccacaacgtcgaataatacttgctcttcgcgtctgttttcccctgtgccgaaagctaccagcaactgtgttaggccaagaacttgaactgcttctctgtcgaaaccacggagcgaggctggtgctagggtaagggctagagtggacaaccccatcttggcatatgcttcggcgaagatgacatcggccgaactgcctccgtcgaccaggattcgctggacctccaagccagctatctcggctgagatcaccagagaatcttgatgcgggaacattactccttcggcatctcccggcccaaaagagatttgctggttcagatactgcggggccccttcgcccaccgaagtgatattgtggaccgttcggagccgcatcttcttttatcgcttcgatagttggatcggcgggtcggcccttgtaatcacttggattactctgcgatgcgcatcttggtgctgttcggccgggggtgcttgttcttgagctgcttcacgaggtgcttcgacagctactccatgctgcggctttggatcttgcgcgttgccacgttgccaaatgttttggcattgctccgtggtgtgcgaagagcgtccatgaggcgcagtagaggtcttttcggaacttctttcggacaggctactgatggttgcctgcttgctgggtgtcgaactccttgcgaagggcttttacttcttcgacatccatcacagccttgcccgcgcggtcggttctgaacttcctccaggtcatgggggcttggccttgccttggcggttgtccctggatcgccatctgaggctggcgaacagcgaggggaggtggttcggcaacctgagcttgtgcttaggcttgggcagcggcgaaggaagccttatcacactcagcttgtattgcttgtcgtcgcttggaatcctcttcgccccttgcgtacccgtcaatgatgcgaagtaggtgctcaagggtctgtggctccttgttggcgaattttcttgtgagttcgcccttgagtaccccggccgaagcggcgtttatgacagacgcctcggttatgtcttgcacttggcaccgggcttgcgagaagcgatgcatgtactcccttatcgactcccccggcctctagcgaatgctgagtagatgctgctgcgtcttcggctcctcataggtgcctcagaagttaaggacaaagacatcgtgcaattgctcccatgagtaaatgctattggctggcaaattaaaataccaagaacgggcgatgccgtctagatcgagatgtattacctttgccttggtattttcgtcatcgtgagccgcttcgatcgcggactcgtaaatggagaggaattcctttgggtcaatttcgcctgagtagcgtgggacgggtgggaacttgaactggggtgggattggacgggtcttgattcccccactcagcggtagccccttttcgccccctgccctgttcacggcaccttgctgcgggtacggcgtagtgaagggcgaaatcacggctttcgcataaggttgggccatggcattcggctgcccagctccgattggtgatgcttgctgagccaccatggatgggtcgaacgttggctgggaccatgccatggcgacctggtttggtgcttggtttgctccgaagcctggcgttggtgcttgcggccgaacggttggtgcctgagcagcattgatgaagtcgaactgtggtccttgactccaaggcgaagcccccagacctgtctgattcgacggcaaccaactaggtgcaacttgacttgtattctcctctgggtgggccgaaggggttgtacctaaaatgctgtgaggttggctgacttgctgaaggaaagcttggagctgcgcctgcagagcggaagccccttctgccattgtttgtgacacttggccaggcggttgagggtgtacttgggcagcgatcggctgagctagtagttgcacgtgaggggctggatgcaccgctgcggtcgagggctgcccgacgaagtatactggcgctcgcgtaacttgtggcggaaggggctggattggtgcttgtggatagacttggggtgggacgtagcctaccgaatactggaggattggggccgaagcgaccttggaccgcctcgccgcctcgtacgcctgctgctgttcttgcatctggtgaagcatgtcttagagtcgtgtcatgttctgtcgcatggcttccatgtcgacttcggtttgtatttcggggtcagcgttgacttgtatagcggcgagagcagtcgaggccgctgccggctgcgacggagcggcttgaggcactagcagttggcttgctgcccgggtctggagtacccttgccgccatggctgccttcgccaagtcagccgtgttcggcacctgcgtagaggcggcaggagccgaaggcggtagtgatggcgcaggtgcggaggcagacgacgctcctccatcttcggcgacgcgcgccgaaggctctgctccctcttcggcggccatctccaccccggcttcgctttcctttcaccttgtaaccttctccttcactaccctcttcggtggcattcgctctcagtgttttcgctcggaggtccccacggtcggcgccagtttcgacaacagcttacgtcgaaagacgtggtcactcaacagtagttggaaaataagtaaagtgtattaaattgagaatttttcttgggatccccctattacaaggccctatgggactatttatagcccccattacaggttcttactactagggttttggttatacaggggaatttacatgggtacataatgtaattgaggttcatgggcccttgatgggccgccaggcaatcgtcagcccaatagcccctaggcttgaagggccgaaatggcttcttcggtcctcgcgtgggcgaacttgctatggcgaagtcgtctcccttcggcatatactcttcgccctacatccttcgcccaagaggccctagcccggcaaggtacccgcgcgattccccgcctctcgccgtctttgtttcatagccttcgccatgggggggcttcgccctgactaaccttgatgcctcgggcttgaatccccactggtcgcgtggtttcggcaggtttggtcgaagggcctcatgccataccgccaaaaagttgcaagtggtttctagctaagtccctgtttggctccaggatgtttctgaaggatattatcaggatgagcattctaagaatttgttgacacagctatccttttcccctgaatccagacctccattctctcttcgtagtggcattctcaagtataaggggagaatatggttgggtaataattgtgctttctagctcaagataatatctgctttgcatgacagtcctatgggtggtcactcaggttttcctatcaccgatagaaggatcaaatctttgtttgcttggcccaaaatgaagtctatgattcagtctgtggtgaaagaatatggggtctgtttacaggttaacttgacagaagcaaatacccagggttgcttcagccactgcctatgccagatggggccggcaggttatcacaatggattttattgaggggttacccaagtctcgtcattttgattgtattatgttggtagtggataaattgtccaaatatcctcaattcatgcctttatcccatccatcttctgcccttgatgttgctaataccttcatgagtaatgtgtacaagcttcatggtcttcctcagtcaatcatatccgatagagaaaagattttcaccagccatttctaggagcagctttttgccatatcaggactccctccgtcccagaatatagcaacctaagaccgaatgggacgtatcctagtactacgactctggacatgcctcctgtctagattcatagtactaggatatgtccaatccggtcctaggttgctatattctgggacggagggagtacacaattacatttgtgcaccgcttctcaccctcagattgatggacaaacagagcgtgttaatcgatgtctagaaatttatttgcgttgctttgttcataccatccctactaagtggaattcttggctctatttggctgaattctggtttaatacttcttaccattctaccatcttgtagtccccttttgaggtgttatatggttaccctcccggccactttgaaattagggatgattcttgctctgttcctgatttggatgttaggttgaaggagagagtatctatggttcagctgttgaaactgcacttgaacagagctcagcgacaaatgaagagttatgcagataaaaacgacagtttcagagaatttcgtattgttgatttggtctatttaaagttgcaaccatatgtgcagtctttagtatctaggaggacaaatcacaaactctctttcatatattttggccctttttagatattagataaagttggcaaagtcgtctattgtcttcaact

SEQ ID NO: 67853 - DNA, 9499 bp, Oryza sativa
tcagcccccacttcagccaccgccgcccaccgaccgtccgcccccgcgcaccgccgccgcccgtccacccccgcgcaccgctgctcgccgccaaccgcgcccgccaccgcccgcgcccgccgccgctcgccgccagccgcgcccgccgttcctgctcgccccgtcgccctgcatcgcagagagagagagagagagattttgaagagaagaccatatgacaggtgggtcccacaattttttatatatatagaatgctgactgggctgccacgcgtacgctacatggactaaaactactgcggattgggtcgaggggggtaaatggagaaagctacgcatcggacgtctggagatttgcaaatctccggacgatgttccactgtatgttgaatgaatgttgcaatgttccatcgctcgaaaaaaaaaatgtttcaacataaaatctccagacgatgtttcacattatgttgaatgaatgttgcaatgtttcaccgctcgaaaaaaaaatgttttaacaaaaattgtttcttgatgtttcatctttcattgaatgtttcaccgtgtttcaccgctttatcgaagatgtttcaatcgaatgcaacactcgataatgttgtctgcaacaaaaaaaaccaatatatgcaacatccgaagaaaccaaatgcaacatccactaccgatttaagaaacatccagaaaaaatggattgcaacatcaggaacacactatgtgcaacaaaaaacatgtagtgtgcagcctcctcaccttcgtcgccgagctcagaaccctctcaggtaatggcgtctcaagcatttccgtcgtgctgccccgttgccgccaatgtggttgccggcgctcaccgcatcccgctgtcggaactgctgcaccggccaccactcgagcgcatggtagtcctcgccggcgacgagcaccaccctacgcttccttttccatctgtcgtcggggagaagctgaagaacagcggcgcgcggtcgtcgccgttcgacgccgcccgacgcctccattgccagtgccaccaggaacacggccaccgcgtctgccacacgacgccgctgatgaacgtcgccggcgacaccagaatccggccatccgcgacggcagccccgccgtctacagcggcggtggcggcaccggcgccggctgatgacgccgtagccgcgtatgcagcgtggagacgttgagaagaagttgaacgagaggttggggatgagaaggaagaggataagatggggaaaggtgggccccatcgaccgtccggagtttgtctcgtatcggacgctcgatacgaagcattttcggggctaattcgtccggtttatatagttgggggtgaaaaatgactggttttgtggttcagggggtaattcggacgaccgcgatagttcgagaggtaattcgtactttttcctaataataataataataataataataataataataataataataataataataataataagtgaaaagatgaggccggtactatcttcacgtaccctaattagtaatcactagcttatcaggataaataaagaaggagagagatctgggcgccgaccattcggacatttcgaagaatctggctcttggaagaaaatttaagcacggtgtctcgtatgatcgtctcattaggattggattctcagatagcccattaccacaagccaaaaattaaattttgaacattaaatttagagttgattttaaagctatttcattgtacgtagtttattttcttcatttgcttttaaatcattataaacacgtatataaacgttttacttataaattattttttatctactagaaaaaatgcacgtgcgttgcaacgggtaaaggctattttaattttattattgttatacggtttagttaaagtgaaattcatcgtgataattcgcttagatatattattttttttctagaaaatcataagctgtaattaggagtccgatcatcttaagttaacatataagtttttttaaagatatttcttatacgattgctcatgtatttctgaaagcgaacaaacttaaaacttgactcaaatacggaaatatagatctgtatttctaaaagcgaacgaacttaaaaaccaactcatcaacagatgacgtaccaaagtaccggtaaaaacatctttaatttttataatagtagagatagagatagagatagagataggtatatcgtttagcttattcccttttaatctgctcaatcacacagtagaattaacgccagatgtcacagatagaatgctctctggtgcaccatcactactcactcacaagagaacgaccggaccaggggaccctgcacgctgctggctggctcaacatggcacgtactccatatatgcacgaattccacgggccatcgctttctgaatcctgacaatatctccagcctaattaactacagcaacaatcgtacgtggacggtggacccacggcatcgtctctggtcccgggtaatcccaaattcccaatatccaaatggattatatcgtcgacaataattgttctgcttgatgatgagctaaggagaaataattacgtactgtggagtggacacttgtttagcttaagccttaagataggtttcttgcggttaagatatggcatggtcaccaaagcaccaattaacgtgctccagatcgcacggtgggcacggggtttgagattagcgtcggcacgtgaggacgacgtgagctggcaggtgaggtgaagccatcgcccgggaatatccgtgtcggcaagataaacaagtccgcgtctctggttatttatttagtacaaagttagtactagtattacaagctgatgttaggtgttgatgtgtggctggtttgaggttgattatatagttttctattgtagtttattttacagtatttatttttaattaaatagctaaggacattactagtatatagaagtatattttatattttagttattaataaataatatgaataattatgaatataagtcaagagatgatctgatatttgtggaggggtcaagttgcagagtgttagtcgacaaaactagtcactacttcacgactgtagagtattttagttgatttacttttgacataccggggaaaaccgtgcaggttagtatttcactgatgtcatggtgtgtagggttagtatctgactgatatcatggtgtggaattcaattaatatgcttttcttgtttgtttctaacttgatatagatcttataaacattttggtccttcacgcctcatcaaattttcagtccactacacttacagaccactggccgtgtaaagattgtgtatacgtaataatggagttagaaaaactatttttttatgttagataggactagtaatattagccttctaatatgatgtaaaaccaaccataaataaaagctttttatttatttggtttgttatcgactcaaccgtacttaaaattgataaagcaacaaacagaacatgtataataataactatttctaccctgacacagtttccttccctcgaagtttccactcttaaggcagtgttccgcgtgcacgttttttaaaaaagtttctatataaaaattgcttaaaaaagttaaattaatccttttttaaaaaaaatagctaataatcaattaattacgctctaatataccgctccgttttccgtgcatagatgataggttcgcaaccctctctaacgaacacagcctactaccaccaaaatatacccctaccctacattaccaaaatttagcaatttatttttttcatattactaagggtgtgtttggttgcaagccacactttgccacagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacttcaccttagacaaggtgtggcaacttttgttggcaagtaatggtaaagtgtggctgggaaccaaacagcccctaaaacttgatagtgttagacaacaaccagtcacgaaagaggttgtgcccattggcacatgatgacatgaacctgaccgagccggagttgagttgggtgcgcgtgcgcgagcacctttttctgttggtcgacgttgggtgcctttctggcaacagtttctcacttaggcccctaccatttcccaaaataacttttccggaccagaccacgcctcactctcgtcggctcgtcgccttgtccgcgcgtgcgccaccgtttccacccagattcgcgcccgccacttccgactagctcttcgcggcaaaagagatcgccggctcgccggccggcccggagcgcgggggttccgcttccgcggcggagcagccgtcggctggggaggggagatggacgccggcgagctgcccatcgtgtaccacatcggcatcgtgctggccgcgctgtgggccgcgggctccctcggcttccgccactccgtcctcttcctcctcgccttcctctacctctacatggtacggtgctcttctgccgctgccgcccgcgcctctcgctgataagttgatgcgacttttttttttatcttttttgagctcctttacggcatatgcttaggtgacagttgtgatggatgcatcgctctctgggaggtttttttttttgccttttgtttctatcagaaaatttcctttcctttcctttctgcgatgcgactgattttgtatctgattccggttgcaaatttctttcctttctgcgatgtgactgatttaatatctgattccggttgcgctttctttaaacttgagtgtataattcttagtgtgtatgggagaaaatgatgtatatcgacatgctttggaatggttgaacatgctatatggttgcttgtgtgctatggactatggttggttgattaccactgggacatggtgctaattgatagttctctatccatatgtatatatcagctggtacaatggtagggacatcaatactgccctattaatcttatgtattccataatttttgtattttggcccttttttatggaattatttggtcacaattggatatgtactaaagttcatgttatggaatagaatttatttctcttttaaataaaagagatagagtggaattcatagtttcatacttccaatatagatgaatcggcatgtcttacacatcagataatcgaaatgaaacaaaaatatgttactctttcgttccagaactaaagtaaatattgtgttaccttttcattgtaggtaaatgctcgctgtgcaatgaaattgcggaagagaatacaacatgaagaaatgaaatctgcctaccaacgaagagtatgctcctttctatgatctatgatttgttcttcttttatattttgcaaggatgaacctggttaactaggctcccacattcttttgctacttttctatttctactgagacgtctgagaacgcttgagtagatttagctcattttgttttatgtatcagctgctatctgatgcagaatcagtacgctggttaaattatgcaataaaaaagatgtggcctatctgtatggagaagatcgtctcacaacttctacgacccataataccatggttcttggataagttcaaaccttggacagttgtacggtttccttcttgcctcttgcttttgcaattgatgagattccactatatgaattgtaccttgaagttctagttttgccatgaagttctataaatttatttttatttctttaagtaggcattgccctcaatagctcaactgttgtagttatcccgcagagtaaagcaggagttcaggagctttatatgggcaggaattcaccactgtttacttcaatgagagttttacctgagacatcagatgatgaccatttggtgggtactaatgtcttctgatttgagtatttctttttcgtccatggtaaaaattgtaatgatttttgtgccatctgatggccaggttctggagatagggatgaattttctatctgctgaagatatgagtgctgtactttctatgcagctgcataagagtgtcggacttggaatgactgcaaacatgcatctgactagcatgcatgttgagggaaaggcaagttctacgtttttaaggggatgcaatttatctacttagcttcattattctgtcactaacaagatcaacttaacatactattagaaataatcaacttttaaagccgttacagcacatggattttcaagttctgtgttgtttatatctaatggtaagtttgatttcggagatactacactaagtccaatcactagatttatttgtatcttttacagtctgcttcattaggcacacttaactttttcaggttttttttcagtctattttgatcttgaaatcatccaagctatttgtttgtggttctaacgaaagcagacagatatttggtgctgagacaagtatggtgtatttccctctaacataagaaagctcctttcatcctaagtggattgaaatttatgttatgatgatgttgcctctgatatccaaatagtatgtgaacaaactatacagattaacaagatacacatattgcagaagtctcttgatcttccgtgttcattatactcaaattaacatgttaactcaaaactacatgagtaacataattctcccaaaaaaaaattgatgacataatttttttattaacctcttgctaaaaaatggtcaatgctctctactaaccttgcttgaaaaaaacagataaggacattgttgacccagcgaaaggaacagaaaaaaaatccttcgttatcttaatggaggcaaagaaattctaggcaagcaccattgttgcttgtgtaggttgattgtgatgctaaccaaggaaatggggacttcatagtcaagaaaggagatacatattcttctcagttataagaaagtatgatagtaaagggagatcatcatctaaaaatgtaagagaggcactgaactgtttgtttaactaaatagtattgtaatatgccctcctcagcatatcaggataaagagttatagagtattcgcatatattcgttcattaagcagtttcttcccccacattgtactcagaacatgcatatgttcatcaagcagattgtagtcggtgtgaagtttgtccggagttggccatttattggccgtgtgagaatatgttttgtggagcctctattatctcacgatgactgtaaagccactcattggtcatgggcttgatgtcgttgagtttccagcaatttcaggatggcaggagattctcctgtaccagcatggtcgtctctgcaatgttagtgaatttgttttttactgatcactcggccccttggaatttttccaggataagttgatgcatactgcatttgggcagacattagttgaggttagatttttatgaacttagggtgaaggctgttcattgtatattttttccttgctgatgcaacttttcttcttccagcccaatatgcttgttatcgatgtggaaaaatttgtatcgactccctcaggtaggaggaagctttgctttctgcttgtgtttaaggaatcatcctttcattcctgttgttttcctttcaatcctcctatatttgtgttagcttccaacaattgtagggttagtctattatcatatgaatcggcctctttagaccacttgctttagccaagtgttctagcaaatgctaataggatacgccccttcaaaccctgtcattgccttgtgttttttaacctacctttttttagaaaaagagtatttctctttctaactttctctgatgacagacttccagtcttgtttcaagaaaaaatatgataaccattattgctgtttactttgcattaacttcttcacattctgcagacaatgactggttcagcattgaggagagacctcctgttgcatatgtgaaacttgagattttagaaggatccgacatgaaaccatctgatatgaatggtgagaattacctgcattaatgttcatgttgcccgctgtttgattttgactcaccttacattccattatatagggctctccgacccttatgtgaaaggtcgtcttggtccttttaaattccaaactcagatacagaagaatacactatcccctaagtggtttgaagaattcaaaatacccattacatcgtgggagtcattaaatgaacttgccatggaagtgtgtgataaggaccacatgtttgatgactcgcttgggtatgtcctgtttactgaactcgtgttgctaaatggtcagctatatttggcatcaactcattgctgtattcagtttaactttgtaaaagatgacaacttggcacttattttatctcagcctcagagttagcctttctgatgttttatattgaattgacctatttggtattttatactagaaaaaaagtgaaagtacattacacttcattttgtttacagaacatgtactatagatatccatgagctgaggggtggtcagagacatgacaaatggatatcactcaagaatgtcaagaaaggaaggattcacttggcaataacagttgaagatatatcagaggttggtgataacatttttaatttttttttccgtatatttttggaacatgtaagtagtcatttcatgaaggtagggaagttgcagcaaaatgattgatagcactagacacatcctcttcatcagaatattatctagtaaaacaactgttgagctaaactatacattatgcattgaaagcttttaaaaggaaactgcaagtacgtatttaaactgttgaagttcgcccctacctaaactcattcacaattgtattttcaggagaaggggttggaagaatcatcaaggaaagttgatgctgaactaccaatatcaacatccgtcaacaagtttaatgctgatgaactgcctgatgaaaagcaagtcttagtagatgaagtggagcacattaacattgatgggcaagaacaacctggaggattatatgtgcatcgccctggcactggagttcccaagacatgggaatcacggaaagggcgagcacgtaatcctgacacggagatttacaaagaagttgacaaatcaaaggatgcgcctaccccaaaaagcagtggacaagggggtttttttggctcctttttccggaagagcttgaagaagggaagtttccatgatattgatcccggtattcctacaacgccagggcctcagagtgcaacagagcttgatccgaagatcccacaaactccacgtccaaaccttaaggaggccggtgaaaaacggacatcgataaagatagtagtcgatgaagatgcgaaaccgacaaggagtgcgggagatgcagagaacttgacagaagatgtagccaaggtgatggagaaaa

SEQ ID NO: 67854 - DNA, 2520 bp, Oryza sativa
cgcattcaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggatgagtttttgtcagatgaaggtttccccgaggagtaggcttcgtccgtgccgtcgaggatgcctgtggagtggtgttcccgctgcagtttagtcaaggcttagctccagttatcttttgtttccgctgcatttttgtaagacttttatgatgtttgtaagacgtggatctgaatgtcaacattgtcgtttgtgtaccccggctggtcctggacggggattttaatgcacattctgcttggaattctattcgggaatttctgggcatgacaagttggtatcagagccgaccttgaccgtaggacaagccaaatggaaacctaagagccctctgaatccttttcattgcatatattctttgcaattggatttgttccgggaaaattgggatctgttcttgtggttcgagggaaaaatcttgtcgcttgtttaagtgggattttttcaaaacgagtcagtctagggttttagtaaaattattgggatttattcgtcagtcagttggggtttgatgggtgaaatgcattaggtcctagctctataacatgggttgcaaggtgtttatgcttcgtttgttattattaatatgtatctaattctcattactttgtcgttatatgagtctgtcttatttattcgctctcatgcaaaatgatctatgcataaaatttcgcttctattcgattctcttatttgagtcttttattgctttatttaaatttggatttgagcatgcattgatcctactcctttgtcttctctagatggccggtcacccacccaaccaccgcggagaaggcatgatcgatttcgtggcagagttagcacgtatgacactggtggtgggctaccccaacgcgccggagtacacgacgattccgccgctcagtggcgagcttcctcaccgtgtccacttggaggtccatggctacgtggggacttgcctcgctaacatggcggtcgaggcatctggaggcacagcagatcacgcctgtcaggaggcagcctacttgatgatggccagaatacgggagcgccacgactacatcttccacgacacggcgtaccgctaccacccccgtcgagcccatggtgatggcgtcagctccttccgtccgacagctggcgagaacgacaccacctttggtcacatgtgtgctgtgatgagtggattggacaggatgcactcggacctgcacaaggcgaccaaagccttgaacgatgggaagctcatgaggatcgtcgccctgaaggacgagatagcgcgcctgaagaaggagaacgctcagctaaagggtcttccagcgccaggaggagtccggatccgcaccacgccccgcaagacgacgactgcacctgtgcgtatccagcttgcgcccaggaacccacctccagcagcagctcccgcagcaccttcagttccgcccgcagttcctgcagctccagttccagctcccgcattcactctctccttcgctccagcatcagccgccagaggtccagccagtggtaccggaggttggttgtctgctactcccagtggcagcggcgagactgatctgtcaggctccaggagtcgctcagagggaccgggtgacgagcaggaggacgctttcgactccaccgaccgcaggagccgttccgagcattaggctcgtttttcccactagtttatcgatggtctagcttctggttgttagtttgcgtgtttaggctgcttgtttggggtcagttgacggttgatatcatgtgcctatgatatggctgtcttaataaggatgtttgcttgctcttttaagtgtttttaattcagatcagaacaattgcagttttaattcctttgtaataaagcttagttcttgagcatctgtttttcttcttttccccccgtctgcttttccctccagatggtctacaccaggactggcaaccgcacgacaggcgagggcagcaacggcgaagaacgcgtggatggtgtgcaccccaacagtgattctggcaatggtccgccaccacttcccgagaatccgacgcttgcccaagttatggcacatcagactcagatgatggcagccatgatgcagcagatgcagcagcagcaccagcagatgcaccaaaggatgatgcagcacgccgagcagcagcaccagcagtttggtccccctccccctcagtccaagttgccagagtttctacgcgtcaggccacccaccttctccagcaccaccaaccccatggaggcgaacgactggctccatgccatagagaagaagctgaatctcctgcagtgcaatgatcaggagaaggtcgctttcgccacacaccagcttcagggtcccgcgtcagcttggtgggacaaccacat

SEQ ID NO: 67855 - DNA, 8347 bp, Oryza sativa
ttccacagtaaacacacaaagctacctgcgcaagcgctccagactatccctctgacttggccattctcgtgctaggggctagatatacttgggccattcccatgaggacagggcggctacagattcctattcgtggcgatcgataaattcaccaaatggatcgaagcagtacccacgggggaaatcaaggccgacaacgccatcaaattcatcaaagggatattttgcagatacggactaccacaccgcatcataactgataacggctcccagttcatcagcgctgatttccaggactactatatcgggctgggggtcaaagtatgcttcgcctcggtctctcaccctcaaagcaacggacaaatcgagagggcaaacggcatagtactacaagggatgaaaaccagcatctacgacatactcatgtcacacaacaaaaggtgggttgaagaactcccgtcagtactatgggccgtacgcaccacaccgacaacgtctaataaggaaacacccttcttcctcgtgtacggctctgaggccatgctcccaggcgagctacaacatcagagtacacgagtacagaagtactccgacgagaaccaggaggagcagcgagatatcgatgtaaatcttctcgaggagcatcgggaacgagttgccgtctgagcagccagctatcaacagaccctccgctgttatcacgagaagcgcatccgtgcacgcatactttcgatcggcgactatgtcctccgatgagttcaaagccaagcagggcgaaacaaactctcacctaaatgggaaggaacttacacgatcacacaagtcttgcggccaagcgcattcaaaatcgcagacggcgacggtcgtgaattagcaaattcttggaacattgaccaactacgtaaattctatgtatgagtcaatatcatccatacatgtaagcacccttacagtatcaataaaggctatttctaggcccatatcacaatcaacgtgtttcgcccgatgatcccccactctgatgacacctagcgttgaaacctgtccttatgtccctttacgccgtctcgacaaggcctccgaggaacctaagggatctttggctggggacgcccaaagccgataaggccttgtcagatcctgtagagacgaaagaccatgtaagatcttgtcgtgtaagagttctcgccgtgcgtattaaccaagccgtgaaatcggaaatcaactttccaacttcacggctgggggctaggatcagagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagaggcatttgtcaaagatagatttctttattcacaaaatactccttacagttttttcacaaatcttttgctacattacatctttttcctaagatatttgtcacaaggtacgagtactaccaagagggccaacgccagtccatagactggaagatcttttcggccaacggcgacattgaccttgccagatggtctatctccgccgaagtcctccgagaacgagcaaaacactcacgaaggtgttcgagctccaggtgcgggcgataatctcgtaggcaagccaacacgtgccccccggcataccggctcgatcgacgacactcctgcttcaaggcctcgtcgatacgcttgtcgattccatcgagttgggcacaggccccattaagccacgagatgtacccggccgctgactcctcgggatctccgcggactacttgaagctccttgcatactctggccatggatgtgcagcaaatcttcaagtacgagttaaaccatacctcacggcctcggagcgtttccacagcctgctctttcgtcacggccagcatggttctctcgagctccgccacttcaaacttcgtcttccagtattggatacgacgatcttggctagcaagggcaccctcgatatctgctaaatgtgataaccactaagtcaagctgtacatctcttttggcaacatggctgacctagtcaggtgggcattaaggggtgaagggactactaacctgaggaagtcgtcgccatccttccctctatatcaaggggttgatccacatggtcaggcgagacgtgtggttcgaactcgaataccggaattactgccagtgactcgggctgcccacgctgctggacatcctcgtcatcagtatctctacaagaggacaaaagttcccgaggtcagcatactaaagtaagccgggatagtaatcgcatgcacaaagacggtcagagttcgagttttacacattatctaggaaatacaagaagtcctactcttcaaaaagggggagaacagactctcccagatcaccgatttcttccatcacctccttacgcgtgtcgctggccgccccctggtccaagatctcgcgcagatcaagttcaggacgcgacagccttacacacgcgaggacatgacacgccccggtgtagattccgtttgacgtctcctccgcaatcctagctgcatgcttggaggggatttcccccattgccgtcgccagttccgcgagagaggaggtcagcgaaaactcatcgggattcgccgggatcgtggacgtgacgccgcataccccggcgagctggtgaaggccggtgtaggtgaccctcaacgagccccggatctcagataggttgttcccgagttctgacattcggtcctcgagccccttccgttgtcgctcgttgccggtcgccaactccctcatcttcgtgaggtcttcacgggctttagccaactcgcgcacaagtctgtcagcgcgttcgccgtcgccgcttccgacctcgcctccgcaatctcgcagccaatgccgcgagcaccggcttcgaggaggcgccccatctcgacttggagctcctcccaggtgaggactgcagctggcagatcacgacctgccgcggggtcgctgactgggccactaggcgtcgcctcccagctcccggctgcgggcatgacatccgtcgaggccacaaggggcgacgcactagaagctcttccggacttggctcgcgcagcctttgctcgcgcctccctacgggacgaccacgagtcagacaataagcgaataagaagcgcggggattcaagaattcatctacttacttctcgccaatcgtcacaatgcgttgtcgtcgtggaggtgggggagatgcatccgaggcctggaatacaatcaacgcaaagtaaggaaaaatccttcttgctgcatgatttaacgacaaaataaattaccgagggggtcgacaccatgcgacgttgtccgcttacagacgagaatttcctcggctttatcggaacattgccaccactagtggtggcagcatcagatacctccttgacggccttcactttcaaagatgacgccacctgatggtccgcgagcggtccgatgatatcagtcaaaggaagggcctacgctcaatcaagtcataaagtgatttcgaaaggagaatgcgggatgttcaccaaatatacttacgttgatggcttcatcacgttccgctgcccccttttcacaaaggggcacagggatgtcactcgccgtagtcgggccgctgatcatcacttggccgacgcggcgctccacgttttcgccgctcagacctgttaatcgagaaccaaccttcgataagtcaagaggaatgcggacacaagtatgtcaagatgaatgcgagaaagataccccgaggagaaacccgggtcgcgtcctctggcccggaatagttataagctggatgggcccgagcctgaagcggctagatccgcctaccaacgaagtctgcaacgacttcatatcccgacaaaccctgtactcagagatcgtcgatgatgtcgagaaacgactgaagagagggggtcaaggggggcttggcggtccaagacggaatcttgtccggttgatcttcgggaaccacgaagacagggttcgagtccttgatctcaagataaaaccacctattcctccacttgctgcgagaagaagggcactggaagggaatgtaacgcaacttcaggccatcccgaagtcggaacccaacgcaaccagataccctgttggattccatccaacgcagttcgtagtaaaagcaaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggaggagggagaaaaccgcagagaacataatcttcgatcgcaaccatgcgacccaagatgggctgaggattagtacctcctacttccctctccatggttccacagccaggaagagcgccatcctcctatagtttctttaacgttgcactggtggaagccgatttgccgaggtccattgctgatcgaaggtcgccggaaaacgagcctagattgatgaactagggtttcttgcggcggcggagaaggcaaagagtgcttgcagtggggtgtgtttaacaggtttggcggacttcaaaatggactcccaaaattcctttaaataggcgcactaccgacggtgcgaattccagggaatagagagagatgcccgccggaaatttctggtcccattacacgcggcggttttttggacttcagtttaaaattcgttcgtgaccgttgggcttcaaatggcgtgctcgactacggtctatctccgcggtcctcgcaccgggaatgacaacagtctcgacacccgaagtcgcaaatggttgcacgagttcattttaagcagaagttgggggctactgtcagggttacaggttaggcataccctttacccttcgatatacgtcacatatcggtatggtatacctacacgcatacggatgcttcccgcgtactctaaggaaatccttcacagagtctatagatgggaagaatcctactcggacaagattgggtcgttaatgtatcgtacagggtctgacatctccgagttctacttggagacctccagatctgcgatataaaagggaccccccggggagggcctaaggcatcgaatctcagagccagcacaacccacacagcctacgaagccagagcctgcagggagccaagtcatcgggatctagtcgaaccaactcgactatgatctcgccggatccgacaagttcccttgttctctttgtaacctgtgttttctaccatataatcccacatcaattggattagggctattacctatcaaggggcctgaaccagtataattcttgtcttttgtttgcttgatgacgtactacgtagatccttgtaccaatgtaccccaataccctctatatccggtctacgggtatcacccatcgacagacaatgcccccctgaatcatgcccgatagggttagcgggcaaatctttctgcccgtaccccgatggatacccggagagcacccgacgctgacgatctgagaagtgcctgtcattgcttgcatcatcgctcgccgccgccgagactctactgatgctgtcgataggagagttgactacctgccgtggttgcgttgccgactctgtcgcctgctaagccccccgccgtcattgactccgctggtaccgccgcttgctcccgccacttgctcgtgctaccactgccctgagagccgccattgttcccacttgctcgtgcattgccttcagccgccatcgtcgttgcttgcccccgcgctaccttgagccaccgccatcgtcgcttgccggcgctgcctccacatgttcctttgctaaatgtgctgtcgtcgccactgcgttgaagtgaggtgggatgaaaattaggttatggtttgatgttgttggctaatgggccaagagagagatgagaatgaagatatgggccaaaatcaataatacatatatcgggtcgggtatgggttatccgcgagtaaaaggtaagatccggctgctgcccactacattatcgggtctcgggcgtgcatgcctaagggtaaaatattgcacccatgcctgtgcccatctggtcgggtaaccgcggatacctgaacccgtgagcaaaattgacatccctaattttattctctagctgcttttcctagctttcgtattcatgtgaccatgcggggtctcagtcagccaaaaaaatccaccgtgaaaaacagtcctgggggtgtaaaataaattaggtacatcatgtacggaaactgctatttcgcggctagtcgcgcgcgccctccccagcgtgactggacacagcgcgcacggggaggagggtggcagacagccgctcttttccttttttttttccttttcccgtttctattgtttcttcccctcttttccgtttctttttcgctttttcggttgtttttttcctttctttcgtttctttttcttttttcggctgttatacaaactatgtatacacatatactaagtctgtatgtatgcgtgtacaaactttatatacacatatattttttcgttttttaaacatacatatataaaatatacaaagtttgtatagtttgtatacatatatatatatatatatatatatatatatatatatatatacatatatacatatatatatgtatatacatacatacatacatacatatatgtatgtatgtatatgtatgtatgtgtatgtatgtatgtgtatgtatgtatgtatgtatgtatgtatgtatatgtatgtatgtgtatatatatatatatattatatatatatgtatatatatatatatatatatatgtatatatatatatgtatatatatatatatatatgtatatatatatatatgtatatatgtatatacacctcatattgtatgatacgaagtttatacgtacatatttaagacatatatacatacctatacatactgagactagagggctagcgctggtcgcacgggcgtgccgggcgatcagccatcccccatcgtatacctgggcagtgctgttaatgtccgcgaattaaattcgactcatatacgaggaacctaatatgaactttattttcctgttgcgagtgtatcccagcccatgtaagacgcccgtagcccatatcctatctcaaagcagtcagcgcaggcccgcatgctatcgcgacgtgcgtcctcaatccccttcgccttcccgtctgatgccacaaatcaaagccctcatcctcttcagttcaccgtgaacaccatctatggtggaccgtgcacggcctggccgattcctctccaggagtgaaaccgtcgcaatcaaagtgcagccaacaagtgtccgtgtttaattcttttcacttaacgtatgcttttattcttcaatccctgtatatcatcgttgacccttatacttttatcaagtgtacggacttactccctccgttctataataattgacgttttggacaaagttacggtgaaatttttataactttagccatcaataactttaaaaatatttagtttagagaaactaaaacaacatatatagatttgtttttcaaagcaccataataataaaagtaaacatgcatttatttattgtatatattataatagaaaaataaggttaaaggtatattttgtagaccgtgttattattcaaaacatcaattaaaatgaaactggagggagtacctgggttagcagctatcagcctatcatgccctcaccaatttagcacgacctagctccctccgttcttaaaaaaaaatctagtactccagattcatagtattagaatatatcacatccagtactagattatttttttatgaaacagaaggagtatgcccccaagaacaggcacttgcacttctgatactcatgtaggatgtagcttatgacatatactttgttggtactttgtccccagtatacttacatgatcttttttaatgattaattgatcatttcctacaaccagctctcatgtatattactatcctatctaactgactatatacacaatgcagtgttgggcaccaaagcaatatctggccatgacaccggttcacagccgtctgtcactggccctgtttgatttagcttaggattattataatctggattattaggagtaagctgaaataaacaagtagattattacgatagattattataatctataagccagattactataatctaataatctcctatggatgagctttttccagattattaggtggctaaagaccca

SEQ ID NO: 67856 - DNA, 6969 bp, Oryza sativa
cgctggcgatgtgggcgacgtggcccgggagagagcgggaccggcggttgcggggtgcggcggcgccggctggaggttgggagaggacccgacaggtgggccccacctgtcagtgaccccgggtgagggaggaggcacgggcgcttgctgggccgtggccttcggccggcccagcaagggcgcgagagggaaagggaaagggaatgggccggcggcccattaggaaaaaggaggggaaaaagaaaaagaagaagggaaaaagaatttccagggattaaataattgctcgtgctcatttttaattggttaaaattatttctagagctctgaaaattccacaaaaaatcctgttagcatattttgacatgtagaactcaagaaaaatcccacatgtcgattccgattattacttgcattaattcaattagggtttctctcttgcattaacacaggtaatttcttgcgaccacttattaattcaatttaggcctaggagaagaacttcagggtgtgacaaacctaccccccttaaacggaatctcgaccccgagattcagaagagctggcgaagagatgcagatgggtagccttcaactcatcttccctttcccatgttgcttcttcctttgagtggtggctccactaaaccctgcagaacctggtaaccttgtttctggttcttctttcactggtctcaaggatgcaaactggcttctccacataagtcagatcttcttgaatatcgatgtgctctgaatcggcttgttcttctggtaccctcaatcacctctttaactgaggcacatggaacacatcatggatacccgccatgttggatgggagttctagctgatatgcaacttctcctctttgttccaagatcttgtatggtcccatgaagcgtggtgccaacttgcctttcgtctggaaacagtgtactccccggagcggagtgacacgaaggtatacataatcccctgcttcaaaagtgagctctcttcggcggttgtctgcgtagcttttctgtcgagattcctttctctaatagttctgactttctcctctgcctcagttagcacttctgtcccgaacagttgacgttcgcctgtttgatcccagaagatatgtgtgcggcacttccggccatacaatgcttcaaagggtgccatttgtaaactggcctggtagctgttgttgtaagagaattcagcataaggcaggcttttatcccaagctccgccaaaatcaagtgcacaggctcgcagcatatcctccaacatctgattgaccctctcagtctggctatctgtctgcggatggtaggctgtgctgaaattcaaacaggtccccaattcttcttgcagcttctgccaaaattttgaggtaaactgactccctcgatcagatacaatcttcttaggtaccccatgcagacacatgatccttgctaagtacagctctgccaatttttttcccgtatacgtggagttaaccgagatgaagtgagcaaccttggtgagacgatcaaccaccacccatatggaatcatgccctgacgatgtccggggcaaacctgtgatgaagtccattccgatttcttcctatttctactccgggatctagaggggttgaagcaatcccgtgggcctctgatgttctgccttaactcgctgacaaacatcgcagagcgcgacaaactccgctatttcccttctcatgctggcccaccagaatttttctttgagatcctgatacatcttggtactgctgggatgaatagagtactgggtctgatgagcctcagtgagtattaggtctttcaactctttgtcatcaggtacgcacaatctttctcccaaccagattgtgccatgttcatcctcgtggaaatcccaggcttttccgaccctcatattctttttcagctcagctatttcatgatcatttacctgagctactcggacttggtccacgagcataggccgtgcctctagggcagtcacgtactgtaacgccccgattttcgttcgggattaaaaatcaattaataatgcatttctagaaattatattaaaggttaaatcaatttaatcaagtgaaattatagaggaaattaaattttcctttaaaaaaatcattggccgggaatattttgcaatattctttgtgccccaaaaatactctccggatttttccgcaaattttcggagctcaagaaataattttaaataatcttccccttcctcccttttgggcttggcccaagccttcccctccactcccgtgggccgcgcgcctcctccctctctcggccggcccgcgccttgcgaaagtcttctttacgttccccggttttcctcccctcctccttcctaggccggcctcctccctcggcccactcggctctctctctccctcaagtctgctttacctcactcgcccgttttcccctctctctctccccgacaggtgggacccgaggccccacctgtcatcttcatcccttacctcccgtcgccccaaccgccgccatggccgccaaatcctcccacgtcgccgcctctcccgcgcgactccctctcccgcgcgtgcgtggacgcggtcgtgccccacgtcggcgccgttttcccccactctccccacgaaaatcggcgccggttaacccctccaccaccccacgtcggcgccccacttcgccggccgattccgccacgtccggcctcgatcccgccttcccgagcccataaaaagcacccccgtgctcccctcgttcatttccccttatttcccgggcccggcactctctccctcgctctccccacgtcgttcccgcgcgccgccacactccggcgaactccggccgccgtttcccgtcgctagggtcgccgccgcactactccgccgccaccgctggctttgccacctcaagggcacgctcggccgccgtttcttcctccccttccaccacgcgaaccacctctccaccgtgctcccgctctccatcggtccccggcgagctccggccacctctagccgccgccctagccactgccgcgccgcgccgtttgcaccaccggcttctccgtgcctcgccgcaccccggcctccgctccgtttccccatttaatcgccgcaaccacccttccaccgtgcatcccaagccacctccaccctacgccgccgggccgccgttccgccttcgtcccgaggagcgccgacgccgagctcccccgcctttccccgcccctcgtcgtcgcgtccttggtgagctcctcctctccctccttgcctccctcctctatctcccgtgcgtgctgccgcgccggtggccgccgccgttaggtcggccggccggcttgtcgctgccccgctcgcctaggccgcccggatccccttgccgcgccgcgccaccgctttcccgcgtgcgtcggccgtcgccgcaggaggctgcgccgccgtgagccgtcgttcggccgggccggcctgagctgtgcccgtgctcagccgcgccaccccgtggccgcccgatcatgtcacaccctaaaaatccaaaatatataaattgttgtttaaatggaattattagattttattttaaaagcctagaagagaagatttaattttaattaataaattccaacataaaatggggccagataaaatttcattaaatactttgcttaattctataattcctagatttttctgggatttatttgagctaaggaagtatttttaataaatggaattgcatttaaggaataatttaaattgaaaaaggtttttaaaagtcttcttttggctttgagccgaaagtcggcccaaaaccctctctctctccccggcccaagtcggcccagtccgccgcagccgtgcgcgcgccctcgctcgctgacaggtggggcccgcctgtcggagtcgtcatctacctccggccgccgccgcccgaaaccctagcgccgcgccgtttatcttttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtcacaagttggtatcagagccccttgaccctaggttatgccaaatggttacccatagaagccctctaaaaatattggaaaagtagaactgttctcctccccttctcttttaattaaaccaaactaatggcacatgcatttcataatctcttttaatggttctcattcaaaatttattccagtgttattagtactgtacatctattactgtactaatggctcaattaccagcaaaagatttacaatattgttttatttaatcttactgcaacgaaataaatttagcatgttgattttataactttcttttatttcttttggaacctgttgttcaaaagtacaaaatttgtgaccttgtttccaactgtttcaacttatcttgcaagattggtttactttatttacttaccttttactttgattttcgaactttattcaaattaatccaaaaccttgtgctattaattggataaatgtcttaactccctccttacacttgtctttagatgccgcgctacaagcctgagtacttgtttggtgttgagggatttgtccaggagttgcgtacgatgtcctttgtcataggatttgggactgctcctttttatgcccagattcctcatgatcgtcacgaagaaaagtgccgagtcaaagtcaccttgaacagtaatagtgaagatatcccctcagtgatgttcgaagctggaggaagaaactatatccatgcatgtcaggaggtggcaaggatcgccataggagagctccgtgatcgctatagtgatcagttggccgacacggagtatcgctatcatcctcgccaaccacaaggaagtgaccgtggcagttaccttgagactgagggaattgagaatgatgctaccacaaggcatttggttgatatgctgtgggctatggatgaaacccgtgcggagactgtgttagcagctcaagatcgtgaagaccggaatcgtggtaagatttgcaagctagaagataaagtggatcgtttggagaaggaactagccgcgttgaagggagaagcaccaccgcagaaggccagggttcgtcttaccgcaagaaagagagctctatttgtccctcgctaccaattggcgccaaaggtccgtgtggtggaaaaagaagttaccccagccctagcagatcctccggtcgtcaatgtaagtgatgatgaaggagaagaatcaaagcgtacccattccaagattgagtggggagctactcaagatgatgaagatgagccgaacgagcctttaatcaactccgatgctcggaagacctagaaagccttgtcaaaccgttgtcttagatcgttgtgttagcttgtttgtttaagtttggttgtgtgtgtctcgcgtgtgatttacatcagtggtgggatgtaagtacatgcgtttgtttgctttcaagtgttaggtagttggtgagtttagtggtgtgagagtcttcagtttgtaataatgaaactcacttaagatcaataaaagttaaattaattttctgtcctaagtagttttccccggtttctcttcttgtgacctgtccatgccagatggtgctcactcgcagcaacgggaatggccccaacaacaacaataacaataacaacaacaatggagagaatcccacacttgcccaagtcctggctcaacaggcacagcttatgaacatgatgatgcagcaactccagaaccagcagaaccagggaaataaccatgcacctccccagaacaagttagcagaatttcttcgtgtaaggccgcctactttctctagtaccactaatcctgttgaagctggagattggctgcatgccatagagaagaagttggatttgcttcaatgcactgatcaggagaaggtctcatttgcatcacaccagttgcatggccctgcctctgaatggtgggatcacttccgcttgaataggactactgctgaacctatcacttggcttgagttgaccgctgctttccggaagacgcatataccatcgggagtggtgtctctcaagaagaaggaattcaggtcgctcactcaggggtctcgctctgttacggagtatctgcacgagttcaatcgtctggctcgttatgctccggaagatgtgcgcaatgatgaagagcgtcaggagaagttcttggaaggacttaatgatgagctttcttacccactcatgacgggggattatcatgatttctagaagttggtggataaggctattcgtcaggaggacaagtacaatcgcatggagcaaaagaaacgccggattgctcaattcaagacacaacaggggaataatcagaggccgcgtcttactttgggaccccagtccatgccacagggaggttcttcgtctgttgttcgtccgcaacgtcagatcttcaacaacaatgcaggcaacaacatcagcaatcaagctccacgccctgttgcagtttcgacacagcaacaacctgccaagagggagcaaggcagcaagcccgtggtgtgtttcaactgtggagaaccaggacattacgctgacaagtgtccgaagccccgacgcgtgaaggttgtccctacccagagcaactctaccgtaccagtatcaaaggccagtgtcaaccatgttgctgctgcagaagctcaaggtgctccagatgtgattttgggtacgtttcttgttaacttagttcctgcaacagtgcctttcgattctggtgctacacattcattcttatctatgagttttgcgggaaaccatgccatggaggtagaagatcttagacgtcctttgatggtta

SEQ ID NO: 67857 - DNA, 892 bp, Oryza sativa
aaggttgttatgtcctcgacatgttgtaatgtgatgcataccccgttaatgcgacatcacgatgcaatgcggcaatgatcaaatggtatattgtactttttaccttgctttgtgtcataggaaagctgtactattaaggggggtgatgcatagacatataaggagtgatgcatgtgctcaaaatctttttttcttggaagcatttctctatttggtttgttccggaaatttttggaagttccgaaaatacacagaaccgattttaacctcctggaaaattttggaagttccgaaaatatccgcgagccaaatatgcttctgcaaattttcggaagtttctgaaaatgtttttcggaagttccgaaaatccacagaaggtattatgggttctggaaattttcagaaatatccgaaaagaatttttggaagttccgaaaatgggcgttgacttcgattatcctagatctggaatttttggaagttccaaaaattacttttattgcgctccaacgggcaaatttgtgctgtgggtataaatacccacctcccctcacttgtgatggctgctgatttcattgcaaatttgtgtgcccttggcttgcatctctctctaagtttttgagcctctttctcgattcatctctccactcgggtttaattcggatttggtttttaaattagcctattcacaccccccctctagacctaattgaccatttcaattggtatcagagcctaatctcctaattaggcttaatcgcttggagagatcatgtcggattgaacgggggatggcaatgatggtgataagggagctaggtttccttatgactatccctccacatctacatcttatgtgagtacctatagcggcaaagcttcatacttcaat

SEQ ID NO: 67858 - DNA, 13917 bp, Oryza sativa
ataggattaggctgttagggtaggaagctgtgcaaccattgattacttctttctttttctttttgtccaaagatgagttagtagaaggaagcaaaaccagtgtagcctatgtcaatgttgttaatgaattgtaaattgaggtgaaatggttgagatctgtatcgttaaccttgtaaaaggtgtcctgtttcatcatagtttatctgggtatttaccagttcacgtaaccttgtaaaaggtgtcctgtttcatcatagtttatctgagtatttaccagttcacgtattaactttgcactggtgtaaacaaaaatatttacatcggtctaacgacaatgataaacagatttgcgacaaaattattttcatagatcgattgtacaccaaaatgccattccattctgcaagagagatgagctgaacggattacatatggactcgtgcaaatgcatccatatttttctttattcttcctttatttgtgcactaaatttagttatgtgcacatgttgtaacacacagtttataaactagaaatcccatcttttcttgacattgaacattatggctgaattctttacattgtcttgtggaactttaagcgtcaactgaactttagccttcataggcacctccttcgtcttgccccctgcatctccaacctgcatgccaggacgcaatttgcgtcaacttcttacagtgcaaaaatatagcaaggaaaaattatttggcacctaatttaactgaggtttgtagcttatgcagttcatgaaatgctagacatactggaaaaatgctattgctaatctatggtctcggttgttttctgatgaaaatgcgatctctgatgttgacattgaaaatttgaaatataggtgaacgcttacccaaagagatgcccatccaagcctttggtcagactcataaccagctttccacttgacatgcttactggccttgtgtttatagataaaactccagtagtttgtgtcaaactggtaccggtagctgaaaatggtaaataccatataaacatattagcagggtactcaagcttcccatagtgtccagagctaggcattcttataggtgtgcaatctcatccataaagcatgaacagtacataagtgtctagattgagtttatgttacatttccttagttttaaaaatgagttttatgggtcaagtcatcccaactatataaggatggattgtctctcttttcactaagcgataaagatgaattaatctagcatccgcgaaggttcttcatccttgttccacagtctcctcaagctaaaagatctatccccttcagctttgcttagctaggtgaactaaggttcatcacatgtattgtcacatatggtgtttctagcatacacaactatttcaagctgtattggtgacgatgacttgcactagagcagcttaccttaacttgtctgaaggagtgaattggcgcttaaatgcaaaggatagtgaattggatggtaaagagaggcttggaataaatgataactcttcatcctataaaatacaacaaatatccatcatgagtggcacagtaaaataaatgtcaatggaactgttgtggggcaggaggccaaggcccatgacagaaacgaaggccagctgagagatgcttaccttgtaacgatattttatgttcatctcattgtcactgtacaatgcagtgcaaactccattcagaacatgagacctcactatgccgtttactgacaaaatcctgtcaccttcatccaaatatttctgcttaactgaaacttcaccattgggaaagatgaaggttgtcctcggctacatacaaataagatcaatgaactcatgcatggtgttttctagtttcacattatcaataacagcaagggctacagtgcatttccaataactattttttttcacttcatcttagtgacttggttgcataaatactgaccaatccatcaggtggaaccacagatgataactcaatcttgcatggtgaatcacccaaatttgctctcaccgccacttcccctttttgctcctaattaagagaacaaaaaatgatcacatatactatgcggtatcttacatgtatcatgaagacatatttctatagcacaacaaaagctatgctatataatagcaaatagatacaaattaccaacttattgttccatgttaaataattttggcacatacaaaggccttttatagactcatgcctttcgaaaacaagtataacgtatatgccacagatgtgtgacttccaagaactcatttcattcactaatttacaataaagaatagatagatgttcatattaaatgaccatcaccgcatttcatagggtcttccagaaaaaagaatgaaggcgtttctcgatggattcattttgactgaatgagtgactgactattgcaagtataaaactaaaaaaaatgtccatcaaattcaacaagaatcattgaagttcataattaagcaaattgatatcatttgatcaaattgctgctgagtaacaaccaaagagatccccacagaaaaaaaaaaggaacatacattgagaattcgttagtcatatggcaatttataaatgtgtttcagactttcagcagatgtttcttcaagttcagtcccaatgctaattaataatttcaagaatggatgggaaaatgcaagctgataaggaaactgctcaaaaataaaatcactgcaaacaaaacagatgctatcagaatagcttctccatatacataacacacctttctactgtggtacttcaattgaaagtacctatccaagtgaatacaagaaacagttgatttgtcatattcataattgcaagacagagacaaaaggtgggtcgagcagctgatatgaaaatatgattgctctccattctggcagttctgaaacataaggtagtctcaaaatctcacagtactgctttatgaaaaaagaatgagcatcaatagcaacgtaagagtttataaatcacgcatatttactgatggatctttacataggaatcattcaagcagaaaatggctctacaacaatgatttttacgataatgatatatcgaaggacatctgagaaactcaaaaggttacagtaaggacagaatggatgacatcaagttttaaagcactagtacttgatattcataaaatgcaacacatagtgcaatacataggatctcacaatttctagccagtgttccatatgtttcccaactcagctcaagaactccaaatataacaccgattcagttgtaccaaactgttgcacaaacttaaccaatacatcctaaacaaaaccacttgcatctgttggcaatgccaaaagtgctcatattatgcagaaggttcgactatagaaaatagttttcaaattttgaaatttacgcagtcatatcacaagtatgcatgattatgcccagtgatgtatttcggcacctagaatcaatattaactcataaagctaaacccagaaagcaggcctgcaaatgacatgtagactttttattcttcctcccccaacaatgcaagtatatctggtcctttgtgttcttcactcaacagcttacttttagctgcctactaaatctcaagaaaacagaatatttcactgacacccttttgcatatcccgtttctgtcattccggacaaagtaaggtcctggattaaattcctctgttcttcaaaatgagatgaatttatctgttttcccttctctttcataacccatatggctagataaatgtcaagagccagatgcaaacagcagcgaagacgcccaatcacatttcacattagggtcaatcgttcccagcaaagcactaaattaaataaatcaatcaagaggtggcaccttggtgtcgtgcttggcgctgaggcgaagcgatccggcgaggtcggcggcgccccgcagcatggcgcttcgggctacggtgtcgacggcgacggagaagttccgcgcgaggagcgcgacctcgggcggcggcggctccaccgccgccgccccggccccgccgaccccgtggtggacccggacccggagcttggcgaggccgtccatgacgcggcaggagaggcggtgggagaagagccgggcgtcgctgtcgaactccgaggtgacgcggacagccgaccgcctccgccgcggcggcggaggggctccctccggggacggcggaggggcggggcccgggaacgcgtggtgcgcgcccgcgctggcgtcctcgtccatcggagggggcgggggcggggcggagaggagcgccggggccgccattgcgcgcgacggcggcgagatgagggttgggttggggagaagatgagagagaaggtgggggaagtggtgtggagtggagtgaagaagacgcgtggcgagcgtttgcgtcttctgctcacacaaagatatggtatcgtatgcgtatctccaaattttttttcctttttttttcatcacacgaaataacgcatatgcgtacacggattgagatttcaaaacaccgtacctttattattaatagatgggtttatcattcatgacaaaattagatatattaccgaaagttctcgttttttggttttatagcaccgaaagtttctaattcattttattagctttcaacttcccaatccgttactatctagagcacttccatcatttacagctctattgctattagattgattaattctgactgaaccatttgatcctaccttctcattcactcctctttcattcccccgagtcaccgactagcacacgctatttgtgtattatttctgtaattgtgttctattatattctaacctaatcgatctaccccttcccccacccccagtgcgtatcgtcaagctcattccgtgtcgcatatatatctggatatccctctctaggcgcggcggcagcagcggtccgctttacccccaccgcaactgcccaccccttatgtcctgttaccactcaccaacagccacccatccatcctatcactagcagcaacgcgacgctgctgctgccaatcgatcatgttgctgttcattcttcatgtaggagaaagattaaaaaacttgttgctgtgttcagatcggcaacacataaactaaacttttgtcattctgtgtcgcttaacttagcttttgtcatgtatctgaatttccaaacaaattgcaacgacaaaacaaaagtttctgtgattttatcctgcacaaatctgcaaatgctagcactaggaaaatcaataagatgcatgtagcaagaagacatggacaactcatttaaacttcagttggagttcaagcaaaacactctctagctcagtacaaagcatgaatgattcaatcgaaagggggcagactagcataggtggaggccaagcaacaacacaggcttcgacgagcgaatgacgcgttaggagtggtgctcaaaaggtgagggtgcagcatcggcttcacgtcgtgcgccacgcgagggggagcagcgccagtcggggactcaggagagagaaagaggagagaattagaaggtaggatcaggaatgctctaggtaggctgtgtttagttcacatcaaaattgaaagtttggttgaaattggaacgaagtgacagaaaagttggaagtttatgtgtgtgggaaagttttgatgtgatggaaaagttggaagtttgaagaaaaatttgcatctaaacacggccgtagtaacagattggaaagttggatgctaataaaatgaacaagaaaatttcattgctataaaaccaaacacaaaaactttcattgctatatatccaattttgccttgattcattggacctacatgtcagtaacaaagacatgtgacttgtttatgacattggatctacacgtacacatcaccaaatcatatttacgctttcggattgcataaaagatacattgcaaacacaccacccatatccctacactcgcgatattatagacattgctaataaagcatacttttatgtgtatgttttttttattaaagagatgagtagaaacaattatggtgctagtaaggcttaagcccaagctcttagctctataatgttaacaccttaacaaattactccctctttcccaaattgatcatcatataagtttatgcaccaagaccaagaacaatttaaatcacatcaatcaagacactatgcacacatgcattctcccacaatacatgtatcgattaaggctattcccaaccctagacactagacatagtttccataaacttcacatcatcaagaaactagtactagacactactattccaatgcaaacaccactattctatacttaaatttaatgctacttatctcacatgatgtcttggatgttgtgtaaaaaccatatctcgtgcaagacatggtttcctctctttcctcgtttatttacttgtcacatcatttttcgttctaggtggtaacttatttaatgctatgaacaacatcctagtcattgggttgggaatggcctaaaaccttatgccaactacacccacatattctctcatattgcattaattatattctgataaaatccatgtccatgtagttatatgatgatcaatttgagaaattttggattctattacatgatgatcattttgggaatgagagagtactatgcaaattttggagatgtggaagtacacactaactcaagctctcgatgcgattgaattctggttccatgtgctagcaacctaaccattgcagcttagatttaacaaggaggaaatacaaggtcttagagttttatcaataaaacaaaaaaaatgcttcgtaagaatataagtagcacatttggtgggtgtgagccatgcgactcaagcgatcccttgcaccctttccaatccccttcttcatttttctccgatgtccatggtaccgtgatagtggcaatggagaggggatctatctctcgttttagttaagtaagtctatagggtttctttaattgcttttaatacttcctccatttcataatgtaaaactttctagcatttctcacattcatatatatgttaataaatctagacatacatatatatttagattcattaatatctatatgaatatagataatgctagaaagacttacattatgaaacggagggagtagtctttatcatttaaatgtattagatagtccggagtatgccttttattaatggaattatattcacttaggtttatgttctctttctatcatttttcataagtactttatttgtgaggtggctagttcatatatgagattctcgaagaattatactagctaagatcctaaaaaaaaatagaaaggctttatttgttaagcgaacgggtgacccaatctatagcactaacttttggtaccgacttgttatacggttataccggtttattaactttctcaaatagatgaagaaaatgcctcctgcttattcatttgcattttcatttcatggagttggtcaacacttaggctgtgttcgccaatccatgttcccaaccgaaatagtacgcgcggaaaatagaacagtctattagcgcgtgattaattaagtattagctattttttttcaaaaatagattaatttgatttttaagtaactttcgtatagaaaatttttgcaaaaacacactgtttagcagtttaaaaggcatgagtacgatagacgagggagatggatcgggaaaaggggtgccgaacacagctttattgtgctcccatctcatgcaacaatccaaattatgaagtctctttgttctactttataaacttttatatttctcaatagggtaacaatagattataatatattctcttatttaatatagagtaacactaaataaatttggccattttaagaaaaataaacactaagggcatgcacaatggttgtcaatagtggtttcttagtgtagctaattaggaatacttgttgacatagaggaaagagaaaaataagagacaaaacatcattgttatgtataacaacggcttaacaacgactcttaatcactataatatggaaaaatggttgcacgaaggtgaaaaaagggaaagaatattaataaaaaaaatatttttcgagttaataattagagcctttgttatctcaactattataaaaacatggtctctaaataatcatataaaatattatttaagagaccatactctagtattgaacctgcccaaagagcaatatttctgtccttattttgtttagagagagcaagagatattttctgttcctctcctgtccccacacaccaggggtctccctctctcctctcctcttccttccactctcctcgctgggtcgcgcgcttccctgctctctacaccgcgtccataccccagttaaggccatcccgaatctcgaggcagattggacggctcccattcacccccaccgtacaccgggtccacccacccacccccacagtcgccgccccttcccccgccgcgagagtcagcgccctataaatacccgacctcaccggaaccctagatttttgagagctccccttctccgccaccgcaagctctcccctgtacccacccaccgccaccgcggctactaccccgccgccgctatcgccgccgccatcacgagctactagtagctaccgggctatcgccgccgcttgccctgatgccgcagcaggaggtcgccgaccagatcgccgccgcggcggcggagcggggcctgcagaggagcggctcggccagccgcctcaacgcgggggcgccggagttcgtgccgcgggtcgccgcccccgtggtgccgccgccgccgccggtgatccgcgtgttcgccgcggcgcctcccccgccgcgggcggccttcttcgcgccgccgccgccgcatcaccggccgtacgagtactacgcgcctgtgaggggcggtcagttcgccgccgccgccgccgccgaggagcaggaggcggaagtggacccggatgcgacggaggcggcggagccactggtcgacgggttccccgacgaggtggtgcacaagattaccaagcaggtaggcatctatttccccgtagatagatgtatcataaacagtagtagtattcagcaaattatattgtgatgatttaggggaaaaatcgattagaatgtttaggttttgggtttactgatcatgtattgtcttaaacagcgttctgagttggctcaagtactgagtagatgctgtttgtagtggctgattacgctaattttaagaatgcacaaacattttgggatgcaatttatgaaaaattcctagttatgtgtagaaacaatgtatcgctaaattcccttaattggtgaggtgtttggtgctgttcaacttaggttcttcatatgtgatactccttctaaaaaatgatctgtgcctaacaatttctaatattgatcgtcgcattacccatgggcccacccgttgcgtctcgggtgcaggccactcgcccttttcggttcgcacgcagagttactctgccagcacgttttgcatctcaggagtaatgcatttcacggctctatcagatccccaaaaatcgatgttttggttcgccggctaaacaacaatcaactaaaagaaaggaaaacaaagtatgtagctgatctcatgcagaacggatgtgcatggctcctttttttcgtgaatgtagcatggacgatgtgtcccctaagactgattaacatggggagttaatatctccttagtttctcaagatggaacgtgctgatcaaacctggatggagggagtagtctgttgtgctgagcatcgagagcacctgtggttgtggatggttatttgaaacatggttgttgtggcgttgtttgctccgttctgcttggtttgtttctgttctgttcaacgttgcccatgtattctcctccattctgctttaggccctgtttggcatggttccaactcctagtttcttgcagaaatagaatttactatttaaaataaagtgatctaataatctaattttagcctaaagcgtgaacagaatatctcacactaacaacctttgatctagccccagttccaactccagaatttttggagctagtaaaacccagctcaaacaaacttggagtttgatctgtacctaggaaaattcagttccaaaaaacttggaattggagctgtgctaaacagggtcttagttcaccttaccttgcctcagtgacacttaggtgcctgccctggatgccttggcatcctggcgcctttcaagcacatggttgccttgcagccttggtttggaaaacatttaagtgtactaacatagtgaagttctaaattatttggtgaaattttatctaatcagctgtttgtttagtgaatctctatcatgattgagggaaacattcctaataggctagtgttatagcagtgagcatctagtctactttataaaactgcagaatacaacagaaatacttttgtccttcatgactttattattgactttattatttagaatttagtggaggcagctgttgcaatcagatcatacataattgtgactcagctgtgcaaaatatgttcctatgttttatttgtgtattcaattttcattggactgctttttaaatagacacaggcttgtaaataggtagtaggaaagtatggttctgtttggaactgatgtgcagtggtcaagagttaggacatttaagatattttttacacaaatagtaaaacattattgcttatgtaatctgtaataactaatcagttgacaaatatgtaaatctttaaaaagctacattaaatggagttttttcggatggtcataaattcccaaaggatgccaagtcctgtcaaatagcgttagtcgtgttgttttgtagtgtctagtagatcagtcagagagagaaggataatgtgcttattttcgcatagatatagttatttagagttcgtctcatgtttacctaggtgactcctctgtgttaaggctctccagggagttagttagccattgcctatgaggtagatgagaaaagagacgggagaaggggactgtaggtaaaattgccttgatttgataggggatcaatagatctgatgctgggtatacctcttattcattgctgcgggcttgctgccagggagtcgcactgctgtcagatgttagccttatagggctgtaccttgctgtatctgttgctgccactatccttagttccctatagtttttttcatggtgctgggcagcgaacattgttgtcgacttgtagcaactgtggcagtgtggctagttctctacctaaccctgctgtatcgtccctgttctggtggcagcaagccttctggagttctggttgttactagttgtctcttcagagcatagagttttgtttgtgggactttctgggccagttggtgtggattctttgtgccttttctcttttttttttcatctactcttccagttgatgccataatcaagttcatatggtttcatacttgccttgccatcttgataatcatgttgacacctccttatcttttcttttgtgttttctcttgcctgaaactatttgaggacaattttgtaggtggagtactatttcagtgatataaacctagcaacaacagaacacttgatgagatttattaccaaggaccctgagggatatggtgagttgtgtataattatttgaatgaatttaatttttggagaaattgattatttttttacatgattataatgatgtctaaaagtaatacattttttcaaaacaaaatggctgtgggtaaacatttttcttacaatagtttgctaagctttactagtataaacaaactcttttttgctaagctttactagtgaaaaagaactatctcctattatttccaaaagtgggaattttttttggtcctcctagatgttggtacatggatatgcttgatattgccagatgaaagatgattgtttttaggttattaattattttcctaaatatttgggttaagagagggaatattaggttttgtttggaatattatattttataacaagccatgtttggtggtaacatttcttctttttcatgaatgcagtgccaataacagtaattgccggcttcaataaaataaaagctttagtgcataataattcaatgcttgccgccgctcttcgaacctcatcaaaacttgtaagtttcttcattccgtactgtggtatgctcactttatgatggttatctttgaaggacaacatatgtttatttttaggataaaacaccaattttttatctactgatatttctagccaaaaaaaaattcctgttttatctacttattccattcacattgcaggttgtaagtgatgatggaaaaagagtaaagaggctgcagtcatttactgtatctgatatgcaggacctgcaggtattcatgaatctcaatcgcatgctgtttatcttatttttttgtaaatttgtgataatctacactgatttatatggcttcttcatctttgttgtagtcccgaatagttgttgcagaaaatcttcctggtgatccctgttatcagaatcttatgaagatcttttcaactgttggcaggtaggagtttgcaacatgtgagcatcctatttccccttttgaggatcttagaaaaataatatattgcgactttttaatgttctagtgtgaagaccattcgaacctgttatcctcaatcttcaaatggcaatagtcctgctactaatagatctgccaagctagatatgctgtttgccaacaaggtaattcccattcaattgttataaattatgttatcataaattcataatattgttggtaagtgaatactaattattttttattcttatggaattgtatcaattacattagaatcattcccaaactttcatcctctagcagtattgcccgagtgcattctactgcagataaattatattagaacatttatcagtaagaaggcttacggatgtatgcttgagacttgtcccttatttaagaactaagatagacttccccatttagcgttggtttcaacttcagtgacagctagatgtacttatgtttttgataattgctgaaatcaattctgaaagctacaagaagttctattttgccaagctgggtaatagtggctgttcactcgaggtgaacatttctcttggatctatggggcacaatatttgttagtttttgtcatattcttgcttgatttacttgctagtttgaacacattgttagccctcatccatatgcttttctgctgtaagcctgcaattctttttttccttttttgacacctttatcatcatggaagttttttcacttagctataagagatgaggtctcattcatgttgtgtttcaatgtgccaaatcatttattttaaaacatgcgtgaaattttcttgtttattttttacttctttttagaaaatgtgcaacatagttgaagttgtcattatacttttcctgaaaatttgatgttattgttacttttcccaacaaaacaagcaacatggttcaatgttttcaaactggctagttgaacctactcgtatggctaccaactagacgattagtcatgactaatcagtgataggggcagagtagctactgagagtaagaggagcagaatagcttgagaaagaagaataatcattggagggggagctggagtagctcatcttctcctgcttggcaccttcagcagcttgagaaggggaagtgaggcagggccagagtgccactaggtccagggagggggctgtagcctttaggcgctcaagcccaactaacattttcctccccttctagttgccgactattatggatgactagttgctgactggtcagatgactaggtctatagttgag

SEQ ID NO: 67859 - DNA, 23972 bp, Oryza sativa
attttgatgggtgtgtgcctaggccaagtgttttggaaccgtctgttatggtattgtcatgtgttttgaagccaaacattgttgttctggttggtacagacttggtgagttgcatggttaagttggctaccactactaccattttggacccaagttatatatggggaagggtgtaagacattattcatgaaaaatgttacaaaaaaaaaacatagaaaaacatggagatgctcgtcttagttcttgataggtcttcaggaaattgggtcattttgacagaagggtgctcaacagattggattggatgaccgaatatattttcacctgctgcttgcctactcccattctcgttactttgtttggtgtgagagaacgataattacatattattttaaatataatggatgttccattcagtaatgaaaaatatccggccgttgcactactaggatgtaaaaacacacatgttcatgggtgtatatttgtatcacctcgttgctgttgtgatgaatattttcctgaatttcctgaatatctggacgtcatcacaaatagcgtccatcctattttcctgaatttctcagcatttactacttacttaattacaataatatataataattacgataaataaaaaaaaatcggttactctctcaaactgtttaatttaattggatcacttaacccataaattattattttttctcattttactctctaaacttttaaaaataatttatgcttaatagcaattctccttttcattttctctttacacaagtatcattttaagctgaaccttttttcgacccatagatgataccccttcgtcacacttaatgcgcacacattttaccgataaatatttttattataaattaaattttatttgatgaaaaaatttttattggattgtcatttaaaattatttttatgtcattactattttgttgccaacattataatatagaaaaaatttaaagaaaagattagttttacggactgtgccaaatttgatcgcgtcttggcgagtgggacggagggaataccattatcaaaggttcaaaatatttgcagatttcatcatgattgtttgcttataactaagttttgatgcttaaatcaatcttgttttttgtaaacagtgataaaaaaaatttaagtaatgtttgagatgtaagttgtaaagcatataccaatgtacattatataacttatatatagaaagaaataaattattaggggttgagtgctcagacaaaatagtttgagggagtgaagtagacccttttttttaactatatttataagacacagtaccataaaactacctatttctctacttctttacctttttatttacatacttaaaagattcgtattgtttctgccgtcccacctgacaaaaatctaatctaacttagtctaacgagaaatctaatctaacttctgtcctattccctcccaaccccacctgacatacagaccaaatcacaagggaaatcaaaataccaagttcatgtactacctatttatttatattcctatttaaatttctattagtccaattcctgttcctatttcaattcaccaacgcaacaaatatatttggtacagagttgaacatgagacaaatataacatgtaactggtacaaagttaacaagaattcagaaatactcgtacgatacgtctctacagtacagtactccttaagtatattgtttcactatcttcacaattatgtctatcctagataaagctccaatcctgagatgcagtaacgaaaattaccatatgaattcatgcatcatgtttaccatgctcaaagtttacgcagtgaaagaaatcttcatatcgtatatcggatgagtgatttaagagaaaaatttatttaaagtatagaaggtaagaatatattttctatttgctaaggaagaatcgggacagaggtctctcgttagcaacaaaacgagagtccacttagcagcgatcgcccgtgtcacagtcagtaaccaaaaagaaaaaaaaataaaggaaaaaaaccgatcggttggcttcctttccttttctctaattgcgcccttctgttgcacgcctttggcattcacggcgtctcgccgaacaaccagtggtgtcatgctgcgccgagaggcattctgacagggttgattcatcaatcaatcaatttccatcgctgcactgacatgcttcgccgcctcaggcgggcacctagatccaggaccatccaaacccatcacgtagcatctcaccgcactgttagttcttccaccaattactccctgcctaatcactttgaatcttaaatttctgcctaatcacatgggatccgtcgcaatttaactttgcgattttcttaatcaagggccttttaatttgctttgcctaattgttgatgctgtcgaacctatgatattgatttatcgttgcaagaatgttgttatgcgccgcatgcattatgcagtgcagttcgatcgcccattgggtttgttcggctgcaacacagctatatatcaagcatagtaatttgtgtctgtactctgtagcaatggatcaaacagccgaacagagccatctgaaatttgctgtctttcttgtgcacaatgcaccaagaaaaatgctaattggaaataagagttgtacctgtgatgtaaactcgtgcacttggatggatatcatttttgcaaagatacatgtaaatattagatgtacgcaaactatagctctcttcatcaatgaatgttgatgtatttctatggtttactttcatcgtgttttccttccctatcagtgaggataaataaccatttatacaattttagtaagtttttgtagaagaaaaaaaagggggtaaacatgagttattgagtataggtgaaaagtgattgatagattaaaaaaatagttaattggctttctggcacgggcagtttttatagtgataataaattaataaaaacatgatttaagtcttaataatgtaagactataaatctcacaatatttttttgacgaaaactaaacagaatatagatataatctgtcttcgttatggtgattatcaaataatccagaaattatgccattatatgtaaataactgttccatagatactagaccaaagttggtcggtccaatcaacaatgtcatcaagcttaaaccaaaaagtttctaactacattcgaaccataaggtataatagtgaaatatgtaccttctgtgataaaattgatgggacatacataatttataatacaatgtgtcaaatctaaaatttcatgataacttttgtttgaaatatgtagttatacagtacaattgaaatatttcacatagttttatgtcaaaagtacttaattactcacaaaaattacagtatcttttactaggtatgccctgcctaaaagatatttgacaagttttcgtcaaacttataaattatgaatttctgaccatcgatactttctcaaatacttagtgttaaaaattaaataaatattgtacatagaattaccaagtagtatactcccttcgttttaaaataatacattatttttattcgtacaactttgaccatttctattagaatataacaataatatcaaataaaatagtaatattgtaaaagtacctacgaaggagtatttataattaacaaacaaatctacctatatttataatacttttagtcattgatggcaaatcaaaatataatccagtaccatctatagccatgaacgaacacgcggctgcaaaaagccccaaatttttgagggcccacctcggaatgagctaatccatctgttctaaaatataagagattttggataaatgtgacatattctaatactacgaatctggacaagatattatatggctagataggcctgctagggagcaagcgagaaacaaaaaaaaaagacagccctaggcgaacacgtcgcttctctcgcaactcgtggtaatcgcgtgcgtgcgtcgaggctaagacgtcacgactcctcgcaagtccaattcagcaattcccgactattgcacgcttgtgcctgcgtgcgtctagagagagcgaagagacgacgacgatgatgacatgacgccgagctacgaggtcgggagcagctagcgagcggcggtgggacgagccgagtgcctaagccctagcggctgggggatggctgtggctgcctttgccttcttgttttcctcttctcctcgtcctagactcctcaatcctcatcagccctgaattggtatttgaattaaattagtaatttgaccaaaagtatgccatatttatattagacatatgaatttctcaaaactcttttagagtgaaaaaccctctcacgtcgcactccccaggggcggctcgggaggcgacgaccccgccgcccctctcccccacccccacccccttctccgcctcgccgtcgcccgagcggccgccggcgaagccacgcagccacaaggacggcggcggcggggcgctcctcgtctcctcgcgctcgggcagcctggggagccgcccggagtggcgacggcggtgtccgccagatccgcgccgttccggccggatctggcaggatgggctggcggtggggaagccgtcggcggcggggacgggcgacggtggcggtcgaggcgagttgcaccgggtggtgttgtgggtgatggcggcggggatggcgacggcattggggtggcgatggtggaggcctgtcacaccccgaagttctttcccaagcctaaattgaagctataaatggtcttaagaaaatacctgtgtaaagcaagagtaaaccttaataaattaatgcaaataataatcggaattggcaggtggaatttttgttgagttctacatgccgaaatacgctaacaagatttttagtggaattttcagagctctagaaataattttaatcaattaaaattgagcacagacaatatttaaatccttggaaattcatttcttcctttttctttttctttttccttttcccttagtgggccgccggcccattcccctcctctctccccgcgccttgctgggccggccggaggccacggcccagctcagcccgcaccccctcctctctctcagggtcaccgacaggtggggcccacctgtcgggtcctcccccaacctctagccgctcgccgccgcgcctcgcgtccgcgcctcccgggccacgtcgtccacgtcgccctcgcacccgcgcctcccgcgcccacttccccctctctcccgctcgcccgcgctcccgagacggccgggattcgattttcgaatcccgcctctctctcctctcccactcccccacgtcggccggcgattcccgcctctcccggccacgtccggccccctctcaccctatttaagctccgccgccaccccctctctctttttccccatttcgccgaactctcccgagctctctatcgctcccgcaccgtgcatccacccgccgccgcctttcccgccactccggccgccgctagctgccgctaggctcgccgccgcaccgcgccgtcaccgccgtcgggttcgcgtggccgagatccaccccgtccacccctcctccgtcgaggttcgccgccggagcgccattcccaccgtgcgacggtgagagccgccatgtccaccgccttcggccggcgttcccgccttctatggcccctttctccctctctaaccttttccttttcgttctttaggtcgtcctggtccccgtccgccgcttgtcgacctccctctgtcgctccttgtcgccggtcatcgccgccccctccggtgaggactccctcccctttcctttccttccccgattccccatgcgccgccgccacccgcgctcgccgtcgccttcggtcgtcgccgccgccggggcgccgtccgctgccgccgcccgcgccgccgcttgccgtcgccggtggacgcgcgcgcgccgccgcccttgccatggccggccggccggctttgtgccgagccgagccgagccaggccaccgccgcaccgtccgatcggccccgggccgatccgggccgtcgatcccgtggaccggcggtggaccacccgcgtggtcccggtccacggtagaccgaccacccatgcgccgctgccatgtggggcccacttgtcggcgccgcccctctctctccgggatttatttattgcgcaataattcaattaaggatttttccatttatagtaaaaacacagtgaatcttctaaaattcataactaattcatccgtgctccgtttaagcccattcaagtctcagtaaatcaagaaaaatttgtagaatccattaaaaatggttttgttctatgtttcagtagtcttatagcctatttgtattgtttgctttgtatgtcgcttagattccagttcttccgacgctccggtgtacttcgagatagtcgccgaggttcctccagcagcagagcaaggcaagtcatgcttgtcacttgaacatgttgatcctatattgcaaatgctctattgtttttcttcaaatactgcatcgttttataatgttactatgggatgtttacctattgttacagccatgctattttggtaccatgttcctttgttagcttgggttataacatgaatagactttggactaggaattgcttagccatgcttagttcaactagcacacaatgggggaaatcctattaatgtttagactgtaggttctaatggtaatgttggattagtaccaccgctttggtgttgaataattaaaatgaatcacatggtgggctgtgggtgcatggttttgttggtcgcacccatggcagttaaggaccggttcgcgggatgccctggaagaacttatcgtacttaccacaagccagcgtgggcaacggctgggcttgttgtgtagctttcctctagctgacgcatccaggcaacggtgggcgtgatggagcggggcgggccctgcgacggcctctgtcgcttgcggattcacctaggcacgagaggggactgcccgctgccttgcgaggagtgggggtgaaacttgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttggtctaatgaaattggatagtataggtggatggttgggcctatcgcaacgtggtatagcgttggacagtggatgaataatattgattaattattacaactgtttaattctttctacctctgtttataaatgctcgctttatgcaaatgaaccactctagctctcctttgataattccctgcatcatacccctattccggtatgacttgctgagtacagtgggtagtactcagtcttgctctattttccccaaccccagagtacgagtatgtgtcagatggtggtttctccgaggagtagcttcgtccgtgccgtcgagggtgcctgtggagtggtgttcccgctgcagttcaagtcaaggcttagctccagttatctttcgttttttcgttgcatttatgtaagacttttatgatgtttgtaagacgtggatctgaatgtcaacattgtcgtttgtgtaccccggccggtcctagatggggattttaatgcacattctgcttggaattctattcgggaatttctgggcgtgacaaggccgcggatccggcggtggcgcacccggatccggcggcggcgcggcggccggcggtggccagagcacggaggctccccgcggctgccactggcgtcctccggcgcccctctaggcatcagctggcgttggtggagaggaagacggccggatctggctccttgcccagatccggcgcgtcctcaggtgggaacggggtggttggagtccagtcgtcgtgcaggtggtgtgaatatcgcaggtatcctcggtgtgcaggtgccatttggtggctcccgtcgtggatgctatggttgatgggtgctccgaggtgaaagtcttgctccgctctcggtgctagcaacggcgatgcccttgggcgccgttcaccttcttgaaggcgttgctactggagccctcgttcaactccacttcaagagttttctccgggtgaaaacctagattcgttaggatcggacgatgtcgccgttgtcggcgtaatcttcttgaaggcttcgttttaggaggttatctcttgttggacggctgtacttaggttcagtttgtcaatgtcggggtttttgccggttttcctttaattaaccgtgctgttgtaaggtttttaggttcggtttcccttataaactggatcaactctcttcttctatagtgaattgcaggagctccctgcctgtcccctcgaaaaaaaaactcttttagagtctcaatttgtatttcattcgggtgcctccaaaatcctaaagatggccttgatatcatttgacttgttagattttataaacttatttcaatatatataactgaatgatggaaatcctgtttcagatacacaaacatgaaatgacttttgctttttaacaagtacatcttccatttcatattatataagtagttttgattttttttccaagtcaaacatttttaagtctaataaagtttatagaaaaaatataataaaatttccaacacaaaacaaatattttataaaaaatatattcaatgatacattcaatgaaactaatttagtattgtagatgttgctaaacaattttataaatctaatgaaacctaaaatagttttaaaaaatcaaatcgactttaatatggaagagagggagtactgcagttataacacccttaaatactaatgaggaatcatttcttctaaatatggtcacatcaacatcggtgaaaagacaattgtaacacatagagcataattgagaaacgaacagaatgttgtaattgagagatttaattttacctagagaacattgaagatggaaaggtcatttgagattgcaattttacctaatcccattatctttcactttccattgtcaccaaagaagatgttgtcttgtgatgcaccttttggatcaagggaggataacattgactcttctctggtgcatccgctatcaatcacccaacttcttccaccagatttgtattcctacaagagatttctagttttagatacctagattacttgggtcctctcatgttagtaacaagtgtgttaggcacccaaatcactctctttatagaaatatttttgcccctagggccaacatacttggccacaacacaaccattagcctattataactctaaagtgcctcaccttattcaaaacaagggttctttttggtggagagatgttatctgttatgctgatgtctttaggtctattgcccaatgtttggtgtactatggtaactctgttacttactgggaagatctatggaatggaaatattagatgtcaagagtatggttctttatatgctctagccatgaataaaaccgattcagtgaaggatgttgtgtttaaggaatttgaagactgttttcaattacctctacctctttcggctaggggttaccaagattttctgatcttaaaagatgagctaaatgttttaactctaagtcattgggatggggacagctggtcttttatctggaacaattcagtttactcttcacagaagttttattccttgaactttgtaagccttttgttggcaactttttgtgacaagttgacaagtataatcgcagcacccaaagctttgcggtgatcctagagtcgccaaccacctcaatctagcaaaagctaaatcaagatgggttttgataaactaaaccggctagcggagccgatctagatagaacgatggataactacccgtctcgtgggcaaaacgggaggttttgaggacaaacctacaaagaggtgaagcactctcgcagcggcgacggacgatttacagcgcaagtcgacaaagatagacaaactaaactagaattagaagtaaaagtaaaagaacgattcgactgattgatagttggttgagagattacaattgaaccagccatgtcccttatatagaggttggtcttgccctctacaggccctcctccacgtccaactcgggatagaaaggaaacctcgaaacccgataaaacagactcgggctcggactctgccagtcagaccggccacacaccgccggtctgactggcccactgtcggcggtctgaccggccgacaaccagcggtcagaccaacccaatcagaggaaaaccgacaaacttctaaactttgtcaattttccctattttattcctatgtgccaaatttaggtgtaaacacatgcccccctggctttttgacgaacaacgtgaatctaaaagcatagagcatgttttttggtcttagggcgataatccaattaccagccatagaacctcctaagcgtcttgccaaacgctcaggaagtatttcttcgagtatttcccattgattgctcgctgaaaacgccttgaagtgtctccaaaaaatatgcgttccctcgaacaataccgcatactagataaggaccctcccaactaggatcgggtacccaaaggcaaaattgtcttccaaaccaagtctccaacttgaaacaactttgctttcacccttttgttgtatgccttggccaccctcttcttctctttctgtatctcctccaaagccttcaaacgcttgtcgatgacttcatcaaggttgtctcccatcaatgtcttgtaatcttcacttgacaaatcatcttgcctgatataacgaagagaaccaagatttacttcaaccggtaaaacgacttcttgaccataaaccaactcaaaaggagtgactttagtagcaccatgtttagatatcctatgcgcccacaatgctttagaaagcacctcatgccacttctttgggtgttcctcaatcttcttttttactagcttcaacaacgtcttattactcgactcagcttgtccattagcctgagcgtagtaaggagaagaactcaacaatttaacaccataagatttggcaaaactcttcacttccttagacataaaacaagctccttgatccgtagttaatgtttgcggaataccgaatctatggataatatgcttcaaaataaagtcaattacctccgtatgagtcatattcttgagcggcacggcttcggcccacttggtgaagtaacccgttgcaactagcacgaacctacgcccctttgatgacgaaggataaatttgaccaatgaaatcgaaagcccaacctcagaacggccatggtttgatgatagggttcaacacggtggcgggcgccaattgaacattgccgaaccgttgacaagcttcgcatcccctataatatttgaaacaatcttcaatcatccgtggacaatagaatcccgctcttctaagcaaccaattcatcttatgggccgattgatgagttccacaaattccttcatgcacctctcctatagccactttagattgatcatcatctaagcacttcaataaaactccatcaatattccggtaatctaaatcttcaagcaatgtatatttgaacgcttgccgctaaatcttccgatcaaccttaagtgcaagatctttcaaatatctaatcaaaggaattctccaatcctcttttgtttcctgggcacaaacgtccgaatttacaattaatttggcctccgtttcgaatgaatcatgcccctcagccttctgtccagaaccggtcagaccggccgtgcaaggctagtcagaccgcccagggtggccggtcagaccgccggtatacagccggtcagactgcctctggtcaccggtcagaccggccgtgcaacctggtcagatcgcccttggtctgcaattttgccaatttcgctcaaaggtttaaaataagcaccggctcttctaatataaaaaatactcccctcttcacattatagccagatgcttgctgtgcttagtcatttgctctagaattatcatgcctagcaatatgtctaatagcaaaattatcaaaattggcaataatatccgagcattgattaagatgcctatttagtgatctgtccaagaatttgtaagctccggcaacttgttacaccaccaattccgaatcaccaaacgcttccacgtgtttagctccaatcatctccatcacttgtaagacgaataataaagcattgtattcggcttgattatttgtacaataatattccaaacgaaccgatgcctcagaagacatgccattaggtgaaaaataaaactactcctatgccttgactctctttgcaagaagaaccatcaaaataaatcttccaaggtataacttcaaccaagcaaacctcttcctcataagcaatatctacatgatggtctactataaaatcaattacaatttggcctctcatagatttcaatggttcataagccaaatcatattcaatcaaagcatatgcccacttgccaattctcctacttagaattggcctttgcaacatgtgtttaataacatcggcttgacaagcaactatgcatgtactagatactctctccgtcccagaatataagaagttttagagttggacacggttattaagaaagtagatagaaatgagtggtggaaggttgtgattggatgagtagtggaggtaggtgggaaaagtgaatggtggagggttgtgattggttgggaagagaatgttggtggagaagttgttatattttgggacaaatcctgagggctaaaacttgttatattttgggacggagggagtaacaaataatgccgcaatttggtaaagcgtagtatagacataaacaaagtctcactatgaagacatacctcgcttcggtatccaaaagacggcggctcaaatatgtaatgatatattacttgccatcttcctcttgtgtcaaaacggcaccaatgactttgttttcggaggaatatataaccgaaacggcattccggctttaggcactcgcaccacgggtggagtagacaagtacttcttcaacccctcaaacgcttcttgttgttttgcccccaagtaaaattagcttcttttttcaagcgaagtataggaataaaggcatcgattttacccgctaggttagaaataaatctcatcaaataattcacctttcctagcaacttttgaacttctttcttgcatgtcggtgctttgaaatcatgaatattttctatcttcttaggatcaatctcaactcttctctcatgcaccatgaattctaacaacttccccgccgacacaacaaaagcacacttgagtgggttcatcttcaaaccataccggtgcacaatctcaaaagctaacctcaaatcggccatatgtccctccataccatccaatttgataacaatatcatcaatatagatttataagataatacctagcaaatcatggaagatcaaactcattgcccttttatatgttgcaccggcgttcttcaatccaaaagtcataaccacccactcaaataaaccaacaaatcccgggaacctaaaagttgtcttgtacatatcctcttccgccataaagatttgattgtagccggcattaccatccaaaaacctaatcaccttatgacccgatgcatcattaatcatcatgtcggctataggcataggatatttatctttcggagtagctttattcaaatctctaaagtctatacaaactctaatcttaccactccccttcttttccaccgggactatactagacacccactctacatagcgacatggcctaataaaccccgcttttaataaccgatcaatctcctccttgactcggtcatataacaaaggattgaaacgacgagatggttgtttataaggcctaaaacccggtttaattggaagccaatgctcgacaagatcatggttaagacccggcatctcatgaaacttccatgcgaagcaatcaacatactccttaagtagctcgattattttaaccttataatcggctctcatgtttttgtttacaaaagtcggccttggcttagttccatcacctatgtctacttcttccaatggatcagccgatgtaaacccttgaccaagcttttctacttcatcaaaatcttcaatagtttccccaatatcattcttttgcagccactctaaattagcttcttttctcattatacaaagtgatatggcctagccgtgctaaactaaccggctttacagagataggtacaaatttgccattggagatactaataaaatcataactagaaagattcatccccgataagcattgaatattcccatgacgccactcaaatgttgcatcggcccttgcaacttcggccgatgtatccgcttgaacaatttcaataccatcgctgtcccattgaattaaatattgatgcaaggtagaaggcacacaacaattggcatggatccaacaacgacccaaaataacattgtaattatcttgcacatcgacgataaagaaagcggttggcaacgtcttgttctctacggtaagctccaccgaaaagatatcttttgcctccgttggttcaccattgaagtcattgaaaatcatattagttttcttcaactcattatctccacgccccaacttcttgaacaacgagtacggcatcaaattcacggcggcacctccatccaccaacatcctagtgatcggcttcccatcaatatgacctttgagataaagaggcttcatatgacgatttgattcatcgggcttctcaaaaaccgcatctttaggacctagtaaaaattgagcaacctcggcttcatccatagcacaaaactccataggcaacatacacaccatgttgaccttcatatcttcctttggagatgaattatacttagcaatcgattgttctcccttctccttttgcacaacaaccgattcttcagcttctatggatttacgcctccacacctttgtacgcggtggtcgcaactcattgaaccttctatttctttgctcttcagcctccctctcttttaattcttgggcccgaagacgttgcaacctcctcttttgggtagccgtcaaatccttaggcatccaccttggtttcggctctgttccaggaggtaaataatgccctctgttgattttatttgaagacgacgaagccctcgagctaccctttgcaaatctcctatcaaaccggcgctggagtgcagtcaaaccgggcgcagacttttggtcagaccggccagaaacacctgtcagaccggcctgtggctggcggtcagaccggcttgttggcccggtcagccagagggcatggtcagaccggccgactgcgatgaactggtcccagctttggatttgttgcttgaagactctccaacttcatctccaaaaggtattagcacatcatgagaccccactttgatagtaatcacctccgaagtcctcgtctccaccttagcacgctttccttccctctttccttcattgatccgatttttagcataaaaccggctattgtttggtgaaaacaaacgctcacgagctggtctccttggtcttccccatccttggttgtattgcattggaggcatatgattgaacattggtggcgttgcccccatggcatgtagcaaggaaaagaataacccggtggcggcattggataaggcccccatgacatgtcttgagaacgatgatatgtaggtgattccgaccgtcttggtgaataaccaaatcgctccctaggaggtgatcttggtctttttcctttattgcgagctttctcaccagcttgcctctcatacttgtccaaaagcatatcgaatgtcaccttagttttcttaggagctttagaacttaaagcttcactcctattctccttccaaacaccaaccttcggattctttggcaccatcatctttggcctaggctctccaatgaccactccttttcccttagtagattcggcttgctctggcagaatcaacaccttcttatcattgaaattaattgtgttcaccgggaaagaatcatgatcaagcttcatcttgaaaccatcagtgaatttcaatcgtctgtcatctatggccgattgaacctatcgtcgaaacacattgcaatcattagtagattgagaatgagaatcatgccatttacaataagctcgacgcttcaattcttcttgagatggtatgacatggtctttaggtaatctaatttgtttttcttgcaaaagataatcaaaaatcttatcgcatttggccacatcaaagctatatttaatctcactttgccgatctttacgaggagtcggcattaaattagaacaaacaaaaggcttatttttgttagtccatgacaacttagcaacatacatatcatgatcaccctcatcatcagaatcactagtctcaaggtaatcaatcaaattaacattaggttttttctcaaatggtctaacaaatttcttactatctttaacccagcctttttgagccagagccttttgcatgagttgactaacatcaagaaattgttgtccttctaatttttctttaataagagcaattaaaccattaaaagcaaaatcaaccaaatctctatcagttatattcaagctgtaacatcggttcctaacatccctaaatctcttggcataatcaaggacatgttcattgtatttttgtctaaccaatgtcaaatcacttagcctaagttcagtctcaccagtataaaaataatcatgaaatctttgctctaattgaggccaagtatgaatggaatttgctggtaaagaagtaaaccatataaaagcagtaccggacaaagataaagaaaacaagcgcaatttaaaagtatgagaactactagcctcaccacatttgcgctaagaactgacctacatgctcccatgtggtcctactatcctcaccactaaatttggtaaattcgggaactctataaccacgaggatatgggatattgtcatagtaatcaggatacggcttttggtaaaccttagcacgattcctaacttcaatcccgaatttatccctaataataccagcaatcaattcctccatattctcaggcctatgttgatttggtggtgggtttggtggcctaataggttgtggttgtagcgcaatataattatatttgccatatctagtatcgggaggatatcccctagtaggatcattgtaaacattaggaatatgtgggggaacttggggattaacaatagatacaggggaatcatgtactggaatatggtataaaagcccgttatttgtcattgggtctaccccctgaatcaggataattgtgtcggtttgaccggtccagggcccagtctgaccggcgtccagaggcgcggttagaccagtctgaggtccggtctggccgcagggaggaaacccggtttgaccggccagtggccggtcagaccggtggcaaacgcgcggtctgaccggccatctggcccggtcggaccggttgattgcgttgcccatccctcaccggttgtttgcatactcgccccgtcggttttgctatatatttgatctacatggggtttgctagtactagtagaggctttatctttggattgaaaattggctaagaaagaaccgaatttattcctcaaaaaattatcaaaacgagattcgaaagatgcatctatcttactatttaaagcagcaatggatgaatctattgtacttgctacgtgttgttggatagggattgatacctcttcagtacttaccacattaaaattaggtttaagcaatggtccaggcttgagaaccacaccttgacaggtcctggtgcatgatctcatcagtgcctcccgcgtgatcgccttaatgtactcctccatggccttgcatgcttccccatcaagatcctccaatgagattggcatgatattggatggttccacctccgacttggttgatggcggctttgtcatggcggcgtcgaagttgagatgacattgagcaaatttccccagcggagtcgccaaaaattgtgttggcaactttttgtgacaagttcacaagcacgatcgtagcacctaaagctttgcggtgatcctagagtcgccaaaccgctttaatctagcaaaagctaaatcaagatgggttttgataaactaaaccggctagcgtagccgatctaaatagaacgatggataactactcgtctcgtgggcaaaacggaaggttttcaggacaaacctacaaagaggtatcacactctcgcagcggcggcggacgatttacagtgcaaatcgacaaagatggacaaactaaactaaaactagaagcaaaattaaaagaacgattcgattgattgatagttggttgagagattacaattgaaccggccatatcccttatataggggttggtcttgccctctacaggccctcctccacgtccaactcgggatagaatccaaaggaaacccgaaacatgccttcccgagctaggaatcctcgaaacccaacaaaacagactcgggctcggactctgccggtcaagccggccacacaccaccggtctcaccggcccactgtcggcggtttgaccggccgacaaccggcggtcagaccggcccaatcagaggaaaactggcagacttccaaactttggcaattttctctattttattcctaggtgccaaatttgggtgtaaacacctttctcccccaaggtcgttctcctggatttggaaatcagaatgtgttaacaagataagggtcttcatgtggctgttactctgtgatcgcctaaatacaggagatatgcttgacatgagaaagtgtgcaaaatagaatgatgatttaacatgtgctttgtgtggtttagggttaagagaaacgagagagcacctctttttcagctgtccctttactgaagcttgctggcataaattgggttttcattggaattacagccttgaattgaatcaaatgctatctctggcaaggtcagcttttcaaagaaatggattttttagagatcatctccatcgcctgttggcacatttggaatcagaggaatgttcttattttaagaaatattccaccttcggttcagtcttggcttaggtcttttaaggaagatgtactcctgcatttctgtaggatgaatggtccccttttaaattcagtttcttcctggttacaaactttgtaatatctgggactgtggttttctccttgtattttttttttgtatattttgattttgctttaataaattaaactactgggcggtgcctggtagtattttggacaaaaaaaacacaaccattagcattcttcctaagaacataagaagcatcaaatgaatttggagaagcacaatcattaggaatgatacttttggccctaacaaagttgctaaggccttatggcttgttaagcatcacacttttgtccaccattcccttaggtggagggacatacctaagaccttcatgagtgtagttgtccctttgatagcctaagtactccttgagagcctttctacccatgtggcacttaagaaggccattgtggaggagtctcataagcttctcatttttcttagtcaatgcactcaacgatttggagttagtagcacaagcataccctcacaccttgagcatggttcattgcttgagcaatgtaggaacaagatgcctcactagggagagagacactagtatttaaggtttcaaacttttcttcatgggagaggtaggctttgttgaagctacccgctctctcttggagatgtgagtttgccacctcaagatgagcatgagattctttggtttgcttataaagtcgtaccaaagcctcatttctctctctccttagtaagttcaaccttgaattcacgagtctgctctttctcatgaatatgcattagctcttgcttctcaagggttgcatattgttgttcaattttcccaagcaactcgctcaagtgtggcaaatgattccttggttatggacttgaacaagtcctcatccataacatcctcttccccatcactcataatatcaacactgaatgacttgagtggagaaggtaccttaggctcaaccatgagacatataggagcgttgtcatcactcgagtagttgaagagccttagtgtaggagatggtgacggcttgatggtgaaagtggccaattcctcttcatcacttgagcttgaaccggagtaatcggattcaaagatcaagccaatgtgggcatgaactttcctttcatgcttaccgtgcttgtgcctctccttcttctcacctttctaatcttccttagcgttggggcaatcggcgatgaaatgtccaggctcatgatattcatagcactttcttcacgagtgtcttccacttgacttgtcggaagacctcttggaagaactccctttgaagaagctgcttcttctcatgaactttccaaacctcttgacgaagagttccatctactcatcttccttgtccttcatgttcttgtaactttcttcctcttcttcttttgccttcaacgccaagtcttctttcttgatgcttgagattgagctttggtagatgtactgggtgacatcattggactcttgctcaagcatgtctttggcaagaatacgcccgagcatatcatgagtgttggtatttcttacgaccacagataaatccgcaagcgcacggaataccgctgtagcacttcaccttcgggtgaccccaaaaagatatcgaactcagggaacgtgtgtaatctacctaaggctaagactatctaaggacaacaactgatggtaggcaggctagagaggactttctatgcgtcttaattatctaggctaagcaaaggtaatttcctatctattgcttcgggcaccgacgcttgctggtctgccagcgtggttccggctatagctctatgatgtatccgaacgtggaggattactgggacagaattcagggctgtcaccacctgccgcctacctctgacaaatccgtgggatagacaacaaacaaaggtaatctctaacctagacaccacgtctaagttattaattactactctaatactcgtacaggaacttccttctctatccaaagtcctagtactagagcacttagtatgaatactaagcaatgaacccgcaaagatggaaacctatcttacttagacaaagtaattaaataacataagaaaggaacacgaatgcttactttatagaagaagttctccgaacccagagcaaagtgtaccgacaactccggtactcctccagaattccccctatgaagctacactcgttgaggtagaagtcggatgagcgccaaacttccggacactcctacagagcttctcctcactctctaccttattctaatgtacaaatgatacaatagagcctcttgtaattcagctcaaagttgtgtgacttggaaatgagaaggtgacctccttatataggctccaaatgacggttaggggcatgggaaatgaccaaaacaccctgcaaccgtctctaggaaggaatccaaaccgtccacgtggaagcagatggttgcttcggctgaacccaaaaacactcctcccggcctctccttcggccgggaggttgcttaatgggtccccaacaacctaggctatgttttgtcctaattttaaatggtttttattaacttattgggcctccaatccatgtaaacgcgtcctgaatgcgcggaggtgcattttgtgacatgacggatgtgttttctcctcaaattacctacatacacatatttcaccaacactagtggaaatgattagtaataatccctaccactaagttggataccatgttttatttcattatatgtaggtattgactgttaaatattatgatttaaggaccgtcaacaatgaggcgtgagattcttgtagtctggactctcacgtatgattgtcaccaaggtagagttccttggtgtgatggctcggatcattttcttgaccacaacttcatccatcatatctcatctagcatgacaaaacctctcgacttatcccttcaagatctccaccttggactcgcggacactatccatggcttcatgaacattctgaagtgtgtaccatatctctttggtactctctatgccatccactcggttgaactcactaccgctcaaggtgctaaatatggcattagcggcttgagcgttcttgtgttggttcacgtcgtcctctttggtgggatcattgggattctgtaaaatatagtcattttcgactattctccaaatagaaggtcaatagatttcaagtgcatctacatcttatgtttccaagaggcacaatccgtaccattgaagtacggagctttgccactataggtactcacatatgtagatgtagaggagtagtcaaatggaatttcggttccgtttttggaaacctccttttggtccccccttttggcccgacatgatctcttcaagaagttaaccctaataaggagattaggctctaatactaattcaaagggtcacttagcctagagggcgtgaataggctaaataaaatgaaaaccggaagctaaaacttaaaatatgtcggatagtctgatccaaggtcggacagtctagtgcaaatcagattgtttgaagagggatcagactatttgactagcaggggaacgctacaacaacctatagatctaccacacaaacaagagtataagcacaaccagcaactaagttatagcggcacaacaaagcaattagtagaggaagaaggagaatgaatatcatcgggatttcatgctgaagtatttcccggagttcaaattttttagggtattctactctccgttcagaggctcaaaaagagccgagtcttttccaaccctttttctcttgaggttgcacaaatgcacacctccttccactagaggtatctcttttcttgcgggggcgagatccgacctttacaaacttctcttggctgaccacgagtagatcggtggctcgagagcgacgcctagccatctaggagtcatcaacctccaagagtaacaaacacgacacaactcttggacaaaccctagtgctcaagatcgagtgaaatacacactaagcccccacacaccaaatccacaaccaccaagatccaccacacaaagaacgaggagggatttaaaacagggagaaagagctcaaagatccaaagcactttagtaccaagctcaacccaaagtgaatgagttgggtagccctagaatagggttaggtggcaaattactctcaaaattcatcacgcaagaaccaatatgcaaacaaattgagtaaatcatagggcagacatacagcttataggcaggattgtaaaaaacaaacaaacaaacaaacaaacacacacacatccatccatgagagagctagaggggttcatttgcataaagctagcatttaaaagcagtagttgaaagcagtaaaacagttgtagtaattaatcaatattatccaatcactgctcaacgctacaccacgttgagacagacccaatctaccacctgaactaaccagttccattaagctaaactagtaatgatactaatcacggtaaatcaggttgaccgcccataaccgcgggcacggctattcggatagttttagtctgatcagaggtgtacaactgtacccacaagacacaaccccatgccacgtttccgtgcgctgacatgccaccatgacatcgaaaagaggccgtgacaggaccctatgcataaccccctctaac

SEQ ID NO: 67860 - DNA, 3928 bp, Oryza sativa
  unsure (1)..(3928): unsure at all n locations
tattaacaataacgctgtaaaattacatgtgtctcttttttttttcaagactggtagcatgtccctgtttaaaggtgttagtttcataaccggaatgtctctttgttaatttaattcattagtactctccacaaactaaaattacaaattcttttttgcgagacaattttcaaaccctaatgctactgccaatggtggtgacagattaactcaagcccgtacgaggacgggtggatgatcaaggtgaagccgagcagcccgtcggagctggacgccctgctggacccggccaagtacaccaagcactgcgaggaggaagacgctcactaggctcttcctctctgttttttttcttcccattttgtcactccgacctaatttctccctgttgcaacaactgctctgtatccgtatacgattaataactgaatcttcaggctttgccatgtgttcagttggttctctgaacttctggtgggtctatctatttatctatgcttaattagtcacttcaagccagtggtctgtggaaaaaaaaaacaatgaaaaaaaaattggccatctatctgctcaggagcaaattataacggcttatctatgtattagaaaaggaaacagcaagttcttgacatgtacaaatcggtacgtgttaatttctagttttagaaatattaaataaaaaactaaattaaggatgcatgacaagttaacttggtacttgttgattttaaaatacttaaaaaaaattaattttaagtactgtaacttagtaatacttagtacttactattaattcttaatttaaaaatatttaattatgaaacatagaaagtaaccgaagattgaacattaattttttggggttttntttaaaggggttttttacagtgacattcacagttgacttcaataacacataaaattaggatgcatataggagtactaaactaaacgtacagccaatgcaaacgcaccgagaaaattcagatttcatcacaccatgacaccacaccggcgtttctaacaagtttgtaaataaaaaaaaaaactaaaataataataacaataaaattagtacgtgtaagattcaaatcggaattaaccgggggaggggtgcgtgtgcgtcgcgggcgaaagagatgggaggccggttttccgagggaggttgttgggcgtgccgtcgccgacggggacgcgccaccggtgccggtgcgcgcgcgggcgccgtcgcgtcgcgtcccccgtgaccgcctccgggcggcaccggcagcggcggcgtcacgggagcggcgcgcgggcgcgtcaacgtcgtccgcgacgtgggtgtgttttgctttgctcggctcggcgtgaggagagcagaggcatcggcgcgtggttggtttgggggcaaggcagagcgcgggcgcgtccacatcgggttcaggtcaaatcccctaatcatttcgctaatttgaccggaattattatcagcaaacacctctatacaccgtggtgtaactggttctcgtttttatttcaaactaattactccctccgtccatagtataagttgttttaattttctttctaatcaaacttctttacatttaaccaaacttatagaaaaaaaagagaaatatttatgatgccaaattagtttcactatatataaccttgattgatagtatatttgtcttgtgttggaaatgttattgtgtttctttataaatttgatcaaacctaaaaactttgactaaagccgtgtttagttccaaaataattcttcaaactttcaacttttccatcactcaaaactttcctacacacacaaattttcaacttttccgtcacatcgttccaatttcaaccaaacttttaattttggtgtgaactaaacacagcctaagaaaaaaaaacttatattatgaaattgagggagtatgtgccagtgtgttgcaacgggaacaagagataaaaaaacttgtaatttagtttcttttatatcggatttggaaataaaaatgaaattcggttttgtttatgctggtttttcacgggcttttctggagctgtttttctagggaaagagtagaacgactgtgcttttaaagtagttaagaaatgaagtcaggctgtttgaaccaataagcggtagaaacacggaaaaattagcataaaattatttataggtaaatattgtatatttatattgttctcagtttaaaagtcactgctgggaaataaatttcaatgagaagtccccaaattcaactgtaaaattgcgttttagattttatttatttatttttatagtcgcacatttttttagtttgctaatacatggaaatcgtcaaatgaattgggcaagtctgatggaatgcaggggaaatataatcagattagagtaggtagcagattatcaaatgtttgcaagttctttcgattttggcccgaaggtaaccagtacgtactagaggagtacaaatgtagaatacggttgtttgacttggagatacttcagcattatggagtagaatactgctcctactatagctggtcagagggcagcgaagactgagttgtcagtgagaaaagggaagcgaatatatgcgttcagttcagactttcagagacgctctttgaaatcctgggcgccatgatccaatcaattattagcactcttcggtacagcggaataaagttgtgttttaagttcataatgctgtatttattcttgatcatggactatacttaccagatttattgtttagtacatctaaactcttattactgaaccctgctgtcaatagtagtagcagtacagaatcaagttgaacatagaatatatacatagttttctggaatcccaactctggtcgaaatctaaatcaatcatcaacaatatgaacagaaacaggaggcactcggtgaactttacacgaacaaacgaaagaataaaaaccaaaatctctttggaatcgtaaaatggacgatccattttcataatcacctcaccctcccaaatcgctgccattttttttttgcaccacaatgtgatcgaaattcctccattagcacacacaaaccccaccttttgatgctccaaatcttttccaaatcataccactactactttttttctcctttttttgattcttttttttttgaggtgctcgcccactaccccgctttgttctaagctccacccagtaggaggggtccacgtgtgcaggtgacgccagatgacgtcatcgtcgtcatcgcaagttacagctcaccaaaagccccccagatctaagcgcctaggattcgacacgcctcgtgtgaatcacagcttcccgtggccgtcggatctcctcgcgacggccgagatggagccgtgcgcgccctgctccagcgcgcgcaccacgtcggccatcgatggccggaggctcgggttctcgccgacgcacgacgccgccagcgacgccacggcggaggcctcgccggcgtcgtaggcgctgcccagcctctcgtcgaccagcatgcgggcgtcgcaggcggcgcaggaggcgggcctgaggcgcggcgcgaggacggcggtgaggaggcggccctcggcggcgcagaaggcctccatgccggtgaggagctcgaggaggaggacgccgaagctgtacacgtcgctcttcttggtcaccatgccggagcggatgtagtgcgggtcgacgtaccccggcgagccgagcatggtgtgcgcggaggaccgggggcggacggcagcggagaaccccatccgcgccgacccgaagtcgcagagcttggcggacatggcctcgtcgaggagcacggggtttttttcctccgggaaaacccccccccccccgttgacgtcgccgtgcaccaccggggctcgcaccggtcgtgcaggtactccagcgcccgcgccacctgcagcgccaccgac

SEQ ID NO: 67861 - DNA, 3953 bp, Oryza sativa
cgccccagccacaccaccctttcccccctcctcctcctccccaaatcccccgccgccgctgccgccgccgcagtccgcgtcatcgtcgcaccccctgtcaccggcggccgaggccgccatgttcccgccgcagccgcagcacaagaacctgtatctctgccacatcctcgcgctcgatctcagctcgcgttgctccttctctgcttcttgcacccacgagaagaagaagaagaagaagaggaggaggagaggaaaggcgagaggaggaagaagaagaagaaaggaggagactttgtgtggcgtttggggctctgtattgtagccttatatattgctgcgtgtggggatttcagatttggtgggggtgtaaactgcaaaaaaaaatgcaaagacaaattaggatgagatgttgagatgaactggtgactgattaaaaaattgattattatgcaggagcagaaagcagagcctgggggtgagtgactggcatgtggggcccaccttactcactcactcattcactcactcgccagtgttaggttacaacaaatacacttgttaaacatgtacaggaaatccgttttgagctcaccttcttattccattattccaacatccctggaatccaatagattacactgaaattgaaacaattatggccctttttggatgggctaattattggattttagataaatcgatcactcataatgtgagctataggtacatgtatacgtggtagcttaggtagctccattggattagattacagctgaaacgccattatatgtgacacaggacagttatatttccttcaagatccaggatgtctcacaaccaccattgatcgtctaggtgaggtacgaaatgatgcatgcaatgcaaaagctttttcatcccatttattaatttgccgctgctacactgatcactgatcagctagctcaaaaccagagagatctagctgattaaccacccagccatgcattagctggtaattaaactgtgcaattaccagcagtacacttacactgacgacacaaatcctctctttctataaagttacagccacaagctcaacatgcgtgaagctaagatgagccattcgatctctctcatgcttaatctcaaccgttcatgttctatgcaattatattccctattaattactcaacttatttagtacctactttattgctaattgttcttgcttatttatttaataaaatttccatcctccttaaaaaatggagatatggagggtagagacgcctctccatttttttttaaagaaaaatatgtaagcgtgttggggattgaatagggacctctgggttgaaaccacacgtcccttctcactaaactattaagtgcatccaaaattttttttattcttatataagtgtccgcagcaatggatggggtttcatcgagtgacagtaatgacaaccaccatgtgatggagcttgggggtccgaggaggcgacagagatatgaccgggatggatttggttggtggcgtcggcttggtcgatccggccggtcgccgtgcatggcccggccggccggtggcggtggcggtggtcaagggggaggtgtggagctaggagacgacgacggctggtgtggtggccatcacggtgggcgcagcgatcgatcgatcgatctgagcggagtcgccgcgattaatgtgggtttttggttgcttctgatgatctgtcagcgacggattttgtggccgcgttagcgagcttattagcagaatgctttgatttgtccttgaatgcatgcatatgcatctaagaaatcatggggtgtgatactgagatgagtctgtgatgctaattaggctgcttgctgctggaagcttgcagattgcaatgctcgagtgttgttggcgaagtgaagctggcaggctcgaattaagctcgcatacgagtgtgctagatgctggaatgaaaactgtcgaaaacgatatcatgtctatggaaaatggttctcggttggtcgagaatttcatatactcaatttgatggcgatatcagtacaatgttgattccagaaatcataaaaatcaaagttctatatatatagggatagaataaaaacaattggaaatggtactacttttacaaaaattgtgatactcggtcgatcaggaatttccgccaccatgttccccttgtagtagtatctaggactcctgctgatgcagacgaaaatgcagtccttggtggtaaaagaaatatctctgttctctgaagtcacaaggttacatcagcaaaagcaacattttgcttgtaaaccctgactaaaatgtcagtatatagttatgcatcagtacttacttgccttctgctgttactactacagttactactacccgtctaacctttcggtgtttcagatttgcgagttaataaagctgagcatagatgaacagcttttcaaaaggagagagaggggcatgcattgcacacatcggattcctgaagctcacagaaagagagctagtatctctcttcacgatcgatcgcgttcactgaactcaacacatctgcatgggctgcgtacggggagcggttttaaaaggtgaaatttattgcttccaagctactgttcttgctacgagcagctagccatcctgttcttgctgccctctctttaatctttatggatcgaaccgtcttaattcttcttcttcttctgatcttcccctcttttgcaatgcaagggcatctcgccgtttggatgatccaacaagacaagacactgaaaatgtgacaagtgtaggagtcactggggtcaagcaggagtaagtgtgcttctacgtacagctgcacctgaaaaagtgagcaattgatctctcgtaatgaacacttctggtttactgaagctcaattcagagaaaagttcagaaaacatatatgtgaataaaaacagtgggaggagaggactggtgatcatttgactcggtttgggaccgtcggatgatggctcgttgcatgatctggaccgtccaccttgcgccgatatcacgaaaccatcaaggttcaacagtgcattggcttgtcagcattagagagaaaaaaacatccggtggcacgcagcaatcagcagcgtttggttcttgggagggtgctgctatgctacggatgctgcagcaagaaaagaaacctgtactgggaacaaaaagtcgctgaggctaagtcatcaggaacagtagcagcatcagcagcagcttgggccttactactaattgagtaggccaatgagcaatcatttggtgctgattcggatggctcactgaccacaaaacaaagcactaatctgcactgtgttgcaaaatggagtacgtccaaatgctctttaaggacaaagtgatggtcacagtgaagcatcttgatgagtgaattttgggacgccatagactttttcactctgaaacagctactagctgagatatataattgcaagtgctaccagtagaagtgtagaacacagaacagtgttcctggtgatggatgatgacagaattgcatgcctacaaagaaaatagtttcagtcagtgtcctgaatcactgaaaatatggctttctttgattcccagattgtctgtgaatccttttcagagatttagtcatcactatgttcaactctcgtgagaaagatgcaaacaaaagaatttgcatccgagattaggtccaagtattaatttaagcagttacacccagcgtcccggacaagaaattcagagctttcttcagcaggttactgtcatttttcacggctacctgatttggtcactgattgctgtcctgcaacagtgatctgcaaggtgacgaaagaaactagctccgaaagcaacggcagaagcgagttacatgtcacattttggtgactttccacggcgaattgcaccgtgtggatcacatgtgctaaactaactgtct

SEQ ID NO: 67862 - DNA, 670 bp, Oryza sativa
agtctacgtttaatatttataattagtgtccaaacattcgatgtgatagggacttaaaagttttagtcccatctaaacagggtcttattcttttaacggtagacgacacatccatcatcagcgaaacacccatgataactccgtcaatcataatatatgctggatcagtttttcataagtattcataggtgtagagtgtgcgtgtgtatgtttacatgggtaagtgtgcgtgtgttgtgaacctctgtttataccgtgtttttttttaaaaaaaatgaaaattcgaatgtggcttgttggtattacaaccgcaggtgagtgagaccacccaccggttcgtgtctccgcaccgcccatccctaaaacatcgccacgtccccgccaccccccttcaatgtccgtcgccaccggcggcggcgtcgtcctctcgcgtgcccaatgcgcaagccccaccacgccgcgcagcctccgccgccgccgccgctcccgctcccgctcccgctcccgccgcggaactgcccgctcgcgaccgcggtcctggcgctcctctccgtgctcctcgccacggcgctgtgggtcctcctcgtgctgtccccggcgtcccacgcgaggggcccagccgcggggctgtcggatgcggcggacccggaggcgtttgcggtggcgggcg

SEQ ID NO: 67863 - DNA, 16270 bp, Oryza sativa
tttagtggtcaacatattgaacagcacaacaaggtgaccctagttattatctctaaagggtgtattgcatccatgcatgtacagaatacaaagtaaagtgggatatctgttagtggtagtatagaggaacaacacagtgataattagagatataaacaagttatgattaaattatgcaatataattgatcatctatggaaggcagggttacacatcacatatatgtgaaactgtacacttgatgaagaagaatacaagatgcatggaaacaaataggatggtacagatttaattgagatggtgattagggaatagaaaaatatttggtacaacaaccatctgaatagacatggacttatgattgacaaaaaaagtttccaatgctctgttgcaaataatagcacttcaactaatagggtaggaccacagctgaaaattgctaaaaatcatttgatcaatcgcttagcttgcatatatgacacaaggatggttgaaagcactgcaaagatgtgcttattttttttctgtttgaagcagaatgtactcaaattaataccaaaaagtgcctgaagatgcctcaaaagagttccatgattaatcacccccatgaatttctgctccaaactagatgctatttgcaaaggtgcaatgagaatgacataatactatactttaggtgacaaacgacatcaagcttcatcgttgcaatcattgtgtagcattaccatttttgcgggtggatagctataacttgtatttctcaaatatcctatgttatcatcatataccaatattccatgtttcaataggtcaaattatttgactcacataacagtggagataaatgctgccaataggataacttatacatgttgaaaaacagtctaagcaaaacgaaaccatggatgaagtagtgttttaaacataaaaagtagatggcattacagtgtacctgttccttttccagttgacgtgataaaatagttccaaccaacttatatggatcctggaatagtgatcaaaacatgtcaaaaacatggatcatgatttaaacagtacaatacatgtaactggaatcctcatatcattttttactaataacctttttcagagaatcattgtccaaattttctttacaacttatcatgcagtccaaaataaccttctgaagtctttccattgcctctgaaaatgcacaatagatagctggttacattgttgatgatgatatcaatgcaaagaagttattatgtacatgtaaaaaaaagcaggcaataaaagttatacataaactgtatcatgtgttccaagagaaatgcatcacaaaccttgacaattaggacccacattttgatttggttgtctctcggtatcagtctctaccaaatctagacgttttggggtggaagaagatccggaacaaacatattcagactgaacatgacttgcagaacgtgttgcaagaggtgatttcaagtgcttgaggtgcccataacttcctccccgttgcctccactcatgataagacttcaaggaaatgacacaatcgacaatcttgcctactgacccagcatcaatattgtcctgcagaagcaacacaattttctgggtgattacacatcccaccatcaggattaaattgctaagcatagttaagtagcaaccttttccaaatcagaggcctcaaagcatggaagcttcagctcttgaacagcaaccaagaagttccggatgttctcaaaatactggaaagccgtcgatggctggctatcacaggaggcattagccacgacctttggcacagcgcctggttgtattttgttaattgccttgcataggacaatgccattccttacagcggcaacaaattcttgctccgatgggcaccgggagaggccgaagggccctatcacgctctcaagccaggttgcagcctggtgccgtctcaatgcttgcagaaatcaaagaaactacaatcagccaacgaatttaacgaaaactaaaccagccagcattagaacagcaaagaaattttgcgtgctacattctattaacattatttacagtactatattattctggagacaaggatgggatccatgtggctattgcttatagaaatttatctacggatcattgggattgaaacagcacgagacagcttggagaatcactgagaactagctctctaaacgcattccttgcagaaaccacggtccaagcagaagaactagctctcataatagcaagactatcgcgatttaatcaatagaagcaaaagctatgcatcatatcgcgtaagattgattcggggcctccgcatagaagcgcccaaaaacgatcacgaagtggaaccccagcgcgagattctcgcaagcactccacctaagttagcagaaatgcccccaccaaaaaaagaccaagagcttttgcccccccacaaacccgcctaaactctaaaccccaagcagcagagcaacccgcaagcaagcaagcaaaccatggaaccctcgacgagaacgccatgagagcgatcgatccaccgatcgaagaaccccctcgatcggtatcgggcccgtgggagaagagatcttaccagcctcctccgccttccgcgacgcgaggcggccgtcgcggaacgacaccctccgcggctccgccgccatgcctccccctctcccgcgctctcaacccccgccctcgttcgccacgagccgccgccgcggcgccctcgcgacgccctggggcttctggaagcttcgattgggaggaggaggagagggaagcgagacggggaaggggattggtttgaattcgaaatgtggggtgggtagtggggtgggcccggtctccgaggcggtccgagatctcgacacggatcggacggacacgctcgccccgctgggtgggtggtcggtgcgcgtgcggtgcggcgcggcgggtggggagctcgaggctcacgcttacacgtggggcccgcgggtggtggggcccagttgtcatcggctgctgcacgaagcagggccgacagcgtcaggtgctccgtcgcgactgcataggcacggcttaacagctctatataccgaccgacggccgacgagacggcagctccgcaacgattgaacactgttgctttgctttgcttttgatttgggatattaggagaaacgagaatgctaggggacgggataccgtcccccaacaggatagctcctatccacacgtgatttttatccatacactcacttgtcgccgtcgtcgtcccccgccgctgccgcgcccgtcccccgtcgccgccgctgccgccgcgcccatcccccgtcgacgccgccgctacgcccatcccccactgccgccgttgttgtcccccgccgccgccgccgccacgcccatcccccaccgccgtcgcgcccgtcccccgctaccgctgccgtcgccgtcctcgtctacaagggacggctgttgggggcgaccgcgcgtgtcggggtgctcctcccccaacgggatgtccaaccatatttagtaggaatcacctgatacctggtaggtatcatccgatacctcgcaagtatcacgtgatacatgatagaaatcgtctgatacctcgcgagtatcatgtgatacgtggtagaaatcgtctgatacatgacaggtatcgcatgatacctcgtgagtatcacgcgatacgtggttgaaatcatctgatacctgacaggtttcacatgatacctcgcgagtatcacgcgatacgtggtagaaaatcgcatgatacctgataagtatcacatgatacttgtaggtatcacttgaaacgtgtgtagaatcgtctgatatctgataggtatcacacctgatacctactcgggatcatcctgttgtgtagaatcgtctgatacctgataggtatcacacctgtcgaggagagatcctcaatagcggggaatcgtgagaccccccatttgtgagttcggcctggggcggaggctcatctcttggaaatcactcgctcgtccctaggattaccggcaagcttgcacgcagtcggattatacaggttcgggccgctatggagcgtaacaccctactcctgtgtttgggattatggatgtgttttacaaagatttcttcactctagaaagcgcactcgcttcctctcttctggagttcaggttttctcggcgtcccccccgtctcagtgggcagggtcctccttttatagctcaaggggataccacatgcgccgcctctacctaccctctctcggagggggatcccactccacttttcctgggctttaaatcgtgccttctcccggaagctaagcaacaaccggttctcgagtggaaccaggtgccggcccccgcctgacacggtggacagccctgtcattccctcataaatgaacgatgacctgtgacagcccttcctcgagtgacgctcggacgtgacgggtcatacccacccccactccgccgggtacaagagcgacgtgaggacatgattgccctatccgtcggatgtgacggtgtcaggccggtcacagatcggtcacatccgttggacagaggttagctaggcgcgccgcacgtctgcccttaccgcattaaatgcggtgagggacagttggggcatcgcacatttatggctgttcagcctgtgctctcgctctctccctccgccgcgtggcagccgggtgaaggcctcggggcgaagccgcgggatagcccgagggggtgacgccatgccccgagcccccccccccccccccggcgctttcacgactcgcgtgacgcacgaatggggctaacttgcagagtcacgtggccggagggaaagtaattcccctctacttcacacacatacccccgggtccatatctccgacaacacctgatacttactcgggatcatcccgttcgaaaaacgggataccgttatattgcagccccctaggagaaattgtttctactgaatatcacgccctccatcccaaataagtgtagttttgggttttcatgttcaacgtttgatcgtccgccttatttaaaaaaaatgactagtatttttattattattagatgataaaatataaatagtaatttatgagtgactattttttttaaaattttcaaataagacggatggccaaacgttggatatgtgttcctaataacttaaaaaggtaatgctgaaaagtaaactacgataacaaaaaaaatcaactctaaaattaagtttttaaaatttaaattttcgctagctatggctgaaaagattaaaagcacgtagagctctaaattttgggctaatttggtttgagatctaaattgaccttaccaatatttggcaatttcaatagtgtttagtgtttatttagtttggagccaaattttgatatgccaaattttgatcgcccacctgcacccgctcgatggcggcgacgtctagcggtgacttctggagttaagacaaggccagcatccaactggaggggaacgagagaggtggctggactgtattttcccatctatcagccacttgttctttctctccgtgacaaatacttatttagtcaactgagtttgacttgttttgggacatcgattttcggcctgacacatagtagccggcttctacaatgtatttggttcggttttttctgcccgcgtcggtttttgtctcacaccggagcatcctattagaatattgcactgaacatattaaaatatatatacaccatactcggcataagaaaccgaaaaaaaaaacaacacaatattcgtgcccatattaaaatttgctaatcaaattctcgaacttacgtcttctgcctttaaataagtgacctagtaacacctaatgaaaaggttatttctgttagattccgtttgtttcctagctacagatgaccaccaccaacaggcaacagcagcagcgtggcgccttgaccgtttgacctcgcaaccgaacacgcaaaagtacagtaaaaaaacgacctggcgaggccgttgcgtgcatcagcgcgcgcgagatttcccacccgccgccgcgttggcgccccgtatattcttccccgcccgcacgggccacggatccatccacccccttccttctctccgacgttgacgagcgcctcctcgatcggcggcaccggcgcgccgcccccctctcccgccttccctttccttctccgctaatcaaccggtggtgcgagagcgagagcgacgggcggaggggatcgacgatggggagcaacggcggcggcggaggtggcgggaagcaggtgctgtgggagttccacgcgacggggccccgcaacatctccaaccccagctggagggacctcatccgctcgagctggttggtggttcgcgacccatcccttctccctccctcctccttccgctgttggatcgtccatgaacatgcacatgtgctcccattcttggtcactcgcgtacggtttttgtttacatcattactacatgtctgagatgtttggagtgttaaggccattcccaacccaaaacactagacatagtttccataaactctacgtcatcgagaaattagtactagacactaatcttccaatgcaaacaccactattccatatttaaatttaatgctacttatctcacatgatgtcttggatgttgtgtagaaacgatgtcattctctttcctcatttattcatttatcatattatttttcatcctatgtggcagcttatttaatgctatagacaccattctaggaatggccttacgcgtgcttgggtcacttgtctagaactgtgaattgttacgggatttttacctgcctgcctgagaaatggttaactctgcgtggagttcagggatttttcgtgctatttgatcgaacctcgtgtcagtcgtgtgcatggagcttaaggattcctggtgtttctttatgaaacctacagagctagtcctaaaagatattatgtataaaatacagttgcccattgagaagtcatacataagtacataactgaaaaagcagaggaatgtggtgcaaacagctgttgcaaccaattgccgaggtaacgtgtgttcgtcatatttcagtatgatggcaactagatagtaccatgccaatatcatgttttttttaatcaccagtcaaggctgtaaacaaattgaatgaagtagtaactaggattgttggcaatatgttagttgaccgcttgtcatactccagcttgtagaatgctggtcgtgtagtggaaataattttcaggtaaaggaacatgtcaaattttatggctttaacatggtgcattgaacaaaatatatatatatatactactctctatgtgcagtgtcgtgtccataattttgcttaaatgtaaatgaaatttagtccacattcttgtcctagggatatgagttccctgttttgtttccatttctggagatcatgcctttttgtaatgtttgataaccaaactagtaatgtgggtagcactgatttaacagcattatttatgcttcttcaggacagatcccaactaccgaagaattgcggtttcatgcttcgtgcaggctgcgtatctactggagctagacaggcaggagaagagaaacggtgaaagcgcccttgctcctaactggtggaagccattcaagtacaagctggtgcgtcctctaattgattctagagatggatccatatatggtgtgctgctagaatgggaccagcttgctgccctatcagacttgatagtgttgagacctaatggcgccccgaaggttgtcctcgcgataaggggaacagtacttaagcagtcgacagttgtgagagacctcgaagacgacttccggttcttcaccatggagagcttgaggggctctgtcaggttcaccggtgctctcgaggcgctcaagtcggcgatcgacaagcgtggcagcaacaatgtgtgcattgctgggcattccctgggggcaggctttgctctgcaggttggcaagactttggctcaagatgggatctttgtagaatgccatctgttcaatccaccatcagtctcacttggcatggggctgaggaaacttcaggagaaagccggcaaggtcttgaagagatatgtcagtggaagttcttcaaatgctacagaactttctcacccaacagaggatggaggagcagcttctgaaattggagaagaaaagctgatcaaggaggtaaagagatgggtgccaaacctgtacataaacagctgtgactacatttgctgcttttatgctgatcgcagcggtgtcgccactgttactgccgagaagcatgatggccattctgggactcattccaagctgtttgtgattgccaaaggaccaaagaagttccttgaagctcatgggttgcagcaatggtggtcagatgattatgaactccagttggccgttcatgatagcaagctcatgtataggcaccttaagtcgctgtatgtgaatgaatcataggaaactgaattttgtaaatgcatcgtgttcttttgcttctctagccaagaaaatgtgaatttttcttttgaatggcgcatggcacaagcctcgtacattctttttttttttttgacctggaaaaacaatcccagtgagatcgctggtcaccaacttcaccacctcagggggtacatcatcccagctgagaatgttgtgaagctgatcattacaacccagtgccgttatagcatgcgctattttattacaatcccgagggcaatacttaatagcaaaagaactagagctggaatttacaaaattattcatttcattcatttgattgcacagagacgcgcctggtatctatatccattcctcagtgacccaggtttgttctcagggccaaactgttatgacaaagcctccatatgaagtgtttcacctttctcggaacctgcatattccataccttcttccagaaaaagatcaggcttgttactctcattggatgtagctgcatttcctctcctttgtctctgtctctcccagtctcggtgcactttatatgccgatttcaccaaaaacaaccccttctcgtcataatgccatgccagtacatcatccatctcaatgtgcactgggatcaagcgaattgtgtcaatatcctactcccagaaagtttgccttagcaactcaagatcccaactcctagtacttagatcaattagttcctccacctccgttataatattgttgcctctcggcgtaattggtttccttgtttggccactgaccaatacgggtcagaccaaatatttatgtgtgaaccattaccaactctccatatcatcccattcttcagtaccccaaggcctcgacagatactcctccaagtgtaggacatgcttgctgtttgctttgcctgcaagatgttcccctgtgggaagtattttgctcttcggacctgggcacacagagactcaaggttttgcagtgatctccaacccaaacaactaactgtgaatgtgaatatgactttttttttttggtaacccaaacagctaccttattgagtatagttgtgggattatgtgtccaatgtttaatcgtccgttttatttgaaattttttatgattaatatttttattgttattagatgataaaacttgaatagtactttatgcgtgacttttttttatttttttcacaaacttttcataaaccctactggacttaaaatgggacggaaggagtacattactactttaagctctgcgatgggataacaaatccagacttcatcagacacttcttgtcagatcgagcaagtgactactactagatcaccagttgacagtgacaaaagttgaaaaccaagccacaacttctattttcctgtcacattagatgtaggtattcaaaaggcgaaatcgtctcaacctgatttatttatgaccatgaacaagggcatccgttctccttgttaaacattaaaaaatcaaacggaaaagaaaagctgaataaggtacatcgcagacgacatactaaatgtttgtgcatccatgagatatacagtatgtacaataacgacacaatgtaaaatgtaattaagcagctccagcggtagctccgattattatagcaatggtggcaaggacagcctgttacatcataaaaatgccattagagtgactggaatttttttaaaaaatacaaggtacgactgaaactagataactgatcaatctagaatttcatcaaagccatttccacttatcattacattagctgttggtgttaccaagagaatatgcatcaatgaacgaattatgttaaagtacgacaatgttctctggacttgatccttcatgtatatatatgctctggctacatacatgtccaaaactcgtgtggattataatggtattggctcaagcaagcgtgcaactggtgaagagcagagatgcttcaaacatgaaaaacagtaacctaaggtatgcactgtatatgattgaacgaagttaactctattgtttttttctgaaccaacattgaaaaaaacattgaaaaaaagatcagacacaacaagttcattattgtacctgtaacctatttttgcagtactttttttgctggaatgctgaggctaacatctataaagtcatcagtccaattcctagttccctacttgctcctgatgcattattcagtatttgcacaacaaagtctgatagttgctttgtttttagaaaccaaacttcacgccttacaagagcaagatggacaaatagccgatgtgcttgaccattcgtttttgtttcatgaagattattcatgtaaacagctatacgaggaacccaaaacaagcgcgcacaaacttcatgtacaatcctgaggtgaactaatatttacatcagcatgtcatgagaaatatattttcaagtttcaacacacaagtatgacaaatggaattatgtattccttgtaaatgactagtactgatctgtttgatcacacacaccgaaaaagaacagatggaataggcagcagaaatggtacaatgcactgcagtaagaatcaaaacaaataatgttatagtatcggatgaactcaagaataaattatgttacttaccgctatagcgcatgctacatatcctggtttctccctgtagtccactctagaacaccacagtaggaatgctccgacataccaaggaatagcaccgaggaagaaaccgactatgaatctaaaaaacaagggtttgtcatgaggataagcaggtacagttcaagaaatggcatgatgcacctaaaacttttggggtactttttccagatttcaaagatgatgttgctacaataagaaatagaagaacaaagcaatgctcgcttacaaaaaccagccaatgccaatcccacagcaaggaaggcggtcatgaccatgtccacgagcacctgcttcataatctcgagctgaaagaagagcaacgaggttacaatgtactggtaattttgtaacaaaacttatctgaataagtactagttaatttggaatataataaatacataaagactggactaactcaattctgtaaaggactgctttttatgtcagaaaaatcgaactccatgtgccaaaatatttcaccgttgattacatacaaaactccaatcaaactaaggtactaaagaggtgttaattttgccattaagcaccaccccagtagtcactacactagctgcccaggtttatggagtaatggagcaatgagttttaaacaacaggagcacactactcgcctacaactggacatcacgtaagtttcaagcagaccacctaagattttgcatatcttggaccaacaacacgaaaaaaattgcataatggcagtaaataaaaacttcaattccacaaagcacggtaaatttcaagcagatagatcccggatcgcgtgatcatgccaaagatctgtaagaaaacgccctctaatcctccaattcacctcaatttcgaccaatcactcatcaaccggttctagatggttcagatcaagcagaacccctccacgatttgagcccgatcacgcaccaccgaaattccagtgatccagtccagacctaacctaacccgcatccctcgtgatcccccaaaccaggcaggccagaacattaccgggaatgccctggtacccgccgcgggggcggtagtatggatcgccctggccgtagagccccggcggcggcgcgggctgcgggtacccgacgaccggcgggcgcgggggcgggtagctgggcgggccctggaacgtcccgtactctcctcctccacctcctcctcctcctccgccgccgccgcccttggccttctcgcgctcgtcgccgccgccgccgcccatctcgtcctctcttcctccttgccgcgttcacactggtgacgagagcccaggcgaggggcgtttagacagcttggatgtacagcgacggggtcggggggcctcgagcgcgcgtggtccgtccgatgcgtgaccgacggtccagatcgtacctgggggatccattctactgttcctgtcgcgagaaaggaattaatggctcgtgacgctgatcgacgaacgggaccgtgccatcttattactacgaccgtgtcgggccctcgataaatcggtcgagaaaattgacattttgccattgtcaaaacatgttttgctagaataacacttttaaaaatgatttcgttaaaatatcactctcaaacaggggcaacatgttgcaatgccatttcatccatttcttctcaatttaatgattttttcttgctgagatgataaaaatacccttggatcctatctcatctctcttctcttacctcatcctctcttcgttgcagatggtgggtggcgctggcgcagctcgagaccatcgccgtaccgctacgagatgagaaagctggccacgtcggggatggtgccgacgccgcccttcaccgccctcaccagcttgacggcgaagctcaccgggttcacgcacaagttgccggcggtggcgacggcgaccgggaacggggaaggcagcgcgccttgggacgaggaaggcgccggcgtggacggggacgacagttcggctcggcggcgcggcgcaccaagcactcgacctgaccgcgcgccacggtgtcatccccttctccgatgagctcctcgatgtgggcagcgacctgctcacggcggagctccttgtcgaggggacctgctcgcgcgcgcagccgcagccagctccacccgcaacgtccagtcgcttgagcgggcccttcaacctcatcggggagagagatcgacgccggccatggtggagctcgccattgaagagggactttaaaatccaccacggagttaagccgatttgagtgggatttgtcgggggaattgatgaggaggacgagaggaactgatttttgcattcaaatttgggcaagagcaaccaaggagggagatcaatttggggcatgagttcatcgaagagagaaggatggtggtggacgaaggtggaagacgctcctgccaagcaggccccacggctgaggcaagggcatttgggtcaaaccaaataagcaaaatggtggaaaacatttgcaaataatcaaaattggttaaaatggcagtgtggcaagatggggtcatttgaagatggcattataacgaagccacattcggcgatggcattctggcgaaaccccaacccgagaatggctaaatatcaattttctctattagatatcccatcgtttcacttgttggaggaataaaccaagcaatatttacaaatggaggaataaaccaaataacatatttacaaatgagaaataatttgagaaaaaagttttatatatgtgttcttaacgatataaaaaaaccgaaaaataaacttcaatgaaaacccctaaaatcaacttcaaatttaaggttgaaaatttaaattttggctgataagcataagcgtaagctaaaagatgagaatgtgggattggaactcgaaacatttcgctttggtattatgttaaaagttgtatacatcgactactaatgcaattaaaaccatagggaaaagtacgaattaccccccgaactaccgtggtcgtccgaattacccctccccccgaaccacaaaaccgggcattcttcacccccaactatgcaaaccggataaattacccccctcgactcaatccgcggtggttttggtccacgtggcgtacatgtggcagtccagttagtacacgtggcagtacatgtggcgtacgcgtgggcccacttgtcagtttgtcccctcttctctctcttctcgccaagaacgggcgcccgcggcggacctccatctctctgtcaccgagaggcaacggcggagaggggcggcgacgacaatgtgcggaggcggagctcgggtggcagaggaggagcctgtagctgccggcgctcggggcggcgaagctcgagaagcccgcaactgccggtgcacggctcgtcgaggcggtggagggggcgctcgcagagcaagcagatgacggcggcgggcagagctcgggccggtgatggcgataggcggaggcgaagctcgggcggcggaggaggcgcccgcagctcggacggctgcggcgggaggacgcggcggcggcgggcggcgccaaggatcccccctgctctctcttgcgcatgctctcggaatggcagccagcggcgggcggacctcatccgggcagtcggcggcggaggcggtcctcgcccggtcggcggcaggcggcggaggcggacctcgtccggtcggcggccggcggcgaaggcggacctcctccgggcggccggtggcggaggccgaacctcgtccgggcggccggcggcggaggcggacttcgtccaggcgcgagcctccgcggcggcgccctccaccgcccgcaggtgcgccaccgcgcctcctccagcccactgccgccccgtgagagagaagagagaggaagagaggatgaggagatgacaggtgggtcccacaatttttttttataaatagagtgctgactggactgccacgcgtacgccacgtggatcaaaaccaccgcggattgggtcgaggggggtaatttgtccggtttacatagttgggggtaaaaaatgcccggttttgtagttcggagggtaattcggacgaccgcaaaagttcggggggctaattcgtactttttcctaaactatagaattgatgatgagagaagaacagccaaaactaaaaaaaaaaaaagaggagaaaggtaggctcccatcgttgagtaagccaaacggcatatttgcaaatgaaaagaaaatttctaaacaaaacttttatatacatgttcttatcaatctaaaatcaaaggctgaaaaataaacttcggtaaaaaaaaatcctaaaatcagcttaaattcatatttaaggttcaaaattcaaattttgactaataagtactccatccgtaaaaaaaaaactagatttattgtagttcatattgattatactggaaggggattgggttaaatccgttaattttttttaggacggaggaaacataataataataataataaggaaaaagtacgaattaccccctgaactatcgcggtcgtccgaattaccccttgaaccacaaaactggacattcttcacccccaactatacaaaccggacgaattacccccctcgatctaatccgcggtggttttggtctacgtggcgtacacgtggcaattcagtcagcattctatatatatatataaaattgtgggacccacctgtcatacggttctcttcaatctctctctctcggggcgatgcacggctacggggcgagcaggaacggcgggcgcgggtggcggcgagcggcggtgtgcgggggcggacgggcggcgcgggtgcgcgggggctgacggtcggtgggcggcggtggcggaggtgggggctgagggcggcggcgcggaggcggcggctgagggcggtggaggtgccgccggtggtggtgttgccgccgcgtcgccgctcggcctagacgacgccatcaccgccgctatgaccaacggtgacgacgatccccgggcggcggagcggcggtacgccggatgagcgaggtggaccgggaggagctccggtgcgtgcgccgcgcgttcgccaacctcgaccgtgcctgcaggagcacctgcagggtgccgccggggaggcctgcgcgccgcatccggttctgcttggtggggggaaaactcgtgcgggagggcgaggagtcgagga

SEQ ID NO: 67864 - DNA, 4212 bp, Oryza sativa
ttcttttaagatttttctttttataaacctttttaactttgtttatttcttctcaattattatttgtgctctgaaaattccactaaaatttgagggctcctttttgaccaaggggaatttgacaaaaattctccgggccacatttgaatttttcttgtacgtattttagtgtttgccaatttcttttcgaattttaattaattctattattccttttagagaatgatttttaattcgggatgaatttatcaggacgtgacaaatccaccccccttacaagaatctcgtccccgagattcgaggaggctagcaagaagataggttgggcggtcttttcttcttgtctgacttcttccgtcgcatcttttataacaaacttgcctagcaaaacttctccactctggactgcttggctcaatctcctgttgcagatggaatcttctcttcacctgacttttccctggttgaacctttagctgacttcgactgggttgcggcacttgaagatggggcttcagttccagagctttgcatagttcatatctttggagtcaacctcatacaagttacccacttcatgtcatgcgtcgacatcagctttgtcattactaggatatcatgtttggcaacttgcccctaactgcctcatattagctttcctggtctccgggtgatagctacttctgctatttgatgcaagggtcgataactttacctttgaattatgcttcccaagagagccaacttatcccacttgatatactttaacgtcttcccaaatggttttactgttggacttcttattgtctgatcgttatccggccaaattttgaagcttcgtggttagatgtgattttactctgacctctgtagactatctgcgaacatatcacttggttcataactgggaatagctcccacgaacaagcaactcagattcactttcttcatgttcagtttactttccgctattctcttcatgttgtcatcatttagcattcaacgtattcctgtgcacattcagccttgatgtgttcttccccattggactacaatcaggggtcttccttgagcggtgcagagtatgtttctgtttatcaatcacctttcggcctacttctctcatgctggagaacatctttgccaatctcttttatcgatcatcttttggcttatctcgaacaggtggtattctttaatgtggattgcggacgcttctggggacgacgaggtcctttggctcgctgcctttcggtgaaaccttgatgtggtttgtcaaaaagctgcactgactaccttcagggaaatacattgcttgctatctgtatctatgccactaaggtttagtgctttctcgagatggggagcatccatattgttcttctgccatatcacctttgacccttttctgatacctgatagactaattaccaaccatcgactattatgttctcaaatattgatgtcttctggatcttcttaactgttgcaggtatatccgaacttatcaatgtagaggcatggcgggtacccttatgggtttcatccaccaatccttatcttgatttgtaaaagtgtatccaaacttttatccccaactactgtctcattagctttttaacccaacacagtgtaattggttttcttttccatcaacaggttggttattaactcgaggttagaatatagttcctctgacacgagaccctaggtctcctttgtcagtaaccagttacacacatgatcacatatccgcatcttccaaaagaatcctcttagaacttgtcggtattacacattccccccttattacacgaatacaaggcactgctttaaacaaaaagggaaggtgcttaccatcggtacattgtatcctcaacaggaatcatccataaacatagcaagctcactgttttatagacatgaatatatttttttttattacatgattgctgtagactcccggttacagtgataagtagctaactgaaaatcacaaacatggatactcattctgattctggagagatatagctggcgtggttctagtgactgcattatccttgattggttctgtgatgatgtgataggactgcatattgctatcattcacaggagaagcttccttctgattgctggttgaagcggatgacggtcttctgcttggtatcgccctttgcttggcctggagtaggtcggggagagacacaacttcttccatcgacgacaattctttgctggggctgaaagtgagcattgacaccttgtggtaatgcactcgctggagttggagctgttgcaacgcgagccataggactgctttgggatgcatggatgacaattcgctgaggagcaagcttctgattgcagggagctgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcacatagtggcacacgagctggggacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgtctggtcattcctggtggaggccactctgtgctagtaatgatcatcttacggacttcatcttcggttcgcattggtgtttttcttttctgctgaggacgctcccttgcatagtgcccttgctcatcacacataaagcaaatgttacttgctccttttgggtcaacatgtggcacgtcaccatgggtccttcgggatgctggcggcatgctgacttgtggtgtgagtgcttggactgcctccaactgcacttgaggttgtgtttgactcaggttcagaattggcgtctgatgctgctgtagtatctctataagcaatcggttctggttaatcaggtgttggaccagtgtcacacaactggtgtctggtgcttcatccactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacaactaacgacactaccctatagggcggcttaaggttctgcgacgggttctccaagatcttcactcctgcttcacagctggcttcactgcttcctccacttcgctagcggatcctgcagtcttccggagcttcggcaaacaaccgacgatgtcttcttcttcactgacctgaccatctagtactagttgaaatccgaagaaggaagaaggcagtaaaccttttgcaaatagcattaggggaaggagaaaaaggaactttcgcaaatagttttatttataaaatatgtccttaggttttatccatttggcttatcctacagtcgagatggctctgataccatcttgtcgcgaccgggaaaattgccttttcccgaacgctagtgtattaatccccgtcccaggaaaagccggggtacaccatacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttttcttactgaagaggggaaagattgagccagcaatgagt

SEQ ID NO: 67865 - DNA, 44352 bp, Oryza sativa
cccctctccccactccatcccctcctcctctccctcttctccccccccttctccacccgccgccgtcgtcgtgccgccgcgccgccgccttcgagccgccgcgccgccgccacgaagccgccgcgctgtgccacgccgtgcgccgtcgtcgccgccgctgtcggtgagccgctgcccccctgtttgtcaccgtgccgccgggtagagagagagccaagagagagagaggaagggagaagccgagggagagagaaagaaaagaaaagagaggaagaaagaaagaagccgggagagagagaaagagaaggaaaaagaaaagaaaagagagaaagagaaggaaaaagaaaagaaaagagagaaagagaaagaaaaagaaaagaaaagagagagagaaagaggggaaaatagaaaagaagaaaaggagaaaatagaagggaagttaggggagagattaggaggatataggaaataaaaatggtcggggttaatcatagattatttttggaaattcctagagtgtaatagtatttcgatcgaaattttgggttaattataggaatatgtttcttgatcggattagattaaaaattggtagtaatttagatgtaattaataactaaacaattagatgaattcttatagattattatagattatttttggtaatctctataagtcatcgattcacggtaggaattcggatttaatttttaggaattttagccgtgtattatatttaatcatttagtcatagactaaattaaatcgtacaatattataagataattttaggattttgtccgatatttagcttgcgatagaaatttctaacctattatatggatataatgcccgggtagattaaattaaaaacttatggtaacaaaatatttatacccgcaaaactagtttaggatgtataaatcgaaattgggtttgccctagttcgcgaatagtaaagttaatataaaagaatcaatttttgcattcgacttccatttggatttacttggatttttatttgaattctaaccgaatttaaatcaattttctcacgtaactataaagcccgagaagcccgagggagttgcggatccaagtgaaggccaagacccgcaagactttgagcaaggcaagtcatcactattccttgaacatgttgatcccatttacaaaattattttgtttacaaataaaattacatgcaatgatagacatcctacttgtgattatgccatgccttgattattgtttacccttaaatccttgtaaccgtgatttatgtataagtccctagtcaactatgacaaatgcttagaaatgctactctagatttatgcatactcatatttatcaaaagctatatgcttgggcaattacctttgggaagggaattgagatgcggcatgtggagacatgagcgccacattgccatgatgttgatgacatgatttgtgaaaggagaaataaaattaaataactgttttcgactggggcggacggaggatttgggtggtatccggaaaaggctagtaccgtccccggtcaattaaggaccgagccatgaagttaagcatgaaacgacgcccgtacaaccgcacttctcgtatgggtatagacctagcggaatatatagctgagcggaggcagtatccatgcatagtggtttcttgatgtgtgaggcaggggctctacggtggggcagccattggtagaaccgcgaggcgggtgtctacagtggtgtcgccatcggtaggactgccatgtgagaatttaaacataattataaattaattaatgcatgtgtgagtcttttcttcccgggtgcgccagaactcctctcactgctagaaaccgtgtacgcctagagtgcatgaggatgtgaagttcatggagcgggtactgccaatgcgaggttatcgaaaagctttgccatgacacgtctcatgtgttgggacgaggctcatgtgttgggcagtcgcggagtacgggtaaagtgtacatccactgcagtgtgagtaaatcaaaactattcgaatagccgtgctcgcggttattgagcaccgggacgtgtattacacttggctagactctaaattcttaatttgtgtgggatgggatattgcatgatgatttctttgctgatggagccacttcctgagagacgggaatgtggacgtcctcagaaaaccatgacgactcaatggcgggaagctatccttgggatcaccatggatggtggacagaaccgtcattgtttaatatgaacactggtactaaaatttgatcagtctgtgctaggtcttaggcttgtgaaaagaattacaaaacttgctttgcgcaaaagaaccatagccatcctttgaatacccttgtcatatgcattgttgctgtggtggcttgctgagtacggttggtactcacccttgcaatatacaaacttaatcaaaggtcggagatgaagcttcggaggatccctacgcttactaccaggagggtgatgaagacgatggcgctcagtaggtcttagttacagtcgttgcctatggcaatggcgtgccgctgccttgactccgctgccttacctacttctgtttttggaatgtattccggaccgcttggtccgatgatttaagactatgcctgcgggcttatgatgtaataattcgtattagacactcgtgtatgtgcacttggtatttcagctatgaattcatgtgtaccaaactacttgatccagggaaatggtacagtttacatgattgattcctgttataaaaacgggggtctacaaatggtgaggatctggaacggagggaatcacctcaacaagctacccctctacctcgcggcactggcgatcttcgagatcaaatcaacggccgccgggaagcacgacgcacacgagacaacgtgaatcgctctcggagtcatgtctcttcacggcgccatgataacggaaatcgaggagatcgctcaaacgaggaccgggaccacgacaaccaccacgatcacaacgatcgcgaacgacgggtgccagacaatactggtcatggtcgccgccgtatcgacgacgacgatggagatcggcgccgagacaacagcggaagacgacgacaggattcccgggatccaggccgtcatcctcgtaatcgtacaccggaaccaagcgacctatcgtcatcgtcatcatccgcgtcctcctcatcgtcagacagacatccacgaaggacacacgaccgccggcaacccactgcccccaacgctgggtgtagggctttcggtcgttccctacgtgatgtccgatggcctgagagattccgacccggagcaatagaaaaatatgatgggagcaccgacccaaaggagttccttcaagtctactccacagtactctatgctgccggagcagacgacaatgcgttagcaaactatttaccaaccgcgttgaagggttctacacgttcatggctgatgcatcttcctccctactcaatctcttcgtgggcagacctgtggcaacaattcatcgccaatttccaaggaacatacaagcgccacacgatcgaagacgacctacacgcgttgacacagaacttgggtgaatcattgagggaatacgttcgacgttttaacgagtgcagaaacacaattcctgaaatcaatgcttctgtaattcacgccttcaaatccggtgtcagagatcgctacactacccaggagttggcgacaagatgcatcacaaccactcggagattattcaagatcgttgagcgatgcgcccacgctgatgatgcgctaagacgcaagaacgataggccaaagaccgggggagagaagaaaccagccacggacacatctgagtcaagcaagaagaaaaatcgcaaaaacggaaaaggaaagctcaagcggaagtcctcgcagtagaatacgcgaaccctcccaaacgcccagacccacaaagcagcgacataaagaaatcatggtgctccatacacaagacggacagacattctctggaagattgccttgttttcaaaaagtcgctcgagaagcacatggcatttgaaaaaggcaagcgagtacgcgttgtcgagacgaacgaagagacggctcctcacgaaccggactcagcgtatccagactccgacctccacgtctcacacatcttcggcagttccacaacgtactcctccaagcgagaatacaagaaagtggaacgtgaaatctgtttgacgtggcagggggctgcacccaagatgaagtggtctgagcagaagatagagttctcggaagaagaccaccccaagaccgccgttatcccaggacgatatccgatcgtggtcgaacccgctattcggaacatcaaggtagcgcgagttctcattgacgatggcagcttaatcaatcttcttttcgccagcactttggacgcgaggggaattccgcaaaacgagttgacaccaactaatcaacccttccatggaattactccccaatcatcgtccagacctttgggcaagattacgttgcccgtgactttcggccaagccaacaacttccgaacagaacagatcacctttgatgttgctgaattcgatacagcttacaacgccatcattgggagaactgcacttgcgaagttcatggctgcatctcactacgcatatcaagtgcttaagatgccgggaccgaagggaacaatcactattcaggggaacgcaaagctagcagtggaatgcgacaagcggagcctcgacatggtcgagcaaacgcccagcccacacgccacgactgagccacccaagaaagtgaccaagacaaacaagacgccgaaaccagatggcgtcatcaagattgttccactctctagtgccaaccccgataagaccgtcaagatcggggcgacactaaatgagaaataggaactcacgctcatcaccttcctccgcgacaatgccgatgtgttcgcttggcagccatccgacatgccgggggtccctagggaggtgattgagcacaaactcatggtgcgacctgatgccaagccaataaagcaaagactgcggagatttgcaccagaccgaaaacaagccatacgagaagagctcgacaaacttctcaaagctggcttcatcagagaagtacttcatccagagtggctagccaatccagtcatggtacggaaggccaacggaaaatggagaatgtgtgtcgacttcaccgacctcaacaaggcgtgccccaaggatcactttccacttcctcgaatagaccaattggtggattcaacagccggttgcgaattattgagcttcctcgacgcttactctggctaccaccaaatcagcatggcaaaagaggacgaagagaagacaacattcatcacgcctttcggggtattttgctatgttaaaatgccattcggactgataacagctgggaatactttccagcgcacggtccagggcgcacttagcaaccagtttggcaacaatgtcgaggcttacgtcgacgacatcgttgtcaaaaccaagacaggcgactcattgattgacgatctgcaggaaatgttcgacaacctccgacgatatcgcctcatgctcaatcctgagaagtgcacgttcggagtaccgtcgggcaagctgctcggattccttgtctctggcagagggatagaagcaaaccctgagaagatcaaggcaatcgacaatatgaagtcgcttacaagactcaaggaggtacaaaagctaaccggatgcatggcagcactaagcagattcgtcgctaggatgggagaacgaggacaacctttcttcgctctgttgaagaaacaagacaaatttgtatggacacgggaagccgaagaggcattcattgcactcaagcgctacctatcaaacccccctgtacttgttgctccccaaactaatgaagaattattcctctatattgccgccacgccacactccgttagcactgtcattgttgtcgagagagagaaagtacagcgaccagtttattacgtcagcgaagctctccacgacgcaaagacaagatacccacagatccaaaagctgctttacgcaatcatcatgacatcaaggaagctacgccactattttcaagcccacagagtcatagttgtctcctcttcccctctcggtgaagttgtgagaaacaaagacgttgtcggccgcattgcgagatgggtaatcgagctgagccagtttgatgtccactttgtgccacgaacagccatcaagtcccaggtactcgctgacttcgttgccaattggactatgccagataacaaatcagacaaccaaggcgacaatgaaacatggacaatggcgttcgatgaggcactcaacagccaaggaactagggcaggatttatcttgacgtctccctccgaagatcaattcaagcacgcaatccacctcaacttcagggcgaccaataacactgcagaatacgaaggactactcgccgggatacgagctgcaaccacacttggggccaagcgactaatcgtcaaaggggactctgaactagtcgcgaaccaggtacacaaagattataaatgctctaattccgagttatctaagtatctcacagaagtcaggaagctagagaaaaagttcgatgggatcgaggtccgacacgtctacagtaaggacaacatcgagccagacgacctagcacgacgtgcatccagacgaaaatcgctcgagcccggcacttttctcgatatcttgatgaagccatcggtgaaagaggttagcggcgaagtcagcccgaacacccccgacattagctcggaggtcaccgaggcagaacgcgccgttgccgacatcgaaaccacagacgactggcgcgtcccactaatcaaattcatcagcagcgaggagttgcccgaggacgatacagaagccgagaaaataacccgtaaagcaaagatctactctatggtcagcaacgatctatacaagaaagcgctaaacggggtacttctcaaatgcgtctcgaccgacgatgacagacacctcctcctcgacatacatgaaggcatatgtgggtcacacgccaccggtcgaacattggtcggcaaagcttttcgacaaggctttttctggccaaccgcccttaaagatgcatgtgacatggtccagcgatgtgaagcctgtcaattccacagtaaacacacaaagctacctgcgcaagcgctccagactatccctctgacttggccattctcgtgctaggggctagatatacttgggccattcccatgaggacagggcggctacagattcctattcgtggcgatcgataaattcaccaaatggatcgaagcagtacccacgggggaaatcaaggccgacaacgccatcaaattcatcaaagggatattttgcagatacggactaccacaccgcatcataactgataacggctcccagttcatcagcgctgatttccaggactactatatcgggctgggggtcaaagtatgcttcgcctcggtctctcaccctcaaagcaacggacaaatcgagagggcaaacggcatagtactacaagggatgaaaaccagcatctacgacatactcatgtcacacaacaaaaggtgggttgaagaactcccgtcagtactatgggccgtacgcaccacaccgacaacgtctaataaggaaacacccttcttcctcgtgtacggctctgaggccatgctcccaggcgagctacaacatcagagtacacgagtacagaagtactccgacgagaaccaggaggagcagcgagatatcgatgtaaatcttctcgaggagcatcgggaacgagttgccgtctgagcagccagctatcaacagaccctccgctgttatcacgagaagcgcatccgtgcacgcatactttcgatcggcgactatgtcctccgatgagttcaaagccaagcagggcgaaacaaactctcacctaaatgggaaggaacttacacgatcacacaagtcttgcggccaagcgcattcaaaatcgcagacggcgacggtcgtgaattagcaaattcttggaacattgaccaactacgtaaattctatgtatgagtcaatatcatccatacatgtaagcacccttacagtatcaataaaggctatttctaggcccatatcacaatcaacgtgtttcgcccgatgatcccccactctgatgacacctagcgttgaaacctgtccttatgtccctttacgccgtctcgacaaggcctccgaggaacctaagggatctttggctggggacgcccaaagccgataaggccttgtcagatcctgtagagacgaaagaccatgtaagatcttgtcgtgtaagagttctcgccgtgcgtattaaccaagccgtgaaatcggaaatcaactttccaacttcacggctgggggctaggatcagagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagaggcatttgtcaaagatagatttctttattcacaaaatactccttacagttttttcacaaatcttttgctacattacatctttttcctaagatatttgtcacaaggtacgagtactaccaagagggccaacgccagtccatagactggaagatcttttcggccaacggcgacattgaccttgccagatggtctatctccgccgaagtcctccgagaacgagcaaaacactcacgaaggtgttcgagctccaggtgcgggcgataatctcgtaggcaagccaacacgtgccccccggcataccggctcgatcgacgacactcctgcttcaaggcctcgtcgatacgcttgtcgattccatcgagttgggcacaggccccattaagccacgagatgtacccggccgctgactcctcgggatctccgcggactacttgaagctccttgcatactctggccatggatgtgcagcaaatcttcaagtacgagttaaaccatacctcacggcctcggagcgtttccacagcctgctctttcgtcacggccagcatggttctctcgagctccgccacttcaaacttcgtcttccagtattggatacgacgatcttggctagcaagggcaccctcgatatctgctaaatgtgataaccactaagtcaagctgtacatctcttttggcaacatggctgacctagtcaggtgggcattaaggggtgaagggactactaacctgaggaagtcgtcgccatccttccctctatatcaaggggttgatccacatggtcaggcgagacgtgtggttcgaactcgaataccggaattactgccagtgactcgggctgcccacgctgctggacatcctcgtcatcagtatctctacaagaggacaaaagttcccgaggtcagcatactaaagtaagccgggatagtaatcgcatgcacaaagacggtcagagttcgagttttacacattatctaggaaatacaagaagtcctactcttcaaaaagggggagaacagactctcccagatcaccgatttcttccatcacctccttacgcgtgtcgctggccgccccctggtccaagatctcgcgcagatcaagttcaggacgcgacagccttacacacgcgaggacatgacacgccccggtgtagattccgtttgacgtctcctccgcaatcctagctgcatgcttggaggggatttcccccattgccgtcgccagttccgcgagagaggaggtcagcgaaaactcatcgggattcgccgggatcgtggacgtgacgccgcataccccggcgagctggtgaaggccggtgtaggtgaccctcaacgagccccggatctcagataggttgttcccgagttctgacattcggtcctcgagccccttccgttgtcgctcgttgccggtcgccaactccctcatcttcgtgaggtcttcacgggctttagccaactcgcgcacaagtctgtcagcgcgttcgccgtcgccgcttccgacctcgcctccgcaatctcgcagccaatgccgcgagcaccggcttcgaggaggcgccccatctcgacttggagctcctcccaggtgaggactgcagctggcagatcacgacctgccgcggggtcgctgactgggccactaggcgtcgcctcccagctcccggctgcgggcatgacatccgtcgaggccacaaggggcgacgcactagaagctcttccggacttggctcgcgcagcctttgctcgcgcctccctacgggacgaccacgagtcagacaataagcgaataagaagcgcggggattcaagaattcatctacttacttctcgccaatcgtcacaatgcgttgtcgtcgtggaggtgggggagatgcatccgaggcctggaatacaatcaacgcaaagtaaggaaaaatccttcttgctgcatgatttaacgacaaaataaattaccgagggggtcgacaccatgcgacgttgtccgcttacagacgagaatttcctcggctttatcggaacattgccaccactagtggtggcagcatcagatacctccttgacggccttcactttcaaagatgacgccacctgatggtccgcgagcggtccgatgatatcagtcaaaggaagggcctacgctcaatcaagtcataaagtgatttcgaaaggagaatgcgggatgttcaccaaatatacttacgttgatggcttcatcacgttccgctgcccccttttcacaaaggggcacagggatgtcactcgccgtagtcgggccgctgatcatcacttggccgacgcggcgctccacgttttcgccgctcagacctgttaatcgagaaccaaccttcgataagtcaagaggaatgcggacacaagtatgtcaagatgaatgcgagaaagataccccgaggagaaacccgggtcgcgtcctctggcccggaatagttataagctggatgggcccgagcctgaagcggctagatccgcctaccaacgaagtctgcaacgacttcatatcccgacaaaccctgtactcagagatcgtcgatgatgtcgagaaacgactgaagagagggggtcaaggggggcttggcggtccaagacggaatcttgtccggttgatcttcgggaaccacgaagacagggttcgagtccttgatctcaagataaaaccacctattcctccacttgctgcgagaagaagggcactggaagggaatgtaacgcaacttcaggccatcccgaagtcggaacccaacgcaaccagataccctgttggattccatccaacgcagttcgtagtaaaagcaaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggaggagggagaaaaccgcagagaacataatcttcgatcgcaaccatgcgacccaagatgggctgaggattagtacctcctacttccctctccatggttccacagccaggaagagcgccatcctcctatagtttctttaacgttgcactggtggaagccgatttgccgaggtccattgctgatcgaaggtcgccggaaaacgagcctagattgatgaactagggtttcttgcggcggcggagaaggcaaagagtgcttgcagtggggtgtgtttaacaggtttggcggacttcaaaatggactcccaaaattcctttaaataggcgcactaccgacggtgcgaattccagggaatagagagagatgcccgccggaaatttctggtcccattacacgcggcggttttttggacttcagtttaaaattcgttcgtgaccgttgggcttcaaatggcgtgctcgactacggtctatctccgcggtcctcgcaccgggaatgacaacagtctcgacacccgaagtcgcaaatggttgcacgagttcattttaagcagaagttgggggctactgtcagggttacaggttaggcataccctttacccttcgatatacgtcacatatcggtatggtatacctacacgcatacggatgcttcccgcgtactctaaggaaatccttcacagagtctatagatgggaagaatcctactcggacaagattgggtcgttaatgtatcgtacagggtctgacatctccgagttctacttggagacctccagatctgcgatataaaagggaccccccggggagggcctaaggcatcgaatctcagagccagcacaacccacacagcctacgaagccagagcctgcagggagccaagtcatcgggatctagtcgaaccaactcgactatgatctcgccggatccgacaagttcccttgttctctttgtaacctgtgttttctaccatataatcccacatcaattggattagggctattacctatcaaggggcctgaaccagtataattcttgtcttttgtttgcttgatgacgtactacgtagatccttgtaccaatgtaccccaataccctctatatccggtctacgggtatcacccatcgacagacaatgcccccctgaatcatgcccgatagggttagcgggcaaatctttctgcccgtaccccgatggatacccggagagcacccgacgctgacgatctgagaagtgcctgtcattgcttgcatcatcgctcgccgccgccgagactctactgatgctgtcgataggagagttgactacctgccgtggttgcgttgccgactctgtcgcctgctaagccccccgccgtcattgactccgctggtaccgccgcttgctcccgccacttgctcgtgctaccactgccctgagagccgccattgttcccacttgctcgtgcattgccttcagccgccatcgtcgttgcttgcccccgcgctaccttgagccaccgccatcgtcgcttgccggcgctgcctccacatgttcctttgctaaatgtgctgtcgtcgccactgcgttgaagtgaggtgggatgaaaattaggttatggtttgatgttgttggctaatgggccaagagagagatgagaatgaagatatgggccaaaatcaataatacatatatcgggtcgggtatgggttatccgcgagtaaaaaggtaagatccggctgctgcccactacattatcgggtctcgggcgtgcatgcctaagggtaaaatattgcacccatgcctgtgcccatctggtcgggtaaccgcggatacctgaacccgtgagcaaaattgacatccctaattttattctctagctgcttttcctagctttcgtattcatgtgaccatgcggggtctcagtcagccaaaaaaatccaccgtgaaaaacagtcctgggggtgtaaaataaattaggtacatcatgtacggaaactgctatttcgcggctagtcgcgcgcgccctccccagcgtgactggacacagcgcgcacggggaggagggtggcagacagccgctcttttccttttttttttccttttcccgtttctattgtttcttcccctcttttccgtttctttttcgctttttcggttgtttttttcctttctttcgtttctttttcttttttcggctgttatacaaactatgtatacacatatactaagtctgtatgtatgcgtgtacaaactttatatacacatatattttttcgttttttaaacatacatatataaaatatacaaagtttgtatagtttgtatacatatatatatatatatatatatatatatatatatatatatatatatatatatatatattgtacatcaaaagcatatgcgaatacatataaaaaatgatatagaaaatatatacaaaatttacacatatattttatcgtctatatacgtgtgtgtatatatatgtatatatatatatatatatgtatatgtatatatatgtatatgtatatatgtatatgtatgtatatgtatatgtatatatgtatatatatgtatatgtatatatatatatatgtatgtatgtatgtatatatatgtatgtatatatatatgtatgtatgtatgtatatgtatgtatgtatgtatatatatgtatatgtatatatatatatatgtatatatatatgtatatatatgtatatatatgtatatatatatgtatatatatatatatgtatgtatatacatatatacatacatatatgtatatacatacatacatacatacatatatgtatgtatgtatatgtatgtatgtgtatgtatgtatgtgtatgtatgtatgtatgtatgtatgtatgtatatgtatgtatgtgtatatatatatatatattatatatatatgtatatatatatatatatatatatgtatatatatatatgtatatatatatatatatatgtatatatatatatatgtatatatgtatatacacctcatattgtatgatacgaagtttatacgtacatatttaagacatatatacatacctatacatactgagactagagggctagcgctggtcgcacgggcgtgccggcgcgatcagccatcccccatcgtatacctgggcagtgctgttaatgtccgcgaattaaattcgactcatatacgaggaacctaatatgaactttattttcctgttgcgagtgtatcccagcccatgtaagacgcccgtagcccatatcctatctcaaagcagtcagcgcaggcccgcatgctatcgcaacgtgcgtcctcaatccccttcgccttcccgtctgatgccacaaatcaaagccctcatcctcttcagttcaccgtgaacaccatctatggtggaccgtgcacggcctggccgattcctctccaggagtgaaaccgtcgcaatcaaagtgcagccaacaagtgtccgtgtttaattcttttcacttaacgtatgcttttattcttcaatccctgtatatcatcgttgacccttatacttttatcaagtgtacggacttactccctccgttctataataattgacgttttggacaaagttacggtgaaatttttataactttagccatcaataactttaaaaatatttagtttagagaaactaaaacaacatatatagatttgtttttcaaagcaccataataataaaagtaaacatgcatttatttattgtatatattataatagaaaaataaggttaaaggtatattttgtagaccgtgttattattcaaaacatcaattaaaatgaaactggagggagtacctgggttagcagctatcagcctatcatgccctcaccaatttagcacgacctagctccctccgttcttaaaaaaaaatctagtactccagattcatagtattagaatatatcacatccagtactagattatttttttatgaaacagaaggagtatgcccccaagaacaggcacttgcacttctgatactcatgtaggatgtagcttatgacatatactttgttggtactttgtccccagtatacttacatgatcttttttaatgattaattgatcatttcctacaaccagctctcatgtatattactatcctatctaactgactatatacacaatgcagtgttgggcaccaaagcaatatctggccatgacaccggttcacagccgtctgtcactggccctgtttgatttagcttaggattattataatctggattattaggagtaagctgaaataaacaagtagattattacgatagattattataatctataagccagattactataatctaataatctcctatggatgagctttttccagattattaggtggctaaagacccactacccttagatgccttcaataatccagagaaacaaacaactcacagcttattttatgttagcttattataatccagcttagagtaatatgatttaataatctagattataataatcttaagctgaaacaaacaggccctaagtagcttctaactctatagtagattattaatctattagtttcttttcactttcatcatatacgcgacatcaaccatttcatcactaacttatgctccgagagccacctacaacttatagcccataacttttactcaaatactccattcatagcagttcaatctagaagagtagcccgactatcattcctagaggattgtgcgatagtgtaggggaatactgagaagagggtggaataatttaacccataagggcccctttgaatcgtaggaataaaaaaacggaggaatagaaaaaacatagaattctgacaggaatgtaagtgtaaaacagaggattgcaaaacacaggaaaacgcagcaatgaatgtttgattgggccacagaaaaaacgtagaaatcggatgagagagatatactcaaaggatttttactacaaggttgaacctcttgctaagtttcctccaaaaactatatacaataagccattccataggaattttgtaggaattagaaaacttcaatcttttgaatcaaagggctacatagaaaaatttcctatagaattttaatcctataaaatttcctttgattcaaaggggccctaaaagtgtggaactgctttagccaggttcaaactagaaagcatggaatacttcttctttttttcttttttgaaaatccaagtttaaaaccaaacaaacttctcagaggataaatggggtcctctcttatcgtgaattcatatattccttatggtgaatggggctatctcccgagcgtgggttgaggttcgtcatcactcatcaatgaaaaaatggaacacttaacagcattttttttactcgttttagttaacatatctttgtacttgtgcttattgtctgatttatgttaatgcatcttcttaatatgtctttgagcagctttgttttcgtgccgtttcgaaaggattttcataatagtagagagctttcagatagtgattgacgttgatataaatttatcaacaatacgcacaacaaaaagtacattctaagtgaaattttgattggttgttgggaattcaaatttaaaacaggccagttcaactaaaatttgattgaaattcagaaaaaagaaatcataccattgagactcgagattcgacacttaatcagaaaggtgaacctgagagtaaatatggttcactgacaagtgaaaacacgcccaatatataaactaaaaccattggacaggttgagagggttttacaaaagggatcattttgcccatcgaaaaccgccccaacctgctcagaaaaaaccacaccccatatgttttgtcaataaaattgacaaccgatcaccgatgaaaaccaccgaaactcaaataaaatttgtcaaaatttctagtttaacttcttcctaattctgaacaagaacaagatcgataagactgataaccactcaatcgttgcatgttgaaagtcgagtcaactatataaatccaagtatccaactctctccacggataataaacccagttgtccatcaacatgactggataatgacgagccaacatgtataggttttgtttggaagagctcgaaattccaagaagtagcttggatcgtcccgtgcatacctctgctctctgacgacctagactggtgaatgaaacatccatgtaaacacattttgatgtgccgatcagagttgcatagatcaacatcaacatggaaaatacgttcttatatcctgtggcatggtagggataaaccaaagtacgatctgggactgatctaatccaatcaaattcatgatgaccttgtgaacatctcttgattgatcaactctgtttctctgaagtttcgaagtttccatatgatcgacgcaattaaagatagaattgtatcgagaacgaagcacaaacaaatctacagttaaaaaagatcaaaagggacatgcatatgttttaagcctaatgactctctctctctcatcgctaatgacgaagatcaactcagagccacagggctcctgcctgcttcaagaccggcacgagctcgccggccatgtgcatggccatgagccgatcgagcccgcccaccagcctcccgccgatgaacaccgccgggaatgccaccgccgctccgccgcctccgtcgcccgccgcagccttgtcgccgccgtccttgcgccggcgggcctgcagcgcggcgtcgacgagcgccgccgggtcggcgtcgtcgccgacctcgagcaccgccgggttcgcgccctgccccagcagcaggcgccgcgcgacgtgcgccatgcagcacccgcgccgccccaccaccacaaccggcttctcctccaccgccctccgcacctccctctcctcgtcggccgccgccgccgccatcgccgccgccgaccttgctccttgcatttgggagcgaggaggggatcgatcgcgcgcgcgcggggcggcgagtgatcagggcggtggtctacttgtcgaggtgtgaacgcgtcgtggaccgaagcgaccgctcagatatggagccacggatggttaacttggttaggtcagcctccttgtcttggtatgcaccaatgcacataaaacatggaaatcatttgtttactccttaatttctgctcgatctgcttcattggaaattttttttggaatatatgctattatctggaaatccggccattaaacgttgaaaacacggaaagtcattaaagaaaaagatatcacgttgtgagaatgatttgctagattgatggacattatcacacaggttttgtatttgggttgaatatgtatgcattttctttcttttttttaaaaaaaaaagaatgtgagattcaattgtacaagtcgatactacgatggtcaggtgctacttggttcaaaaacaaatggaattgcctagttgtactacatatgcaaggtcagcaaaactgttgccaccgagcaccagggtgttagcaatcgtcactgccatcatcatcagttgaaaactcctcgtcgtctactcgtcttcgctcggcttgcctcggtgatatccatgtacagtatgtgtggtgtgtgtcacatgtgcgtaattatgtactactagtccattcgtttcgtcatcagtgatgcgttccgatccatctcgtacttaatgacgaacatgtcgtcttgactccactagacccaaagtacagatcagcaggaccacgtagatcaatacgtagactctacttccaaacctgagtacataattagtactttttttctctctcaaacccataccggccagttcaagctatggtacaataaacgcatgtaaaatgtttggcaagtcaatctttttttttccgagtttgggtcgtggcaactaatgagcaattacacatttccttgcatagctagaagttgatttttttttaatagagggagtagctagtttggtagcgaagtcgttcttaaatttcgttccctcccaacgtgcgcataacaacatcttcaatagcattttcaaatcagactctccaaacactcatatagctaactccccatctgatttagctagtcaaactagatactcactccaacagatcaatgctctccaaaataacaacggacccacatgtcagcctctactcttcttcctctctctcccattcttccttatgtttccttcttttcccctttccttccttcccgtcgatcacattgttgccgacgacggccgacgcatggcgcatggtggtgcagcgacgcgggaggtggaaggcagaaggcggcgcggggaagtgggaggcggcgctgggaggcggacggcggttcaccaacgccgacgctgccgaggtggtccccctctccccgccgaccactccccgcagctgagcgccgttgagctcccctcgggttgccagatctagaggccgccgccgcgaggtgttttggctggccaaatctagctagccagcgagcgagtttggccatccggttggtcagtctgttggatctcttttttgtgcttgaatggccaaaatttggctggagagactgttggagatgccctaaggtcgtctggtccttggcatgtgatgtgcactagggtttccgatctttcaaaaggttctgataaacaacgatttgggcggagtcgtaacaaaaatcgatccagcttcttgaatgcgcacgctcttgagcctcgcaatcgtagcaccacgtctcctctggttatcacccgtgtcgaaacgcggatgacctcgctgagaaggctaatccctgtttgccaatcgaagaacacaaacaagaacgagatagaaaacaaccaaaattgcagatgaatgattaagctcacgagttggggtcttacaaaccgatctagcgacgaaactgttctcgacagaataatctaagcaaaacccaaaaacctaaagatggcggcgggtactgatatatagagtttagggtcgtgcaatcccctctcgacgcaaccctaatgggttccaacacgatacacgggccaaaggcccaaatacggtgacgcagcaccaggacagattctggacgtcaacttgttcggtcaattcccattgacccggagagaatttggacgtgggaccaaaaccattggaaaggttatcttcttagctttccatccatataaagaacgccccaatccgagcatgtatgcgacctgagcgtccgttttagtgcagactagtcctggactccgaattgcactcgacgtcgacttggtttgggcctccaccttgacttagacgtccttgatgatcctccatggctctaagtccttctccaagtgtcttcttgtctcctccattatttctaagcacaatataatcattaggtaacaatctattctcgaattcatacaaagaagaacataggagcgagctcgtctctaaattcaattgtcgcgcacgagctcttgttatcggttcttgaatgaccgttggaggattgttgtgtgtattcgaggtaatgatgtccgcagcagcatgtgacagccaatgcaaaatacagtgctttattctcgattcatctcttcagtcaatctctaattatacgagactgaataaatgtgttggtcgtgcaaaagcggccaagagcagggtggtgtagttcgcctattgcgcgttccgcggggtgtacacgtctcaatagggatggagctatcgtccggctagcccagacaatcgccccggctcaccggtgaaaattccattaaatattactaatacttttgaataaactgatcaggaaatttctatagcaaatgtagctatagtgaaatttgccccgtttcaaaagtttttctaactccgccacaggtctcagtcaatgtgcgcgtctgtggcaaactggcaatgtggcatgcatgcagctggaggacgacgacgatgacgaggaagcgcgcgtgatgcgcggcgcgccgcacgtcgtcagggcccggatgatcgatgcagcgtgatgcagagtgcagggtgcgcgccgacgatggcgagcgctcacctacctagctaccgtgtgtttcgtacgcatatgtggctacctacgtacgtcgtcgtcggtcgctggcgtacggtgtgtgcgtgtgtgcatctcgcatgtggcgcgtaggctggcgtcgggtctttatctgtacacataggcgcggcgctggcgaagaatgaagcggccatcgatggggatcgatcgatcgagctgtaggctggagcctgcaggatgcatacatgcgtgcagtgcacacatggggagcgacttgcggacggtcggcatcgatggttaagaggcagcatgcaagcgaaggaccgaattaaggggccccgtatggaaattttgttgctttggttggatttgatcatctgctctgttttaatttgccggacagaatgtgctgttaattcttggatccccacctggactcctggagaaaaggagtccggtccaacaattcggccctgtcgtcgttgctggcgaattttcagtgaagctcatgagctgatgtacgttggggtgtgggtgatggtgttgtcattcagtatttcagtgtgcccgttggttttgcgtacgcctacatatacattggttttggcttgtttgcctccatcgtttttctctcaacttttgttattgctggtccaataaaaccagtatctctatacagagtgccatgttagaacgtagaaaagggttctccaaaaatttctcaggacagtacatataaattataagaaaaaataattcaaccagggtcccgtagctcagttggttagagcgttggtcttatgagccgaaggtcgcgggttcgagccccgccgggaccaatttttgctgaaaataaatgcaaatcataatattgttaaatacattttttttgctgaaaataaatgcaaatcataaacatctgtatgaagttttttttattatttaatgcaaattaaaataagtttttgctgaaaacgattgcaaatcacaaacatctgtataaagtaacttctaaaagtatttaatgcaaattgcgaccaaattttgctgaaaatgaaaacaaaccataaacatctcgggtgtagctgcttgcctcttcggcgaactatggcagcgaggtcgaggaaagaatattgttaaatgcaatttttgctgaaaataaatgcaaatcataatattgttaaatgcatttttttgctgaaaataaatgcaaatcataaacatctgtatgaagttttttttattatttaatgcaaattagaataagtttttgctgaaaacgattgcaaatcacaaacatctgtataaagtaacttctaaaagtatttaatgcaaattgcgaccaaattttgctgaaaatgaaaacaaaccataaacatctcgggtgcagccgcttgtcttatcggcgaactatggcagcgaggtcgaggaaaggcggcggcacatgtagggaggggagcaccgtcatcggacgcctctctgccctggttgctattgccaggatggaagccaccggcttcaagggctaaattgacacagcggtagtgcagtggaggaagggagaaagaggtcgcggtgaaaagggaggatagaggactactaacggtaaaatttggcatattctattgagtaaggagaaagcgcagagcggtattgatggcgtgattttgggatccaaagttagaagattgcatcagctaaagcgtatcggcggcagagttatgaaagttgccgataggacatggacgataaccaggaatcgaccccttgtcggactcggtatgggaagatttggtgacgttaccaaggggaggtcgagttctcgataaggatacaacatcttaacttatttattaaatagattgagttagttatttccttttatgttttaggaaagtttgttttatagttcgattgggcttgtaaattttttactttatccttaggaaaatttgagttatatccgataataactagtatttacttatggtataaatatatacatacagagtctttgtaaaaaacaacagttcaataatcacttttcggcgcattcctaccctagtttacaaggttttcatctcaacgagttcttatattcgagttgaactgtatcggcttagtccgatctccgacaagaggtgagttccgtcaatagtttgcttgtatcggcgaggctagggcttccatcgattaagttcgatactctaaatcagtcgatacaagcgctaatttatcatatacattgttcaatctaaattaaacaatgttatttacccatatcaggtagttcaactcagggccaccttctattgtctaaattactcttgtaaggtttttttagatcttacgatttctatcacagcttggtgctgcatcagttagttttgacctactaagttgtacttgaaattgtaagaactaatttgctctttgattgtcgatagggtcaccggggtttcattcggtcttacctgatataactattctgatttactgtctttgcttaatatattatatctatcatcttatctaagactatcaaacattcaaatctattaagcttgtaattggtcccgcaacatatcagttaagtccgatatgttgggattaagacttgtttagtatatttaactggaaacatgatatctgttgtatcagagttctagctgatatgttatctctaagaacctaagttacttcatcagctatgatataaattcatatattaatttatttcctcttgagtacaagcaactaatattgtctcggttaggtccgatctatctcgattgctcgtatttaaggcaaagatcgaattagtaattgcatgataattacctctaccgccgattgcaagtaatttaggtctaatccacaaacatatgttcatcgactagttatttcagttataaaattattctatgattgactttaactttattaattttatgctatataaattgtgtttgacatatattattgatttttctaagaaaaagttatttataattatatgtaatctagatctagcttatgaacaagtatccttcatatttatagccaattcatttgtacaatagtttacgcgatacaacatcggcctatcggctgattggctatcatttactaatttttgctattgtctatcttattaattgcaggatcacaccaaccggcacgcctttaaaccagtagttttagacctgcattaaagttaagcaattttttcagagcatcgtgttttgcatcaatgaggacacggaacgtgcaaggacacgtgagcttagagcggtgccagcgacaatgctccagttccattcatgtcttcttgggctatggcggcagaaacgagggagctcagcagcattgggcgccgccgatcccattctactggactgctgccactgccgggcatgaccatccctgtgctccttctgaacggttgaagctcgagcattgttgtcagctaaatatttcctaactaccctacctaagcattgttgccacgtcatcaaataccgtctacaatactgttatagaagtcaatctgtaccggttttaataatttgagtcttccatcccgattttatggttacattttaagggagttaaagtggacttttttctaaataaaaatacacaccaattgcctattgggcctgtccctagaatgggctcagtgggctcgctgcgagcagttacaaaacgggagaaaaattggcgagcacggcgcctccgcttcatccttttccacctctcggccggcgtcgccaaggtttgctgcgactgcgaggcaccccggagccacaaatcctccccgccttcgcgcgagctcgccggggggagagatgctgctggacgagcccctcgacttcgagaaggaggatccgctcctccctaaggcgcgccccgccaagaggtggcaatccgtccccattctactccgctttctttttttttgggtgccgattgatttgaggggttggagtggatgtcaggttttgagttccatttttgggcaattatatttctggcgcgtatggtcgggtctcgagtaatcggggtgggtgtgatttcgctggttgcgggggttcccttcttctgatttttctagggttttaggggataaagtgaaactgcaatgtcgttgctttggctggtttatgtttggtagtaggattgaagtagtagcagtagcactcagtcgatgaatccgtggtgtttgcagaagattcgtttgatgagtggtcactggttagctgacaagatgtgtagtgatgatatatattgttagttaccattggaatcgtttgccctcaaggtgtgtaaatgtgttaataacagtttggtgtaggtagtacgaccattttagagacatatttaatttaccactgcccattttcttttcaggaagaaggttattgggttggacgatcttttagaggatttctttgcaagtggtaaggatgaccttaaagcttatggtattgagtccaagcatggatccaaaggatataattcagatgatgaagacaagaaagtgaaggagaaggagattaagtttcgcaaatttgttgaggagtatgaggagcaggtagttttcaaacaaacatctgttcataaaacttttacattttctatgtatattcctgtctctaagatattattgaatttacagtcgaaagagttggatgctggtgatgatgtgccccaatggggtcagagagtttttggttgccaggttaaatggccctacatttattcagttaatgttgagtgcgacagctaagtgattttttctattttttaaaactaaatatccttatgtactgtgcctgcagaaatccccttctgttcttactgtcacaggagttgaaaattgtcaacttctgaaatcattctgtgcaaatgagcatttaggttttgatctaaacattgaacaaggttagttctgttacgagtgtctaagtatctgacttgcaaaaaaagatgatattatttgacttgtctttgtttctacttgagcttttcttcttctcgactgtaccactatggcataatattcttttatcagtcacttcaacatttctctattgctatttgtgtaggagaagggtttctagaaggcttgttggtggatggatggcttttgaagttggtcctcttgcatggctctgttgaagattctatagcatcttgggcactaaccaaatgtaagaattgatatatgtgtgtttttccagttattattgtttgattaaactgtactgtatgcttaacaccactagctaccagtgttgtactcgtgtaataagaagtttcgagttgctgcatctgacttttgggacagtgttctttccctaaatgaggtaacgtatttataagcaaatgtatggtttgtgttatactttgaagattctgcatgtaaatttttattcgttacaggctgacaaactctcagttgacattggacactttccaagctactctgttctaaagagtgccatactcaactatggatatatatttgataattgcactgaagtttccacctctgaaagtgtgattgcaggttggttccatccaaattgttcttcctttatttacagtttactcaatttttaattcactaattttcagcctcgtgattatgagcattcatgaaaaattcatgtttatttcgttatttctgaattagtacccagtagtttggacattctgaaaattaagcttttcctatttattatttgatacttcagatgatggcccacctcaaaacatcattgaatggttaaaaattacatctgcttgctgcaaaatcaggtaagtggaagcttctgaagctattatacagagattacattgccttaggtgtttctacttttctgtcattcacaaagtctaaaacaaaagacactattacacactaacaatttaacatcaactgatctctgtaacttcatatttgcttgttagtttcaacagagttattttgtgttgtaatctctcaagttttggctaaaacaaaataatcagtataaatttgtgtgttattgcttatatagatgatagctcatagttatattatattaggactggatgtttctagctctgtctgtaatactgatgttatcccagtatgatgcaaaattctgcccaaatctgcggtcactatattttgcgatgataacattctagaattgttctactgctacttaagggacattttagtttcatgattctgtcctgttctgatgttcaggcttccagtgtggctttgttgttccactatttgtgatagcgatgtctttttgtatggtgaatgtaaatctctgtattcatttaatccttctaaaacaataaatattatgatattaaccagtgtttcagtaattctgctattctttttgtaccaagttaattctatttgaatatttatttgatttacagaaatgtgcattccatattctcatcttccgaggcagaagaactccttgttattgttatttccttatttttggaccgacaacttgagggcctgctgcttattttgggagactgtctgagttcacttatcttgtacttcaattcaagtgaatgggaaagtagctgtctaatagtggctcagtccatttcccagaggtaaattttttcaaaacgtcttatttttaagacgagatctgtattggtgatttgtaaccatttaccatttcatggtatactgatgcccaattgaacaagtgctcgagtaatttatgggtgaatacattagttagatattgactaggatgcaataatgctttctcaacaagatatgtcggcgatgaaccttgttatgccgtttgctctacgttgaggactttagcttctgtacaattctattccatctcttgcaatgtttcgtgtacagtaactcatggtattttgttaaagaatagctcacatggcttttgcttacgatatttgcccatctgaaatcaacttcataacattgcagagtcacaatggacctgaattgtttaaggattgttgactgtatcactgggactgattaccgtagcaaattcttaaggagccagctggccctacaattcctcaaagttagctttggccttaaggtaagcatgattgatgagcatgtctcttcaatataccttttggtatggttgtgctagcccataaatttttgtgtgttctgcgtattcaggtggcaaatgttgagaagatcttgaagtcagtcatgtccataaatgtgaaggataaagattgcaactttttcagtctgtacgtatacctagttttgatggataacttactcttctcaagtgatgcctttagagataagcatgcgatcattaattcttggcgtaattatctgcggaattgttcaacccaaataggatgcacagactggagattatatgcctcaaaggtactaaaacattgcattctttcagttggtttttacccatttctccatcttggttataccggaccattttgtttcatccaggttcggaacaaggcttcttatcttctgcaaggtgcggtcttgagaagatctgctggcggtgctagcttacccgttcagtaatttgaacttactgaactggatcaaatggtgctgttgacagtatctatatttaaactactagcaccaaaaactgcatggcagggcaaactttcaggttcttatatttgctttaggaattgtaggccatcttttgtagacaggggcaaaatgctggcagcttgtttatggtatcatggctgacagcacatttggcccatgtatagcttgttccagtatgtggaacctttcaagattttgagacacttgtagctgattagtgattaccccttaccgtcggttttgggatttgccatccggtatggagtgcacgtgcagcttcatcagatagagtctcctcgactgatcgctggaattggtcagattttgcgtgaagcgtggaattcatcaaatgtttaccactcatatttatgaaatattgtcagcattcaatgaatctgtgttaaacaggtcatactaactaatctttaaacgagtctattacaacgtccttgtttggctgaaccgatcttaattgtcagtttctcccgttcaattaaatggctcgtatctcgatgagtccatgttacgttctgctgctgcagctggtgcttaacatggcacaaaaatacggcgagtcggccgcaatcggtgccgattcgagtttgcttgatcatattcatatctgacatctgatgatgcgtactgtatgctgtttgtcattggatctctcgtgttatcggcgccgaactgtccagattccaaacattgtttttggacttgcctgctggtagccagaaaccggcacatggggattggccggacaaccagaggtatgcgtcgccttgctctcctgctatgctagtatcagccaaaaactcctgaacaatggttaggaatagcaacattttcacttgaatcgttgcgtttcctgatccaaggccccagaattttgctatattggcagtaacatggatataaaattccctttttggtcaagattgccttgctctcctgctatgatatcagccaaaaactcctgaccagtggttagtaacagcaatattttcattatgttgcctgatccaaggcctcagaattttgctatattggcagtaacattgatataaaattatcttttttttgtcgagattatatactactcacgttggctcccttggaacctctgaattctgcaacaatttcgtaggaaatgaaacatccacccttactagttactaggatagttacaagcagtggtgttccaaacaaaatttgtgcgagaattcatgagttccaaatggagcctctcagcattatagattgtaaatcctttcatttgggtattaacaaaaagaatagggcggttgccgccatattattcatagatcaaccaaaggaggatatataaagaaaaacaaaaggtgggaagagcactgaacatctacctagatggagtatcaccctcttggattggaatggaatttgcaggcgaaagtaacaaaactcaactactgaaatggtagtagtatcatcgagttggtgcttctggtttccgcggtaaaaaaaaaaaaaactcgtgtgatcgtgtgtctggtccggtcgacgccatgtatcgatccgattttaacactcttgtcggacgttgcacgccacggcctgcgcccacatccgaagctggtccttcatctccgccgccgacctcgcgtccgcctgctgcagcctcatcgccgccgccgccggtgatcggggcgccggccgccgcacgtggtaccatgcctccgacaggtacggccgccgcacggcggcgacggcgtcgctgccggtggcggttgtggctgtgtttgcgtcgtcgttgtcgctggcggagccggagccggtgggggtgggcttgccgcggaggccagggaggacgtcggcgaggctctcgcggagctcctcctggtcgaacacgaagcccaggtccctgaacccctgcacctcgatcgactccaggtcgctcgagctcttccacttcttgtcgtggaacaggctctggtgccggacgagcggctgctggttcgcgctgaacgaccgcagctctcgccgcggtggctgcctccgatggccgccgtcgccgccgcccgacgttctcggcgtccggtcagcctgcaaggatcaatgggttaaactcgatcaatcatcatccatggcggtcaatggcgtttgggggtgggcggtgcgtaccttggtggtgggcgtgtgcgagcggcagtgtctctccagcgtgctgtgggcgtgcctgagcctggacatgcccggcgtcgtggacccggtggcggccgccgccgtatcctcgcggcgggcgtcgtcgtcgcgccccgtcgcggacgacgtgacgggcatcgacggcgcgcgccgcagcgccgacctgacaccttcctcggcgatcctggtgcggagcacgccctcgtatatcgagctccagttcaggtcgtcgtcctccgcgtcggcttcctgatcgccaccaccgcccgccgccgccggggcctcctcgacgacctcctcgtcctccttggcgatctccatcccgacgcgcggcgacgggagcgacggcgtccggaggagcctccgccccgcggacgcgaacagcctcgacgtccccaccgcctccacacctttccccggccgcccaccaccaccactcaccgtcgacggcgacctgggcagcatcggcggcctacccccgccgccgccgccgccgccatgcctcccgttcttccccagcgtgttgctaaagaaccagtactcatccagcagctccaacgccggcgccgtcccctcgccgccgccgccgccatgccccgtcaagctcatgcccgcctgctgcgtggctgcccggcgactccggattggcctcaaagccggggtgggtggtggggtggcgtggcgtggcgtggcgcggcgcgacgctgagctgatcgagagcgatgcgaggacgccgctttcttgtccgttttcactcgctcgagtggctccggttttgttgcgaggcgaggcgacggggtggggcccgcttgcggcggtgggccagccacatgcatatgccagatgacaatgcatcattcatcgcatcgctcattattgattggatcagtaattgataagcttgatatatgtacaaccactgctatctccctttcatattatacgtgattttgattttttttctagtaaaactcctttaaatttgattaatttgtaaatgatatagcaatattttttatacaaaacaaatatattatcgaaatatattcagcgttatatttaatgaaactaaattgatatagtagatgctactaaattttttttataaatttgatcaaacctaaaggattttgattagaaaaaaatcgaaacaacatactaatataaagtggagggagtggctaacaatagcctaatactaccaataatttcatttcgttttcttccggttagttccatctctcgtgcagtagtaccacagccagatgacgtgacacatatgatagttgctaattgatttgttgaaagttttgaatgctggttacttcggcgagaagaaccgaatccggtatagcaacggggaattcagtgaaacgtacagatgcagggaatatatgtttctcgagatgtgtcatttagggtgccatttgtttacggttcaggctgcgaccaaatacatcgcaatcgagaatcgaccacgctcgccatcacgtacgggttaatcaccacgtcattggttagcatctctagagaagtcgccgtctaccatgatcactcgtgataaacatgtacacacatgtgtcacgaaacctagcgatcgcaacacggtgcgagcgctatcgaataatcgatcgatcccatattcccaccacgtacaacgtcacctattacgaactccctcatcccaaaatataatactccctccgtcctaagatatactttctccgtttcacaatgtaagtcattctagcatttcatatattcatattgatattaatgaatgtagacagtcattaacatcactatgaatgtgagaaatgctaaaatgacttatattgtgaaacggagggagtaacaactttcaaccctcagaaaatataactacttctccatcagcattatttttccaaccaatcacaaccctccactagttacttttcccacctacctccactgatcatccaatcacaactcctaatataagggattttgatatttagtgcaagcaactcctaatataagggattttgatattttgcttgcactgtttgaccactcgtcttattaaaaaaattatgcaaatataaaaaacgaaaagttgtgcttaaagtactttgggtaataaataataaagtaagtcacaaataaaataaataataattttaaaattttttgaataaaacgaatgatcaaacagtgcaagcaaaatgtcaaaatctcttacattagagaacggatggagtacctactttcttaatatcgtgtctaactctaaaacttataatattctgggacggatggagtaataatttaaaatcagatgagacatatctggactcctgtgcagatacattgtacagaaaatatatctcgtttgattctatattattatgttttgggacgaaggtagtattacgtacgttggaagttgagaaaaaaaagatgggataaaagaaacacggccgtatcaagtcgatcatttgctagctatacaagctagctcatctcgcatcacccaagcagttgattaatccggtcgcaatcatgcttagcgtcggttgggtgtgctgattaggctcgcctggtttggttggctggctagccagccgatgctgtgttggtcaatttaattttattggcttcttttttttttcttttagtagctgatcaattggacgacgagatgtgtgtgtacatgagctgcaaaatgaaaaacttgagctgagctgagctcgtggaagttatgacttagcgcgagaaacggcatgtgggggagagctggctctccatgtgcggtgggccccatgggaaaactcggggcgtttccagtgatcgatcgattgattgattggtttgtgctgccgttgccgaagccgtttggatggatcggtggccgtcaaaagggggggccatatgcccacgggttggtgggatctgacggcggggatatccgcgggcgaaagctggtactgagatccagtcgtccagagatttgtggacagggtagatgacacaacaagctagtcgtaggtcatccacgcacgtaggtacagtagtaggggtagtagggttcatgctccacattgggtgatttggttaattacctttttagggcactaaaactttgcacccatactccaacaaaggagtttaggcctctttagattagaggattttcatggaaatttcggagaatagtactactaaggattactccctccttcccaaattaattatcatgtaatgaaatttaaaatttctcaaattgatcatcatataactatatggacacggatttcatcggaatacaatcaatgcagaatgggagaatatgtgtgcatgctaggggtataattgacacggtgttctaatcgatacatgtattatgggagaacgtgtacatggtgtcttgattgatgtgatttaaattatcattggtcttggtacataaacatatatgatgatcaatttgagatggagggagtataattctatatggttatttgggtttaaggaaaaggcttaaggaaaataagagagctcatgtttttgtttcctttgctaagtccaatgcagctctccctttctctctctacttcctctctcttctacaagtgattcctataaaattcatgtgatctatttcctgtgaaccatccaaaggcactagctcaaatattatgtgttttaagatccatcaatattcaaaagagcatgacaattcattactacgtttttcttattatatttttttagtatcttgcatttcaaaggaggccttaaagaggtatgataagaaaattatcgaagaattcattgtcactcgataaagagaaaacaattgatcaaaattttgactagaatgtgcgcaaaggttctactccaacatcaccagatgaggcgtgaaattcgagttgaaagcatgaagtcgccaagtgataaaaaagtttatgttccaaatctatcaaccgtagctatatttgattgaagttatacataattgtttcaagattttgaattggtgaaggaggttgtaggttctattgtacaatgaatattcttgatacgataaggattagaaacgggaggtccatactataaaaggaggtaggataatatagtgaaatggtaatggtgccagatagccgggggtagcaagaacaactgcaggtagccaatatttgtgcacggctagttcttatgggtgggtggagaaggtagagccaaaagcatagcaagcatagacagtcctagagtgtttgatgccacaagtataaacaagacagagtggatataccgatgggtatttatctagctgaaaaggactcgaagatgcgagaggtgtaaaggtttcaattgggtctatgggctatggaatcttataaaaaattgggtgtatagtaagtttccatctttatattaattgtatcggtctagtttatacttcatataactataaattttcttgttaacgtattctattgtagatatattggacaaaaacaaagctttaggtataacgcgtgaactgttcgcaaaacaacatcattaaatcatgctcaaaccgaactatgacaattcgaaccatagaataaaacatacatgtatctgaaataatataaaactaagaccaatatactaatgcgaaagagaggtaaagtgggggagaaaacatggatattatgttggttttaatatcaactcttagcccaagataaaaagaaatgttgctgcctgaggctggccggtgaactaattaacgagatgaagagcttttaataatctacagtctcacctgttgactgttgtaagggataatctatcgatgacgtgtactgctttagctgtaataacaagctcaattattatacttgtcctaaatacatactcccccgcttcataatataagtcattcgaatatttcccacatttatatggatgttagtgaataataactaaatatctcgtaaaaaatataatatgtagacgtttagctccgatgagcaaaagatcgaagacagtagccactggcgagtatggccctgcaccttggaccttggaacaaaagagttgcacgcgtacttgttgttccggatcatcctgggccgacgcgccaccaagcgctcagttttggagtggaatcaacggaaactaatcaatcctaaggttggcgccacacccacatgcatcggtcgcgctcctgccagtccggacccgtgtcccagccgcgtcggcccgggcgcgcggcacacacgtacgcgggcttcgtacgaggcatccagccctctagctcaatcggcgcagtcctccacccaaagtcctaaggaaacccatcggtcgccgtctcgccgagagcccaccaagacgtacggtctcggtgcggtctcagaaggcaggcacacggtgctatcgttgagtcgttgccacacgcgcgcttgcgctcggtccccgtgcggcgcgcgccagtagctgtgtagcacgcgatcgcaggcggggctccctccgcgcgggtgatgtgctcgcgtttgcatggccttgctggcttgctgcgcccagtatacgtgcactaatcggtcggccgagctggtttcttgggttctttacaaatgttggggagcgctatagctttccacgaaatctttagctccccaaataatttggattgtcacatatattctgggaatacagttgtagaattcaaaaagaatgaactagaaatcagaaactgaaaatcttaacttctccaaattctacgagctgacattttaccgtgatcgaccgatcaatagtttacacaacagtgcgtgtttgtctcgttgaaaaggacaaggaaggatggatgttcccttcttctgaaacacaatatatatgaacataaatatgtacactttaccgttacaagcacatttaaagactgtaccgacgtaaatagattaataaaatcatcgtatatgtcgatatgttaacggatatatcgcctacaaagaaaataattaactgtaaatatgaacacatatgtcatacctagaatttgatcttgaataatcagattccaccacaatgaatctaactagttaaattacgctattaggatccccgtacctatattgttttcatctaatttatgtcctctatatgtgtaaccgaactatatttatattttggtatagttgttttattgcatagatatttgttaacatgtgttggacaacataaattaactttaccaactgatattcttacttttatgaaaaaaatatatgtggcgttatttgtaaaaccgatcgaggtactagtactgattaaggtaccccagttcccctccaggcctggaaaaaaagggttgtgctaaaaaaaaactgttgacagttttttgttgggaaaactttcgattttctagccattagatgcgctctaggattcgtgcaacatataaagccagaataaaaaaaaatcgcatgggcaaggcagtcatcgaacatgttaagctaagccatgcaacttcttattagcaataactcttttttattttatatcacttacaccctagttatatatcacttacatcttaattatagagtagttacataacacttataccctaattacagagtaattacatgatagttatagggtagttacattgtataaaattatgatttgcaatttttttaggagcacatattacttttgaatttgaaaattttttcccttctacatgtaagccaatttcttgttgttcaatcagcttggacactaaaatttatggtttgtactagtgtggattgtccccctataaccattgatgacaaatcctgtagtcaaaaaagttttggacctcaaaaattgtcgacaactccctggctagtcccggaaaaaaaaaatccttcagcagttcagttcagctctaaatcatttactattcagaacgaacaacagcagcaaaatttgaacccgtagtcccgtacgtagcataaaaccgtaagtaacgtgcgtatgtttagcgtgcgctaagcgaaagaccaaagtacagtatagccctgtagccgaaactatagtcctgcgcctcggtacacgatacgatgcccacagagaattccgtatcaatctggggctggcacgcaacacgcgtccaattttcacccacgcgaggagtggtggtgtgggcgcgcgcgggcgcgcggtgcatcgatcggtcgcgcgctcctgcatgccggccgacccgtttcgcggcctccccgcgcgcgacgttaactcggcacaccgcgcacacgcacacgcacacgcagacgtatgggtttctaacaagttacgacgatcgtagtcgtactcgtacacccaacacccagtctcggcgcaccgacgcgatcgagctaccgcgcgcgcgcgcgcgcggagaggagcggagagggggcgcagagtgctcgctcgctctcgctgccgcgcagacgcgtttgctcccgtgcggcgcgagcccgtagcagcacgcaatgcgcggctcgaatgcacgacccgtgctcgcgcgccgttgctgctgctgctggccttgccgcgccaagtacgtgtgcactgctcgattacggacggtttcctggattttttttcgttttatacggtacggagatggatagcaaaaagactccacacatgcacacgtcggctgctgtctgctgatagtctgacacatctactgaatcagcagtcagtcactacgaccatctccaattacacacagctgagtacgggcgcagcgcaaacttgtacttgttggaataatcacaagctgtttctatctggatcaaatctgatgatcaaatccaatccaggcggtcctcgaatttcctcccttgtttgcaccgtcgacgcgttcccgctggtttccgtttgttgatcaagatgcaccaagtattattcagtacagcgacagtccaagattaaaacaatgcacagaccttgttttcctcacccgaccgtctgcaagtttgcttccaagaccagccaattatccgtgcaagtacacgcttatgagaaaatggacattttaccatcttcaaaactaggtttcgctattatgccatcttcaaaacgtgattcgataaaatgccaatctcaagcctacgctactcgttggattgtcattttctcattttcttttatttccggaatcttttgcctcttcctcatggtgatcggacgaaaatgcccctggggccattggtggaggtcaagttggagggaattttcgtcaagttagatggaaggccaccggggctgctcccggaggcgcagttcgcggcgttcgtgcgacggcactggcgggagtactctggaccagaggagtacgcgtggcggctgcgcgtgttcgccgccaacctcacccgcaccgcggcacaccaagtgctcgacccgactgcgcgccacagcatcaccccttctccgacctcatccgggaagagttcgaggcgcggttcacgggcctcgctgccaacggcgacgacgaggcggccgatgccggccacggaggaggtggccgtcctccctgctagcttcgatttggcgcgacaggggcgccgtgaccgacgtcaagatgcagggcacatgcgcctcctgctgggcctttagcaccaccggcgccgtcgagggcgacaacttcctcgccagcggcaacctccgcaacctcctcaacctcagcgagcagcagctcgtcaactgcgaccacacggtacatcacattcacatcacactcacgccactcctaatctcatctttgaactaatcgagctattgcttgccgtcctcatctttgaactaatcgagctattgcaatgcagagaagaagacggagtgcggctgcggcggcgggctgatgacaaacgcctacgcctacctaatgagctcgggaaggttgatggagcattttccaatggccataggggcatttttgtctgatcaccacgagaaagaggcaaaaagtttttgaaaataagaaaaaaatgagaaaatggcaatccagcgagtagcgtaggcttgaggttggcattttatcgaatcacgttttgaagatggcattgtagcgaaacctggttttgaagatggccaaatgtctattttctcagcttattatatatagatgatgtgtttgttcccggcaacgagacctgcaaggaggagaaaaaagaaggcgccgtagtcaaattattccatagaaacagaaacgatatactctccctctgttcagttttgacagagtttgctcatgctatttttttcatgcctaaatgtagcttacagtgctgtccatttcgctcttcattttttttaacccttttaattggtaagcagtcaagcatcagtaataatgaagcatatatacacaatgaagggagtagaatggtgaatgattaattgtttaacactcaccaacttatcatcttcgtcccatatttttattacttctaaaaaacaaaaaaaaaacagaatgttaaatacagtatctcttttcaccgccaaaataaaaaaagtcagaatattcttatcttttttttttcaaaagagcagaatctttttatcatccggctactcctgaggcatggacaatatgacagtttgcccaatattagttggatacttaaatgtcagatgccgcccctacaaataccacaataggatccttaatcccgtggcatcagtttgctcaaacgagtggtttaaccacaaaaggtgaacatatttagcatggaagaaaatcatgttgagagttgagacccatccgctctatctgcccacactggctagtctgaacttaaaaccatactaccaaatgaaaagatagagactggaactcataacatctttataccatggatttcaatgacatcgtcaagaagcctggattctaaggcttttcctcaacatatgatccttacctaatttaagagccagagaacatatgatccttacctaatctaagagccagagaagcctagctttctgaatgttgatcaagaactagaactctgcatattctgaattgctctgacttgttttcatactcgttgtctgtccattgtccactagctagtccctgatattggggactgtagagatacaagtcatttagtcaataagagagaactaaaacttcttgaacatatctgaatgaaatggatgtattcctaattcaggactgtgctattgaggtgatctgaagttctgaacaactagccatccgttccccaaagctgcttgaataagagaaagctctacttgtttaaggccaagatcttcaaaatttaaaatcctgggagaaaagagtagaaatctacgggtggatatagatttcttcaacagaaagatcaaaagctgcaattcatagtgacaccaattgaagtatctgaactgtgcctcctcaagcttatccaggccaacctttggatgcgtttcctacagcgagccagggaaatcctcttcaaaacgtatatcactgtcatggattgttcggtcctgcaattacgaacaaataagaagaaaatcacaaaaaatgcagatacggattcagatgtaacaagatggcaaaccgatcgctgaaaaattaaaatgcaattcagagtgggtttgctggtatcaaccgtcacaaggaacttcttcagattagggcgatgacaactcttgaggaacacaaagatgttgccgaggccaacggccttgaattcaagcatggttaattctagcattgtcagactctggaagttatcgaggatggccatatcaagattcgctccaggatgccgcaagaaagacacgacctaaacaatagtgttaaatgatcaaaatccatgaatcgatcgagctaaatgaaatgttggaaatccaatatatacctgaagggtattgctacagatggagagggaggtgatgttggagagaaaaggtagattgttcctgaaccattctctcaacacttgatgaccaagtatcgggggattgaagcagaagaggaggtcggtaagcaagcgggcgccgccggagaggttgaacggcgaaagggggctccccatgcaatggaagttgtggaggggagaatccggcatgacgaccacgccgcggacgttgttgcactccacgataatgaggctactcagcttccgtgatgatgcaatgatcatggcgagggggccattgcagtagaacaacgtgaggacgcggagactgggggagaggatgaccatgcggcgcaaggcctcgtcggtgattctgacgtcgttgaggtggatcttcgcaaggcaggacatgggatggacaacggcgaacatggggacgttgaggttgagccagcacagcgtgaggctggtgaggtagatacaaggcgaatcaaagaccattcaacaacagaccatgcgaatgaaaagcaattacatgaaacaacgcatatgattctctattctcctatcctgtaacatatgatccttacctaatcaaatagagtagctatagaagttaagctctgaatctgattaagaactcagactcagcatattctggatcactctgtttattgtccactagctagtccataatgctaaagactagaactctaaattttccattaggtagtccaccggaactcaaactcaactactctgaattgctctatttattgtccactagttgatctttaactaacgactaaaacatcttgtagatctttgaatgaattgaacggtacgcagaataatgatctttcaagataccgataacagtgacacgtagttggccactagttaaatcttcttggatacgagaaatgttttcttgctgaagatcaagcaccgacgacggcatcctgacggaatccttctaggagaaacaagcaacagtctatggttgcggctagccttcttcaacagaaagatcatgaacttcagctcgtgccgacaccaattgaagttcacaatctttaccacctcaagattagctaggccatcctctagcgggttttgcctctgctcgccacacctcaagattagccaagccatcctctagcgggttttgcctctgctcatcaattggatcatattcaaagagaccatgatcactggttgttgggagctgcaatgcaagcatgaaccatgatttgttcagaagtctagaacgatcaaggtgaaatcaagatgcagatacaaataatggaatcagacgcaacaaaacaggaaaacacattactacaaaatacaattcagaatggattggcacctacacaaagagctccgtcagattggggcgggtatgtcctgaggaactcatatatgttatcaaggtcgacggccttcaattcaaacatgagaaactgtagcactctcaggctctggaagttggcaaccttagcaccacgcaaggaagacaaaatctaaagagagaacaacgttaacgaaaaatccatcatcgatgagcaaacgaaatagcaacaaattaagcgaaatgaaatggtggaacggggcgaagagatcgatccagcatgcatactgacggagcgtggggctcctcaccgggagaccgcgcgggcccccctttgccggttcggccgggggcgctaagtgagcttctaaacccttgatctgtggaatggttcgcgagagagcaaacgcacaagacacgggcgatgtagacaggttcgggccgctgagaagcgtaataccctactcctgtgttctggcggatctgtctctgaaggagttacaaagagctggaaagcaagagccttctaactctagagacgctctccctactctttttccccgtcctttctacgagcttccctttctccttctttctttttttcccctttttcttggtaggcatggtcctccttttatatctcaaggggataccacatataccatttctacctacccttcttttgggtggggacccatcctactttgagcaagatttggctc

SEQ ID NO: 67866 - DNA, 4360 bp, Oryza sativa
  unsure (1)..(4360): unsure at all n locations
tggttaggctggtaatctcacgaacttatttactgtaaaataaaatgtggcacatacagtactagaaacttttctaaaaatgggtatagctaataaagcctgtatatacaacttataaaattcataataaaatcatgctaactctaaaaatgatgacactaattttgttgaactcatgagaacgtaaaattcactgcagtaacctaatacttcacaaaatttgtacctaaaatgtatcaaaagcttaataagacataattaacctagagctagcattaaactttaaaaattaataactcataaatgcaaagtgataaaatagaaaattccttcactaaaaatcatatgcacctatacacagtagtgaactcatgcattttagagcattttaattttttacatgttttggcatttatttgattactgttatttcttttagaggacaaattcgatatcagtgaggaaattggatatattgctgacctcagtgaggacattgatcaaggcaagtttttcctctccctttgaacatattgaatcccatgtgtttcgggctaaaagtgttcttttatagagatgcatgtgtaattataactattagtaatatgcccgtactaacgctacgacgatatttagtaatatgaattaaacaatcatatgctaaaagatacatattttagcaaaataagttcaaatgtctcaaaagctgaaaaaccaaacaatggtatatatattgttgtaatatatttggtctaaaaataatttcatattcctgcaaattatcgtacatgtcgtagtaacatggtaaatttgaatttaccaaacctaggggactgtgatgccaggatctactggaactctagcataatgttcatatcaagcagaacatggtgaaattcttcaactacttgcatacacaaaatgctcaaatctgttgattacttcaggtgatgtaatgcaatcacggaaaccacaaatctaactgtagatgcatgatttaccaacaagtaaataattgattgtttaaagaatctcaagaacgtgtgttagcttgctattcgtctatagcacatgaaatttactacgatggtgggaacaaaaatcatgaaatttatttgttgcagctctaatttcctaatgaacatgtacatccatcaggtatattttagttgatgcagacacacatgaaacatatattactcccttagatatgcacctacatagtgaaagtagtagaaagaactatccatgtgacaatcattaaaaccttgagaacaatctaatcctaactgataatatttctggtcatgcaatgcagtttgaaaatcattatctangcagactttagtattatgggtagcagcagcacaggtatagcaagatagtgactaaattagtacaaaatccccatctctgaaggacacgggaagacaacaataacctgaaaaatatcttcaagatattttctttggcttcattagaatgaatcctaaaaacctacacagctccttgttcaaatggtattcacatagacactgcttagaattgatcatccgacacaaattacttgtgcctgaataaaggaagtcagcaagattcaccgagcataatgccatagtagcatgaaatgcaaattgcagttcatgtacaatccaatcgtcagacttgcaggatacaccaactctgactctatattctttctgtttctgctctctaattagtgatagtgaaagcctctgttttgaatattatacaatggctaaatctagcaaagtaatcctgcaaatcaaacggcagaaaagttaatcaaaacaaaacgtcattcctccatcagaattaataaaaatccaacagggagatcgatcaatttgtcatagtaagtaaaaaaaaaagctagctagcaatagaacagagctattcacctattcttggccactcgtcttcatcagcacgccggcaccccgtctccactttctcctctccacagtgcctttcctccaaccctaggattacatgcagattacgaaaaaaagtgggactgcatcctgatctagtagcaaggaaccggatcaacagcgtgtgacggcgtctctcccacaacctcctccatcgtgctggcctccgatcgagaaagcatggtgccccagcggttgtgctcatctccggtgaccgcatcgctcgctccaggcgacgagcagcagcgatgatcgaacgacctcgagcggcggggagagaggggaggttagggtttagcgttctacgagaagctgggggtcagcggcgacgtcaatcgtggcggggcggtgtgatggtgaagatcgctggcggcgcgtgacggcgtgagagggagaggagagagattagggctgggggaggagcgatcacggtttgggcgtggttggggtgggaagggggtgctcatttgtggggagggtgaatctggagcattggatttcacagggataatctgaaccgttgagtaatgaatgaaagaatgagtgaaagtatttgtttaactataggtagattgactatcttcaaaattcggaaaatgatagctatatcctacttggtgcataaccaccattaaaaaccttgctaacttgctgtttgtagccataggaatatttagagtacattgttagtgctcaaatgaaactatttaagttttatgtgtaccctgcttagccatgcctagagcttttatgtgaatcacttctatattctgtttggacattcttaaaccttatggacagaggtgatgctctgaatatttgtgcactaaaatgatgaaaaatgtgaattttagacttgggcggtaaatggtatgcatatgacggtagttgcataccaataagaggattgttcgcatgagttgattaaggatcaaactacataacactcactcagggctgcagccaagatttagtgactgggggtgtgggtcagaattcaccagtgactcagccgacattggtgcggacgtgtggtcaacactatgtattggcgattagctataatagaaagaacgagaacccactggttaaggccctatttgttttaacttaagattattgtaatctagattattaaatcagattactctaagctggattataataagctaacataaaataagcagcgagttgtttgtttctctagattatgaaggcatctaagggtagtgggtctttagccacccaataatctggaaaaagctcctccagaggagattattagattatagtaatctagcttacaaattatgataatctacttgtttgtttcagcttactcataataatttagattataataatcctaagctgaaccaaacaaggcctaacattgggctctacaccttagcgacttggcttttgttgatggcagattggccctatccaatcacttcatatttgcaataaatgtgtataaatttgatatgttcacccagtcgtttctcgtataattatattttggattatatggttatttgccgacagcactaatatatgcatgtatgtaggttagtataatataaaaagaatcatttttaaactaggtcattaaatagttgttggtggctattaaatgtcaaatttatgccgccaatacctgcttatcttcttgagtccatttatttggctttacaatatatataatgctggtatgtccaatttatccctaccaagctccacctacacagcctagggacaatttggcaaaatgtgccttggtgaggacccacaaaatcaaaacaccagagtaattcgagagtaatttattatgaggagtatagccattttgtgaaaatgcataaaacccccaagagtcaggcaggaattgagaccgttccatttatcaattgcccaagatggtaagttagccactgttaaagttcacaggtacgagaatggttttgaataatttatgtgcttgcattatatcttggaaatttttattctacactagcttcttaaccttggatgagtaaagagctaagtgtgggcggtttgttggcagctataaaatgccaattttatgtcgccaatacctgcataatacttagataataaaatatataacatagtggtagggcttaattctggtatattccatgagtgttggtgtatattcggatgcaggtattaaaccgccaaagttgggaggaaatttagaccaaagtgaaaaagaattctatccatacaagagttgggctcctaaactccatcaaaacaccaaaaaatgggcccaactaccggaaaaagggataaggcaaagcaaggaggagacccagaccaaatctgggggccatctggcctagcccaggttcggccgaaccctggggatcgctgttgga

SEQ ID NO: 67867 - DNA, 623 bp, Oryza sativa
catatatatgcatccatctgttcctatgaaactagctagaactcacaatcgacgctatccatgatgaacgggtctctgctgctgctagctaagtaaaaagacctcttttcacgtttcagcagtaagatttcagagtagttaatgtgctcctcaagtgtcattttcagtggcaaatcacgattatttaccatttcggtttaggttgtacaaaatctagaagagaagtgcttggtgcaaatcactgcacatgtgcatacgagagcactgccaaaaaagaaaaaaaaactacaatgagttatttaggatgatcttttacaccacaaagactaactactacaattgcccattttatgcttccaaattttcctttttctccccgtcttgttccactgcttttgccaataaagcagtagctgatgcttccttgctcttaccccagaggagaagatagaggcctccaatcacaagagcagcacctatcgcactgcaaagacaaaaagaaaaacaaaagtgcgacttttgatgtgtccatctgcgtaataaagttgtcttttggccgatagttccttcaatttgtaactttttagcaacacgtcaatagtttaagtgatgctagttgatag

SEQ ID NO: 67868 - DNA, 9504 bp, Oryza sativa
aaggctcgaaaggttgctcttggagaggatgtgaagacactgcaaaagaagaataatgatgcaagcacttggaaagaggaaaataaagaactgttcatgtcactgaatgaacaagatgaaggtcccaaggagtctggctcacagggagttgctttggaggggaaggaagacctattctggcagcaagggctgctaatcattcaaaccatataccatggtgctacaaaagctcttccttcaagcttaaccttgcggaagaaattcttagagatattgagtagtgttgacctagcacattctgacgaactgaaggtagaggtcatggatgacctgaagaaagagttctctgacagtgaggactactgggattggcttgctaggcttcagcttagtgactcaactagttccagtaatttgaatagaatggaagctttatcaaataaactgaataaatcaatacaggtaaaaactcattatttggttatttttatctgtcactcaatcttgcctgctttctttgggagaaaaaaaaggttgttgattaatgcaacctgccctagacttacgaataatcaaactcaatatttaaacatttcaaactacgttttttgtattgtaggtgtatgatgaagctgtcaggaggttgccaacttccagaatgtattccctgtatgcaaaattttggatgggtgttctgtttgctgatacagaagattccatctcattgtttcatggcggtgaatttgatgcttcagggttcacttcatgtatactgaaagtctatcaaaatgccgaatcaagcggttgtcttactgaagatcttgcttgccaatatgtgtctctttatttgagacttggaggtttggaggaggcacctggaagattagaggaagctaggaatcttgccaaaaagctctgcaatggtcctctttcacatgctgcggatttgtggaacctgagagcatctattgagatgaagtcacttgctacttctactggcatttcttcgttcagcaaggagaacttgagttctctatttgatctatttaatgttgcacttccaaagttacccatacctgaggctgaggaattgtggcacacggtatagacccttctcgatctcttttactctcatgtgttatctctgaacttgtttcacaaagttttattctgctcctctattttcactgtgattatggttcatcttttcttttgttgatttgtttcttttacctttaacgatgcaatgtatttatataatagttccatggatgtattaatgtgtttgactgcttgtactaatttctactatctgtaatgggcacaatgcattacttcgttgcatatttgttcaaaagcttgttgtaattcatttcaggccatgaaattgttttctcatgagaaggtttatttcgaaaagctggtgaaatgtgcaatgttatcattaagttctgctggtggaaatgattgtggagcttcggtttcttctgctattgttggatggattttacaaagagatggtatcaagcaagctagaaagatgtataagaggtatgaactttatggtccttgaatgaaatatcactgtaatattgttcattgcatgaattgaatttgctttgctgcaagatttggagtttttgtctattaggcaagtagtgttgtctttgaaactgagcgaagcgtgctatgaattttcattgcacattccatgtttcagattctgccttttgtgtatgaactataagtgcacatagattcttctagaaacatgtgcgggaatcaattcatatgtattgtttgagtaagcatgtttctgacacctctgcatcgatgcagatttctggctttaccacgtccaagcttcaagttcttccagtactgcatagagttggaaacaaaccttgcatcaatcggaaaccaagacagccttgtgaatgctcgtaagctgtatgatgcagcgctcgatctctatccccaggaaagagaactttggaggaactactacaacatggagctgaaggtgagatccatatcgcttgtttcctcatccgattgttcttttaatcgtgattaagttccttatctgtattttatttgctgacattacattgaaaatgcacatgggcagttgggaacatcagaaacagcaaatgctatatactggcgcgctcgtaaggtgctcggtgattccagtgccctggacattccccacagctagcaatgtgtgacttgtgtatcatgcaatatcatttttgatctgatttgattactttgttgtttaagcgtatcaagtcaagtagcgcggtggaagaaaattttggctagtctatctgttggatttgtgttatgagcccctaactagggttaaaatttgcatgctctgtatgattgccgattaaaagcttgtacagatacggcgatagtggccgatccccgaaacatactactagctattggtgtttgtgtcaatttagtttgtgccaagcttgccttgacaaagaatttatcatctactagtccagttgaatggttaagagctgacgtagtgatgatgacggaatgcatactgctgtgttggtctggaaatgctccagcttgtcaggcagaaaagcaaagtatccagctgcacggggcgccgccacgtacgtgggtggcgaagggcacccgtccatgccgccgggggccagacacgacggcgatggcggctcctagtgtgctctgcagccaccccaccatcaccgtgaagctcctccggcgaggacacaacatcggatgagtttgtgcacaagcgtctaccatgcatgtttaaacaataataattctgcacgattatgataattcaccaatcgtaaaatctttctaattattaacacgaggtcagcttctttagttagtagacttgtaggtacataaatgtttacaagttgctaaaactaaaaaagaaatcatacatgtaatgtagagttgttctctcagttaaagtgaaatcttagtaatttggcggtgccgtaataatgtagtgcagttttcaacaaccaaaaaaatcgtctaaccaaatacatgtcatcctcttgtcttctaaagggctatatatattcttggtctttgatgctttcatacgaaaggagcatgattttataagtagtagtgctacactcttaaattcataggaattctaagggccctttaaatcgtaagaatgaaaaaacagaggaataggaaaaacacaagattctgacaggaatacaattgtaaaatagaggattgcaaaacacaggaaaaacacaggaatgactgtttgattggaacacaggaaaaacgcaggaatcagatgagagagagagagactcagaggaaatgttccaagaggttagacctcttgctaacttttctccaaaatgtgcataggattacacattctatatgaattttaaaggattggataggattcaatcctttgtttcaaaggccttcattggatttttttccataggattgaaatcctccaaaattcctacatttttcctacaaatcaaaggggccgttaaaatcagtagctagagatgttatattctacttttgaatggtgtagttcatatagacattaattagttacatactagttcatatagatgtttgtatttgatacggagtactttagttggatatggttaagagggagatagagacttgtcctgtaaccgtgagtctttctctgtttaaatttcaaaacttatcggttgcttgcctattggtagatgttttactattatactccctccgtactttaatatatatatgacgccgttgactttttgacaaacgtttgacctttcgtcttatttaaaaaaaaatttatgtaattataatttattttattgtgatttgatttatcatcaaatgatctttaagcatgacataagtatttttatatttgcataaaaaatttgaataagacgagtggtcaaacgttggttaaaaaatcaacgacgtcatacattaaaatacggagggtagcatttattaacatttttttaaaaaaaaataaaatcgtaatgtactgaatatgtaacttcatctgcttagaatattcatcagaatggaagtagacagaataagagaaaaggcccataaacaaaaggccggccctatcacctatgcgccgagaggtggagctcgccgcaggcggtggctgtcgcgtcgcctgccgccaccgccggacctccctgtgaccccgtgagccgtggcgcctggaggctggagagaggaggggagagagatggagagaggggagatggaaagggaggaggaagaagataagggggggtatgacatgtggggcccacgtggtcccacttttatttttattatttgatgtgtgaaaatgacatgtgggtcccacgtgctttattatttttccggatcgaattgccgcgtaagcgctacgtcagatgaataccgagttaaattagccacgtaggtgccacgtcagccaaaaccgctgagggaccttgtttgcccggttttcgtaagttgggggacgggtcgtatccggttttacggtcaagggacgaaaatcggactgtgcgacaaatagagggacccaaagtgaacttattgctaggctaaaattgggtggcccatgatcgaatagtactagtactaagtagatggagggagggaggcgcgcacgggcaccacaagctcgtcacctgctttctcttccactcaatccaatcctctctctctcttttccaatctcaattactacaatcctctcctctcctctcctctcctctccttcctttgtcgcgagtcacaggcacacagacatggccgccgtgaacacagtgtcgtcgctgccctgtagcaaagctggcgccgccgtagccgggggagctccgaggccgtcgacctgctccgtattctaccctcctcgttgctggtccaagcgaagcagcggtaatggcgtgcgggcgcaggcgtcgacgacggagacgaccgcagcgccggctgcggaggtgactactaaggtggagaaggtgtcgaagaagcaggtggatggcgtggtgacgaacaagtacaggcccaaggagccgtacacggggcggtgcctcctgaacacgaggatcaccggcgacgacgcccccggtgagacgtggcacatggtgttcagcaccgacggcgagatcccctaccgcgaggggcagtccatcggcgtcatccccgacggcatcgacaagaacggcaagccccacaagctccgcctctactccatcgccagcagcgccatcggggacttcgccgactccaagacggtaactagctagtagtgtttttcttgctccatcgatctcaaccacaagacatgagctaactaacatcgacatcgtccctgatcgatcgatcaggtatcgctgtgcgtgaagaggctggtgtacaccaacgatcagggagagatcgtcaaaggagtctgctccaacttcctctgtaagctaggagtctgatcatgtaatagcagttagattgtacttgtgtgctaattaatggagtataatttaggtgacctgaagcctggttcggacgtgaagatcacggggccagtggggaaggagatgctgatgcccaaggaccccaacgccaccatcatcatgctgggcaccggcaccggcatcgcgcccttcaggtccttcctgtggaagatgttcttcgaggagcacgacgactacaagttcaacggcctggcgtggctcttcctcggggtgcccaccagcagcacgctgctgtacagggaggagttcgagcggatgaaggagatcgcgccggagaggttccggctggacttcgcggtgagccgggagcagacgaacgcggcgggggagaagatgtacatccagacgcggatggcggagtacaaggacgagctgtgggagctgctcaagaaggacaacacctacgtctacatgtgcggcctcaagggcatggagaaaggcatcgacgacatcatgatcgacctcgctgcaaaagacggtactgtactagtacttcttttaatctccatctctattcgattcctaattactttctttcttgcattatatactgtatgtaggcatcgactggcttgactacaagaagcagctgaagaagtcggagcaatggaatgtggaagtctactgatggatatatatatgttaataattaattaatccctttttatctcgattttcatgcatgcatgcgcaacctgcatacgccatcttgttgtactcgatctgatctcatctgatgagatgcatgtagatattatactgacgattcgtcgactataaagtggtttcccattttctgctgtattttgacaactttagtgtcccatttatttattatatatgcgcatgtgaattaaaatgactgggctgctgcattacaatctacaagtcgcgagcgtgttgattgggcccatccatcatcattgaacggcccaccagaaagcctaggcccaatatggcaaaaaccctaaggccgtgtgcgtcacccacctatataaagcggaaaacgccactcgtctccttcttccttcttcttccacgccccgcatcgccgccgccgccggagagggagagagagagagagagagagagagagagagagcgagagatgaagacgatcttggcttcggagacgatggagatcccgtcgggggtgacggtgcacgtggcggcgaaggtggtgacggtggagggtccccgtgggaagctgacgcgcaacttcaagcacctgaacctggacttccagctgctggaggtggagggggtgaggaagctgcaggtggacgcgtggttcggcacccgccgcaccatggccgccatccgcaccgccatctcccacgtccagaacctcatcaccggcgtcaccaagggctaccgctacaagatgcgcttcgtctatgcccatttccccatcaacgcctccatcaccaactccaacaccgccatcgagatcaggaacttcctcggcgagaagaaggtcccccccattacccctttccctttctttctattaccatctaccagcacgtacatgatttcatcctacgcgcaatgtattttctccactccacgattacacgcctctattgattcatctcaactagtagctgcaaatatttaatttatgcctcacagattgcctgtttagcctacattcagcttcggatttctgctctagttagtcttgcaacacaaaatgctgattcttctgttaaaaacacattattagggatcacttgcacatacatcatttctgccatgcttcaatatttctcatatttgttctacacaacatagacatgtggtttagactctagaaaagcaaatcattctctggccttcaacattgtttttttcccaatctgctgtcacattcattcagtatatagcttggaaaccacagataataaaaaatgttatgacatccttcgtttccttcaataataggtgaggaaagtggacatgcttgagggtgtgacaattttgcgttctgagaaggtcaaggatgagctggtccttgatggcaatgatatcgagcttgtctcccgttctgcggcactgatcaaccaggttagatttcttgcacccctgtctctcttagctctgtgaatgtgtgctatgatgatcctgtaaatcacaatgcttcgttatgtcagactgttactactttaatttgctgctgtataatggagtaggtgttctgtgtgcatatgctttaagattctgtatatttcttagagtttgttcatgcttcccaaatctatctattatataattaaaggaatagaaaaaggagcttccacgttctctctcatggcttagaaattctcacattaatcagagaaaaagaaaaagcagagtccatatagaaatacaatttagaaatagctgaaattgggaataaaaaaataaggaatattagaagaggagactatagtccatatagaaatacaattaggaaataactgaaattcggaattaaaaaataaggaatattagaagaagagactagagtccatatagaaatacaattagaaaataattgaaattcggaattaaaaataaggaatattataagtagagtatagagtccatatagaaatacaattaggaaataactgaaattcggaattaaaaacaagaaatattagaagtagagtatagagtccatatagaaatacaattaggaaataatagaaatttgaaattaaaaataaggaatattagaagtagaggatagagtccatatagaaatacaattaagaaaaaaaaatagaaattcggaatttaaaaaagaaatactagaagtagagtatagagtccatataggaatttaaaactaactaaaatttggaataaacataataaaattaaaagtagagtctagagtctgtataaaaaatacaatttacaaataactaaaattcgaaattaagaaaaatatgggaagaagagtttaaggtcaatataagaatacaatttattagtaactgaaattcgaaattaaaaattgaagaatattgaaagatgagtttagagtccacatagaaatacaattagaaataataaaaattcagaaataaaaataaataatattgaaaaaaaagcatatagaaatacaatttacaaaaagttcggaatttaaaaaagaaatattaaaagacgagtctagagtccatataggaatatatataatttacaaataactaaaatttgatattaataactaacaagtatataaaatataatatgaaaattcagaaataaaaataaataatattggaagaagagcatagagtctatatagaaatacaatttacagaaaattcggaattaaaaaaaggaaatattaaaagacgagtctagagtccatataggaatatatacaatttacaaataactaaaatttgatattaaaaataattaataactaacatgtatataaaatataatatgaatattacacatattgcaaaatttaaaattatgttgtcattttaatatatttgaataatataatgagaaaacatatatgctattatatgatagaaaatataatgatgctaggcgcgcaatttgcacaggccaccatgctagttggatgtataacaacagtgttaagattctgctcctacttgacttaaatcaccaataggtggggtgatatctttgctactctgtgctgcacgagtctcatcttgttaggtgtctttactacctgatgcttagttgatctctgtcctaaaccatgtctatttcctttttgctcccaacagaaatgccacgtcaagaacaaggatatcaggaagttcctggatggcatctatgtcagtgacaagggcaccatcactgaggaccagtgagctgcgtttccttactagctgtagcaaaacctgtcctagagagagtgcacaaggaacttttactgctctgtttttgagtcaaatta

SEQ ID NO: 67869 - DNA, 1814 bp, Oryza sativa
ccaattcttcagctttggaggccatccatcgcaccatttggctcaagctggacaatattaagcattgtttctaaaatcagatactgtcgaataagtgaaatatactagaactttgcatagatgaagctaataattagaagaaaatctcagcaccttatcacatagtttcccttgttatcgaaaggagatggaagtgtccatgccttattctttgtcaacagccagaacttgtcagatgagacggggactcttattggggtctatcaaacacacagtaggcacataaatatcaatgccttatgtacttagaactaaatttactttgttactgaagtgtattttgctatcattattcaaggaactgccatatcaaaaggaccaggtcttattcattgggaatttgggacatctcatgatgcaattgttagtttgaaactgttactgagcatcaactaattaaatttcgcccccccccccccccaaaaaaaaaataaataaataattattattattatatatcgtttatttctgtgcatttgccctacgcaaagcaaaattagggagctgaaacatcctcatacaccaaaatatccatgatttcccatgatcaaatgaacctcaggcttctgatgaagggatcaaccatagttaatttgcacttggtctagagtctagacagcagaatggccaactaaaacatacttatatagcatatccagtttagagcagagaagggcatacatcctcttgcctccacttcgggatgagttcatccaacgctcgtggctcgaacacgttccccgacaatacatgcgcacctgcagcgagagcaagcaaaatcaaacaaacgccaaattacacgagcaggagtagagtaacgccatcgcgcactggcgtgctaagacgcaagcaaccggaccgaagggggaaccgattccggaggaagacacgcaccgacttcggagcccttctcgaggacgcagacggagaggtcggtgtcggcgtcgcggcagagctgcttcagccggatggccgcggcgagccccgcgggcccagcccccacgaccaccacgtcgtagctcatcgcctccctgcccccgctcagccacctcgccgccgccgccgccgcgccccacctcggcgcgcggtggcccgacgcgtggccaatccccgccgccgccgcgcggagcactcgttgcattgccgcgggaagcttcccgatcccgagccgaaagggaggaaggagaaggccgggaaggtacggaactgtggaggaatgggagtggcagttgagctccgcgacgggacggcgatgggattaggtcgctgaggtggaagaagacgaggacgaacagtattcctttttttttaattgaaaactaatactccctccgtcacaatataagggattttgagtttttgattgcaacgtttaaccacttgtcttattcaattttttttacaaatataaaaaatgaaaagttgtgcttaaattactgtagataataaagtaagtcacaaataaaataaataataattttaaatttttttaaataagacgagtggtcaaacgttgcaagtaaaaatctaaaatcccttatattacgggacagagagagtaataataattcgctctgttcatgggctgtttccgggctagctttatgggcctttgaacacttctactagtttttgggccttacataaatgggccgttacatggtgatgcaggctggagtttgggcccatcgaacaaggagcatggtattgctgggcttctttcggcctgccccgctgttcaagggggctgcagg

SEQ ID NO: 67870 - DNA, 1459 bp, Oryza sativa
  unsure (1)..(1459): unsure at all n locations
acaaccccctctcattttccccctctcctcctgagccaagacaattccctatcccctcatctcactgcagctttccactatactaccaccaccactgagctgccactactcatccagctaatnngagaaggaaaaaagaagaacacagatactttggtaacaagcaagaaattggcacagaaatggctctgaggctgtgggctagctcagctgccaatgccctcaagatctcatgcagtggagccaccagggctgcacctgcctactcaatctccagatacttctccactggtatagctagcttgagtagtagaattcatatcaaataaattttctgttgccttttgcaacaaagcatgtggttgttacaatgttctggttcctgtacagtcttgcattgtgccatgctatccttgcacccagttataaattgctgtggcttccttttttcttttctttcttttttacattctatattgttacattgactggtccatgctgtagttatacaccggagacatactaaatgattgaaaagggaagggaataaaatttagaaattccagttgttgaaaagagttgagtatacttgttgtaactatggtccctgttgatttaagccatggtgatgatttcatgctggtattgcagttcttgatgggttgaagtacagctcctctcatgagtgggtcaagaatgatggctctgtggccacaattggaattacagaccatgctcaggtgagccaaccaaaggagaaaatattccatgcctttcatgtgcaacaagattagttaaagcttaatgcatttctaaacagggcctaagtgtcaatttgctgttgtattctaaactacgtggcatgctacaaaatcaaatattctgccctctgctgcaacaactaacaacccttttcctgatatgtcacagaacattttcctttactacttttaagaaatatgatgaagtacctttgctgtaactttttttttcaaactaaatagaacatgtcttttgttactttaataagaaacaagataaaggaactaacttccactgcagaatgctagccagttactttttagtgctacacagtaatgatggcaattatttgaaaacaaaagtaacagtaagatggggggtaaaaaataatttgattggacctgactagatatatatttttttagataatgaatttttattaatccggtctctgtattcatgagggatatacatagccatgactagatatgtatgtatactcgcagggccatctgggagaggtggtgttcgtggagctgccggaggcgggggcgaaggtgagccacggaggtgcattcggcaacttggagagtgtgaaggccaccagccgacatcaactcccccatctccggtgaggtcgtcgaggttaacgacaagctctctgagacacccggcctggtatgtactcccaccgtct

SEQ ID NO: 67871 - DNA, 721 bp, Oryza sativa
ggccgtgtaatgcttcagcaatggctacaggttagcatctaatgctcatgctctcaaggaacaattcatcgccctttgttcttaccccaacatcagctgaatgacactagaaccagtcagtattcatgcactttgtaccaatattcctcaggtcacgcaatccgatcatgcatatatagcttgcttgttcggttgttccactgttccgtgaggaggcttctgttgctgcatcaacaaagcggtgctctgcttgccaacctattgcattgctacctcatccatgtacaaatgtttgtatatgaactagttacctaatgacctgagaccgaatcaaaatgttccattcaagatagctacatgtgtggcattgccttgttccacctgcagccaaactgtgtaatataagcaagcttgctatagggggactaggcactctaggcttacctaatccaccccttcaggcttcagctgttcagtgcagacacagagaatgaattgggtggagtttctgaagcccgtagtcgcaatgctggtgtttgaccgctcttcgcgctgatgacagcattggtcaagaaggctttggctgatgggttaaaccacgttgtctttatcaccctacgccagtttgtagcggcagtcccgctcgctccgattgcttatttcaaagaaaggtttgtgacaagtaatctgatctcaagtgtcttatcaggttgggctgcag

SEQ ID NO: 67872 - DNA, 12308 bp, Oryza sativa
tgcaggaggaggacatggtgggtcagtgatggtgaagaacaataagcaatggacgctggggacggtgatgctgctggggaactgcctgtgcttctcgctgtggctgctgctgcaggggaagctgaccaagaaatacccggcgatctactcctgcacggccatcatgttcttcatcagcacgctgcagggtggggcgctcacactggccaccgagaggctcacagcctccgcctggactctcaccaacaaagtggagatcgtcactgtcatctactcggtaattaatcaattaattacatatgccttgctaatagtacatctatcaccatgcacatatatacagatgaattaattgtgtgggggcgcatgcatgcagggggtgatggcgtctggagtagggtacctgataatgacatggtgtgtggggaagaggggccctgtgttcacggcagccttcatcccggtcatccagatcatggttgccttcatcgacttcttcttcctccatgagcagctccacctcggcaggtatatatgtatatagtactatgcattgacgacgatatatatatatatatgtatatgcatgcatgatatataattaattgatttcatccttgcatatatgatgatatatggcagcgtgctaggatcagtgttgatgatcctaggtctgtaccttctgctgtgggggaagaagaaggacgctgcagctgcctcctcggtggtggtggtggtttgttgtcctgaacccaagcacctgcctgttgatgatgaagaggcgcccaacaccatcaaagcccaacagcaaccaccttcaccactcaaattataattgaccataaattaatataagtatatagtttgttctaaccaatactattattatattttagcaaagaccaagagcaattagctaaaatatctatagaatgtttccttgttttcttagtgtcacctaaacggttataaaatattttgagaaaaaggcaagataaattagtatgtgatatatcactccgtaaatatgtaattttaaatttaacctatataaattagaaaaagaacaaatatgaccataaatagtacatgtactagttagagtcagatttgttcttttattataacttatagaggttgaattaattgcatgtttatagagtaacggtgatatgcctcatatttatctattttattaattatttttttctatttttttcatagctatttagacaacacgtaacgacatagaagaaatgaggggacatcttttgggacaaaaatctatctccgatcaattagtatatatatagcatcccaatgcatggttcatctgctgtactgtaagtggacaatgaaaagaagataagagtgattatatactatattggtcgtgggatatatcacaaccaaccgatgatggatgctcgcatttgccaaaactgcaactaaagtgaagtgattgagagtaaacatatatagctttattccacgccattatcacgcaattactttttaaactgtaagatagtagtataagacaagaacaataatatttgcactcgctcatgcatgcactgagattcgcttgattagttctcttggcgtcgtcttaatttatactatcgtctatggacgtcaccacgaatctggaccaattgatttgtgcatctggcagcttagcttgcaattatataccttattaatcgctggctccggccattcctactgggcttacctcaaaaccatgttggccctcttctggtcggaccagtggatacatggccgctctatggcctttatggcgccggaccttctccttgtagtgcccccacgtctcagggcatcgcgcaatgtggccttcgccctcgctggcaactcctgggtaagggatatccgtggcgtcctcactgtcccggtcatatcccaattcctgatggtctggaatgcagtgtgtcctatccaactctctccgagcactggagaccgtctggtatggcgttggacgggggaacagtgctactcggcccgctcggcctaccatgccttcttcctagggcaacttccctttccttgcaccgacttaccgtggcaggccaagggccttgccaagtgcaattagttcctttggtttgcactctagcaatgttgttggactgctgagcttttgcaaaagtacgacattgacaaccactcggtctatcccttttgcgcgcaaggagcttgaaatggtgaaccacatcctactcgactgtgtgttcgctcgctaaatctggcacaacatcctgtcccctcctggttggactgggctcgtcccttctcgtggtgacacttttcaggactggtggccgtttgcggtttgctagggccgcttcccagagcaccttcacaaggccttcgactttctggtcctccttgtatcctggcagctttggaaggagcggagtgttagggttttcgagtctttcctctcgccggtcttggaggtgttagtttccatcctccaagagggtcgcctctggtccttagctagtgccgctttgtttggggatcttttgggaggatagggtttttctttcgcttttctccctctgtttaggagcaacaattttagtttaatctccttctcttttaacccctctcttccccgtatctttgcaagggccagtccattccgttgtgctatgtaactaaaactctatttcttctaatatattgacgtgcaattttttgtgcgttcgcgaaaaaaatacaccttattaatgtattcgttccacatatatccataaatgatttttttcaataacatagtcaaggatgaatttttaaagaccaacccttctttaattaaagaaaggaggaaagtaagaaaggatgagtgtgcatgcctagcttgcgtaattgactaatatgaaggatagttttcattacttaggagatattgttttgtttcttgcatgtctaaatagttaaatgattaacataaaatatattactctacaaattaatatacatgttcaaattcaactgctataaattgtaaataaaaacaataaataaatataattatgcaggtatgttaactagttttagttgtagttttatttgatctttttgttacagcctatacaagtcgaattaattaatatgataagatgatatatcttatagtaattaatttatcttgtcaaaattttaaaatgtttttttgtaagtatttagatgatatatatgcagatgtagatgtcaattgagagatgaaaatccatgtatgagtagtaaatctgtacatatatacgtgacggatgcatattaatggatgaacggcaagcaggcatgcagatagagagttgaagtattcaagtcgataagcaattaatggacgtgaagaaatcgcgcgaattgaacgagcgagcgcccgtcccggactcccgttggtccaccgtctccggcagcccgcactctgcgctagctgccgcatgcatctatccatcgatcgatacatgcatcaatgtgtttatatatatatatattccatctagcctaccatagccagctaattacacgatccatccatttgcatcatcgtcgtcgtcttcttcgatcgatcggctgatccagtaattcctcgatcggtggacgtacgccacgctactatcatcatatcaatccccgatcgacaggttaacatcgatcgatcatccaagccagccatcgatccatcagaataagcagctagcttggagaccgatcgatcgatcgatcatatgtcgattcgattcgatccgatggagagcagaagcagcagcagcagcagaagcgtggtgatgatgtgctgcgtgctgatgttgatgattgcggcggcggcgcatgcgggcgagcaggaggcggaggagtgcgctagcccgatgagcatcgaggaggcgtgccggggggcatcggagacgcaccacgcggtggcctacgaccactgcgtggcgtcgctgacggcggacccgcgcagcagcagcagcgaggcccgcagcctgcacgggctcgccatgctcgccacccgtatggccatcgaccacgccaccagcaccgtctgcaagatggacgacctcgcggagctggagcccgaggattcttcgtcgccgtcggacgcgcgcgcacggttcgagcactgccttgagcagtacggcggcgccgccgacctcctccgcgacgccctggacaacctcaaggtccgcatctacgggacggccatggagcagctgtccgccgcgctgggcgccgccgagagctgcgaggacgcgtggaagggcgacgagggcaacatccccatcgccgcccacgacagggagtacggcaggatggcccacatcgccatcggcttcacccacgccgccgcctaatcttcctccatttcttccttacttccatctatcgcctgcctgcctctgcctaattttatttctactactccttattaatttgcattctcatcgatcgatcatccgctggaatttcttcttcttttacttaaattattattattattattattaattgctgattgaattgaatatgtactgtaggatttaattgttcatcagatgaaagacgaatgaataataacacgattaatttactgtgtactttttattttcctcagtcctgttgatttggtacatatgttcacatgtgcatggtttcgatctcaatgatcaaatgtaaaaatattgctcatcgatctaagaaattcagatcaacaagaaaaaggaaatcgaacgatctctatgagccaatgctactactagctagtgcaaggaaattttatagattacaagcatgtcgtcagactaaatgaagtgaataacctgttgtcataatctctggattatcttttttttttctaaagaaaacaatatctggatttgagatatactgcaggagtctgttcgatcggttccaaatgcaatatttatttgccatgcaattaattgagaaactgaacttgtatcaatgtcgacaaaacgctgtctagtactagtactgtacacatcattacaattaactaatgcgagagtataagtgatcacattgatcaaacacaagcggagattatcgtacatccatgtcgaggaatccaaaattttggacccaatatataaatattcaaggaaagcatccttccattttaaaagttaaaggggatgcatttggctaaacaaggacaactaagatatcacaactaagaagctagagctatagatggagtactatttagttgagagcagagcaaagctgttcaggtttcggttgcaacataactgctaaccactcgcagaacgaacggcttgagtagtgtatactaatagtcttagaattaacacatgtgctcatatttacgataaataattttttaatgttaggtgatgtacgcgtcaaaagtgatgcgttaattttttagataatgatcagtgatgcgtcaatgatgattttagcaatatcaagatatatcagtgataggtgacgtccacatcgacagtgatgtgacaatgataactttgtcaatatcaaggtaacatatatatgctcattgacagtgagatatttataatgacttcgtctcaggatatatatatataccggttcaatctatcagagatacttatataataggtgtacatgtgtgttgataagaataagtgtagcatgtgtacggcgtcgctctccccaggagcggctcgggaggcgacgacccggccgcccctctcccccacccccacccccttctccgcctcgccgtcgcccgagcgaccgccggcgaagccgcgcggccgcaaggacggcggcagcggggcgctcctcgtctcctcgcgctcgggcggcctggggagccgcccggaatggcgacggcggtgtccgccagatccgcgccgttccggccggatctggcgggatgggctggcggcggggacgacgacggcagcggggacgggcgacggtggcggtcgaggtgagttgcgccgggtggtgttgtgggtgacggcggcggggatggcgacggcgttggggtggcgatggtggaggctgcggatccggcggtggcgcacccggatccggcggcggcgcggcagccggcggaggcaagagcacgcaggcaccccgcggctgccactggcgtcggccggcattggtggagaggaagacggccggatctggctccttgcccagatccaacgcgtcctcgggtgggaacagggtggttggagtccgatcgtcgtgcaggtggtgtgaatatcgcaggtatcctcggtgtgcaggtgacatttggtggctcccgtcgtggatgctatggttgatgggtgctccaaggcgaaagtcttgctccgctctcggtgctagcaacggcgacgcccttgggcgccgtttaccttcttgaaggcgttgctactggagccctcgttcaactccacttcaagagttttctccgggtgaaaacctagattcgttaggatcggacgatgtcgccgttctgtcggcgtaaccttcttgaaggcttcgttttaggagtttatctcttgttggacggctgtacttaggttcagtttgtcgatgtcgggggttttgccggttttcctttaattaaccgtgctgttgtaaggtttttaggtctgatttcccttataaactggatcaactctcttcttctacggtgaatcgcaggagctccctgcctgtcccctcgaaaaaaaaaagtgtagcatgtgtactattcgtactgtgtactatctagaagacgttgattagtaactaatcccacaagcatgcatatatacactagctagcttgtacgcagtggtagtacgtcgacgttgctaaccataaggtcggtcggtcgatcgacatggccactctctgcggcagcgtctgcttcttgtttgtaataatggtcattgcgtcgtcgccggcggcagtggcggcggcgggcgaggatatagtggaggagacgtgcgggcaatgcagcaggagcaaccccaacgtgaactacaccctgtgcgtgtcgtccctgtcggggtacccaggcgccgacctccatggcctcgccctcttctccaccatgccgctccgctccgccctggccaccatcgcctccgaggccagggtgctccgcgacagggcgccgccggggtcgccgccgaggtcctgcctcgactcgtgcctggaggtgttccgcgacgccgcctacaacctcggcaacgccgtggcggcgatcgagtcgtggaggtacggcgacgccaagacggcgatgagcgccaccaccgacgcgccggtgacctgcgaggacgagttcaaggggcagggcatggccacgccgccggccatcaaggccaggaccaagcccctcttccagcacggcgtcatctccctcgccatcatctccttgctctagccatattgctaccagctactactaccaattaattcgatatccaaatatcactagctagtactatcatgcatgcatgtctgtgtagtgtgtacgatcgatgatccattaatcaatgcatacttactgcatgatgatatatgcagaactaatatctttgcagcaagcctgcacatgcatacataaatgcaaatgatgcctagaatcgggcgcccacgtggggagtaaaatcgggcgccccatgtcgcgccctgcccgccacgtgtatgactaaggctacgttcgttcctaaaggttcccaacccatctccttcattttccgtgtgcatgctttttaaactgctaaatagtatatttttataaaaagtttctatatgaaaattgttttaaaaaatcaaattaatccatttttcaaaaaaaaatagctactacttaattaatcgcgcgctaatggactgctctgttttccgtacggtggagttgggttcccaaccccaagtatcaaacacagcctaagtgtaaaataccttgaacatcctagttttgcacaacaaatgcaaagatgaaactaagtcacaacaaattcatcataatttccgccgcaaatgtcacacatgaatcacaattctcgctaacaacctccgcattcccctgcgtactctggtgatcttggtatcctaggaaatatggtgtgagcgaaatgaataaattttttgaaacactgcatcgccaccggcatccatcctcaccaagataaaagaggaaggtcaggcatgagttaaagtaggagcctctaagcttcaagagttcggaatcttgagagatatcacttaatcatcaccttttgcgggcttagttcttttttagactagccatgtacataattctatcgtcctgtattttccccatctctatcaatatacgaggcaaagcttttgccctcctttcaaaaaaaaacaaacacatgaatcacaatacaattttgaacagaatgattttctcaattgtacatgagagtataaaaaacatgtggttacttgtgataaaaagaaagaacaagatgtgtatctagtggactacatgcggatgctcaaattagctgggcgaatattattagtgttttgacgcatgcatgccgttggtcatcagttaatcagttaattagctaatttgggtgaatccatccatccatccaaaaattagccgggcggccgctcaaaattaggacggtgagcgagctataaaattctatggaaaaagagagagagagattgtgatagtagatgatcaagtgaggagctatagagatcgagatgagcctttcgtcgtacctgacgtgcaacctggtgaccaggcaacggcaacgaggtggcgtggaagaagacgagtacgatgggcggcgtcagccgcagacggccacctgctgcaccgccctgaaacgaggtgtcaccgctgacggactcctcgcgcagccgcgctacgccccggtcaggacgccccaatccgcattgctgctgctcgatccaccaccaccggcgcccatgacgcccacgtcgtcgtccagcaacagcaaccacgacgacgacgacgaaaagaagaagaagcagccgatgctgcagcagcagaagcaggtgcgcaagtgcaaatcgacggtggaggaggcgtcggcgtcgcagctgatggaatgtaaaggcggcggccctcctcctcgtctccgtcgcagcggcggcgtccgccgtgactggagcttcgaggacctccgcgccaacaacaccgccgcctaataataataataattcaatccccccaccctcctgctgccctgcctgtaactaacaacccacttcttgctaaatacatatatatactcctccttaggccctatataaacacgatcactgctaactcgattatcatgtaaataatttatttattattgtaatctgccaatgcccccttaattaattaattatatgtttgtaactcgatctaactagctagtaaaatcatcatctactccaacgacaacacaatcctctcccggttattaccaactacttcagcttgcataattctcaaccttaaaaacattatgttgcactgtttcagctcttctgtaaggtcgagcaacaataaactgtcataatgctggccattcataacctactactcctctcatctgccacattgacgtacgcaacaattacacacaggaaaagaaaaaacgtctcagatgcaactgtgaaattctgcctgcctccagtgtaaaaatggttgccaactgccaaaaagggtactcctcttcttctaaactaaaatccaaaacctgaacaaaaaacaattagcaaactctgttcaagcatacaatatatactactgtttgatcatgatgagcaggtccgtgtacctgatccacccattgggttcccagcagcagctgctttctcaggctccttgatgtccaccacaacagcatctgatgtgatgaatgttttcgccaccgacgcagcatgctccaagcaacatctcaccacctgtttcacacaacgttagctttatggactcaaaatactaatataaaaaatagggtggaaaacatccttgtttgattgcaaggaaagaaaatccatatcccagaggttcatcttcatgcagctgatcacttctatcggttcaacatggtaaatcggttatattaattttacagcacaacacaaaggcacacgtgcatttcaatatatattctaataatgaaagaattacttctgatgtgactacgaataagaaagcgcattgattcggcagaaaattaccttggtgggatcaataataccagcagccatcaaatcctcatattttcctgtagcggcattgtaaccatacctgaagttatcattggcaaggacctgaaatcatacatgttcaaaaattcgttacacacgagctgcagaattgcatattcatcgtacttaagaacaaatgtcagagtacaaaccttctcagtaacaacactgccgttaacaccagcattttttgctattaatttaagtgggtaactcaaggacttccttacgatttcagccccaaccttgaagccaaaaagaaattttaattattgacaatagaaaacaaatgccttgaacctaggatgaaatgaaacaataaccaaagattatttcatttgttttcctaccttctgttcatcattctcaagtgtttctataatggcatcaacttttgatgcaagccgcaaaagcgtacagccacctccaacaacaataccttcctcaacagccgcctgccacagagcaaactattaagtaacaaacaacaaacccatatactctatgtgcatcagaaggctctctgaatgcaatcccaaaattaaattatattaacaaagagaagtattcaccttggttgcattcagtgcatcttcaaccctcagtttcttttccttaagctcagtttctgtctgtgctcctacctacataacaagtagcgtcatttcacaacaattatcttctgcaaatgcagcctagtagtacattaacaagtgcattggttcaattgcagaacatcgagatcacctggatgacagcaacaccaccagagagcttagctattctctcattcagtttttctttctcatattcctgttcagcaacctgaagaaaaaataacttgtataaaaatccacaaaaaaatactgagacatgtgaatccaaaagatctgccctgtaaattcatgtaagcaaagaaacccccaaaaaagagcagggtcaggagaaaatgaatacaggagtggtttgacgagaagtacaggaacacatagaatttttaattttaaataatacagacctcaatctggttcttgatttgtgtcacccttttgtttacttcgtcctgggtagtaccatccccaactattgttgttgaatccttggtaactacaaccttggcggccgttcctagaacatctctatcagctttgtctagggacaagccaacttcttccctgatgacagtacctgaaagaagaacgatatataagcgcacgtgtggcttagagtgtagacaacttatgtcaaaagctgaatatcacctccagtaagagtagcaatatcatcaaggtattgactcttgcgttctccaaaaccaggagctttaatagcagcaatcttcaatgcacccctaagcctgttgaccacaagagttgcaagagcttcctgctcaatatcctccgtaactattaggattgggtacccacccctaatagcatcctccagaattgttataagatctctggcattgttgattttcttgtccacaaggagcaactgggtgatagaatcaacattagcatcaaatgcatagagcccacaaatgagtatctggttaatgcacagtttaagtacaccgaattctagaatgcatcaaaccttgcaattctcatactccactgacattttttcactgtcagttacaaagtagggagaaatatagccgcgatcaaattgcattccctcaacaacatagagattattttcagcactctttccttcttcaagtgtgaccaccccctgtcgtccaaccttgttcatagcttcagctatcatgttgccaatttcgtagttatttccagcacttaccgcagcaacatcagcaagttcgctgtcttcaacctgcaaagttgcatgcaatatgatagattcaaatttcaagcaaaaatagtgctgtagcggatgagtacgattcaaactggcagccaatgctcctgaattcaaatgggtgttacttaaatatcagcacagaagattcccagcactcatgtttagtattactgaaaaagaaacgtgaaacatggcacact

SEQ ID NO: 67873 - DNA, 2528 bp, Oryza sativa
aacctagtaagtatcacgtgatacatagcagaattcgtcggtacctgacatgatacctcgccgagtatcacgcgatacgtggtagaaatcgtctgataccttacaggtatcacatgatacctcacgagtatcacacgatacgtggtaaaaatcgtctgatacctgataagtatcacatgatacctcacgagtatcatacgatacgtggtagaaatcgtatgatactgtaacaccctaaaaaaaaaaggcaggcaagctagcagcagcagctgggccaggctcggtagcaggccggcccaagcggcagtagtagcaggtcgctacagtaccgtcgtggtactgtagcagccgattagtaccacctcgcctaactagcttgaggagcaccaagatataaggacgagagcctagaggctgttaactctgattctggaatttttgctttaaagcgaatttttgctttaaagcgaggatgaaaaacgtagtgagttgcagtattaggtgtggtccaactaaatgagccgttttcgggccctgcacaaatggtatcagagcagactctcgcggttgcgcgtgcgggcatatagcgcatgtgggctccgtgtgaggcacatggcatatggcgccggcattggacggtacggtcgtgcgccaagagagggcggcgtgttcgacagttcgacggggtcgtcgaacccctgagggtgggtggaatgtaacaccctaaaaaaaaaaaagaaaggcaggcaagctagcagcagcagctgggccaggctcggtagcaggccggcccaagcggcagtagtagcaggtcgctacagtaccgtcgtggtactgtagcagccgattagtaccacctcgcctagctagcttgaggagcaccaagatataaggatgggagcctggaggctgttaactctgatttcggaatttttcgttaaagcgaggaccgaccacaaatagcgctatctggtcccaaaactaatgattcggaaaccgacatgtttatactgtatcaagcttcggaaaccgaccacaaatagcgctatctggtcccaaaactaatgattcgattcggaaggagtttatattacaaaataataggggaatttacaaaattgtggctaactaatacaacagaagctataaaatgactcaatcctaatgttttaaaattgtggttttactatagacttaaaccatctaacaaatctagacttgaaaactaggttaaaatattgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagttgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagctattatatttaagtatgaatgtatgaaataatagtatttgagtagagctagatctatttgcagaaagctgagaaattagaaggagaaagtctataatgtgttgaaatgcaacagtatttaataaatctggagttatatttctaaccaagatgccatagtgagtcccgatgctcaatatccgtgagcacggctattcgaatagtttcagagatactcatactgcagtagatgtacgctttacccgcaatccatgacatgctaatattcatcagcttagtcatggcaaagcttttcggttactaacatcagtggcacctgttccatgaactctcatcctcatgcgctctgaacgtaacgttatcagcagcgagaggagttctggcgttcccgaggtctttagagagaactggttgagagacccccgtcgtcccaaccaggttttcacaatacacacacagcgcgcaataatcaatatatttacccgcgcctcggtaaatattataatcgccctgctcggcgtaaatttgcctcctgcgcgaggacttaaagaagaaccactatacagaggtaccacctttgttagataacctactttgctaagtctgtccccattctagaattgcggtcgtactcgttcgttcttcacatgtacttggcaatcttatgtcggttggaacagtactagccacccggaaatcaaccatttctaccgtactgttccaatctaagttcattatattttatgcaatctaactaggcatggctaagcaaaatctagcatatatctggtttgctatatgttcaagttatgcatttaaaatcatgaatggctaatgcatggaataatagagatatagaatataggataataatgctcaaaggggtggaataataacttgccttgctccaacgcaaacaaatccgagataggcaacctgattatccgatcctcgaaacat

SEQ ID NO: 67874 - DNA, 3980 bp, Oryza sativa
aaagaaaatatttgaaaaggcaaatataaattcaaacgatatttgaatagattcaaataaaattataaaatagcaaatttggtgtcaaaagatagggtttgaatttagataaatttaggtccaagttttattggaatcggatctacggtttaggagatatgggcttctaaagattgggttttgaattaaatctagaaaatgagaaaagtcactgtgcaggggacccacctgtcaggcttttctttttcttcttctttttctttctctccttcttcctctcgttttcctttcttcttcttccaggctcccagccgagtaacagaggagggagaggattgggcgccggtgctccggtagccggggatcggcaacgtcggtggcggattgcgttcccgaacaacgcgcatccggggaaggcagtttcaagcgaagggagttagagaggaagccggaacggcgagtggaagagcttgcctccggcggcaaaagaggtggctatggtggcttgatgaagtggttagggaagaggggaaataggtaaaatggattctccttgtcgaggcgaacccgatggtgcaagtatttggttggcaatgctccagtgagggagatcggccgatgactggtgagggcttgccatggcaggagagagagagaagcagagcttcaagctctgttgatgtgaggaaaaggagggtacctcgccggctatttataggcggcgaaggtcggttgcttatggcggttttggaggagtaggtgaaggcaaacacgatgatgcatcggcctgtaggaagggaagtcggcgccggctctgtcttcgattggccgatagtgtcggttcggctcggcggctgacggcggcagcgtgaggtggcggctgacgtcggctgcggttgcttagcagcgacggaaagacggcggcggcagttgatgaacacgacatggcgacggtggcggcgcgacttggcggcgacggaagaggagcttgcggcggcgtgcgccgtgcgcgtgtacgacacgcactgggaggagggggcggttcggctggggttggctgggccgaattgggccggctcggcttagctgggccggcagcccgagagggaggaggaaaatagaagataaaagaattgggccaaaaggaagaaagaacggagtttcggcccgatgacaaaaaggaaaaagtctaatttgaatacttaatatgcaaaactaggttttgcaaagaatttgaattcagaaagaattcacaaaagagatttcctaatatatttgagtgcaatatttagaggtggagtttgagggaatttatttggaagcactcaaataggaagggtgagcgatatatgaataaaatttaatatgtaaataggaaggtgggaacaagatagttggagaaggataaatagggttttagcctcaaaacatatggcatgggtttcaaagaattgtttgaggctaataggaaatttgaatgacaaagatataatctattttcttagcacaagagcaattattcacaatattcgtaataatattattcttgtgccgaggaggaaatcaagccacaggaattaaattgacggctagattggaagaaggaatttggatacaaatttggaaaggggactaaggataggtttggaatcaaaggatagattgacaattaattccaataaatttggaattgcttcggttttggttcaaggatagtgttggaggatttcttggaccatgattcataaaaataaaaaggggttttcaaactaaatttgaataaaagaattttagtcaaaagaaggtttttaaattaaaacccaaaatcaagaaactccttaatttaactaaatatatttttaaaggaaagacacaaaagaaattaaataccagaaagagatttaatgcaggttaattttaggaggtctctttaattataatatcctaggtttaggaggttaataaaaacgtaagaaccggtatgatgcataattagaaaatagctaattttcagtatgttacagatacttgataagtatcatatgatactttgcaaggatcacctaaaacgtgtgtaaaatcatctgatacctgataggtatcacacctgatacctactcgggatcttcccgttagaaaatgggattccgttatatagcagccccccaaagaaaagatggatagtacgcagcgcagcgattcggaagtatgtgtacgacgaggagggcgattctcaatttcaccacatcgagaagagaaaggcggaggctggcggcggcggtggcgacgacgaccttggcagtggccgtccaaggcgatgacggcgacttggactacgccacgatggtcgcgcgcacggctcatttcctagcggtggtccgtggtcgagcgctacgcccggatggtgcacaagctagttctgggactaagttgacgagtatcatgtgtggaatgcgatcgtctcgacatggagcacccgtcggccgcggctgtcgacgatgacggtgacgaccggcctgcccccatcgccacatcgacgacgtgcggtggactgacgcggtggagcggacacggtcagagatcgaggaggcgagcgagcgcgagtgcgtcgcagtctacgagctgtggaggaaaaggtggtggcagtgtggagccgtaggtgggatttgggagaaaacaacacccaatagctgggaataccgcgttagacacttagaaaacgcggtagcaggcagccgtcgtagccgtcgaggaagacctagctcaacaaggcgtcggagacctcgtcgccgcttctgccagctacttgattccgctctagtcctggaggcgcgcgaagtcatcgcggaggcgtggctgcgtcccaacgacgggcaccgatgacacgccattcccggcgcgcgtgggagagggagaggagggagagggagaagatttagctagagacatgtggggcccaccgcccacatgggtcacactcatcgcgtcagtcgggctactatattgtcgaggaccaaagttaacacgtatggtgaatttgaggatgagttataccttttgtttcggtatagggaagaattttagactctacaacaacttaaaggacttaagtgattctttccagcaatctagcccaactggcaagctggcgggctggtcgccgtcgatgaaggcctgttcagttcccactattagggctttttcggattagaggatcttcacgtgattttcggaggaatactgtgcataggaattttttttcctttcttgtcattcagatcatgaaaactgtggttgtaggaaatccaaagaaaagtttcctttgatgctgatttcacatgaaaagtatatgaaaaatccgtccaccttaagctctttttttttattcctgcatgcaaatcccaggcaattaatttcatgttatccgaatgtcctcatttttttttattcctttgtttttcattcttatgtttcacacttagattcctttcctgtttctatactttcccaatcctatatttttcctatcctataatctgaatgaacccttaatcatgatttggaaattccgaaccctggttattttacatttcacaactaatcatgcatatctattcataatttcagaaaagattacagtaaaaagtaccaagtaataagctagtaactagttgatacccccgcgctttgcagcaaaatatgtggataaatgcatgttataccatttctataatgtataacatgcataaatccacatatctctagcaaagcacgaggtatcaactagtgggaacaatattttagctcaaataaatatggaaaaagtactacacccctgaactatcgaggtcgaccgaattacacccccgaactcaaaaaccagacattctacaccctcaactattgaaaccgggcaaattaccccccctagcactgttttaggtggttttgggatagacttgctgacgtggcagtcctac

SEQ ID NO: 67875 - DNA, 4682 bp, Oryza sativa
gacctcgatagtccaggggtgtaattcgtactttttccaacaaatattaaacgaagataatatcctaatgaataggacacatacagaaccaaaagatactatgccatatcgttcgtattctccattgatagctttgttatcaacatatcgtattgactgggcataaaaaatgatcatgttaaaaaaaattgctactatcagcatggagcaagatatacttagttgttgccacttaccagtatagcaggccaaacgggcggcccggcccagcacgacacggcacgccgacggcacagcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagaacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatacttaccagtgcatgcctcctgaagtgaaactattcctaccgcttcacctctgttttaaaataaaactattttttcatctatctttttatctcaatcaattataactattcttcgttcgtttcttcacctacttctacttttcagccaattatgttttttcttcattattttcacatatgttataactatcggtatccaacttcagaaatacttatttgaatctgttcgcacatttttttaagctcgatctactgatctacactcttgtataagtaagatttaccttccttaactctgttaccagacgttttatacttatgaactctttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgccatggacgcctggcagctgttcgtccccgcgatcgccatcctcatccccttgctccggctcatcctcttccgccgcggcgacgacgggagacgcggccgcctcccgccgggtcctccggccgtgccgttgctcgggagcacggtgtggctgaccaactcgttgtacgacgccgagcccgtcgtcaagcgcctgatgtcgcggcacggccccgtcgtctcccttcgcttcggctcccagctgctcgtcttcgtcgccgaccgccgcctcgcgcacgcggcgctcgtcgagagcggggcctccctggccgatcgccccagccaggccgcctcggccaggctcgtcggcgagggcgataccatgatctcgcgcgcgagctacgggcccgtgtggcgcctcctgcggcgcaacctcgtcgccgatacgctgcacccgtcgcgcgcccacctgttcgcgccggtgcgcgcgcgggtgcgccgcctgctcgtcgacaggctgcgggaggagcacggcgaggcggaggcggcgccacgcgccgtcgtagagacgttccagtacgccatgttctgcctcctggtgctcatgtgcttcggcgaacagctcgacgaggacgcggtgcgcgcgatcggcgcggcggagcgcgacacgatgctctacatgtcgagcgagatgggcgtcttcaacttcttcccggcgatcaccaggcacctcttccgcgggcgtcttcagaaggctcacgccctccggcggcggaaggaggagttgttcgtgccgttgatcaactcccggcgggagtacaagaaaaacggcggcgagccgaagaaggagacgaccacgttcacgcactcgtacgtcgacaacctgctcgacatcaacctcccggaggacggcaaccgcgcgctcaccgacgacgagctggttatgctctgctccgagttcctcgtagccggcacggacagcacgtccgccgcgctgcaatggatcatggccgagctggtcaggaacccatccatccaatcaaagctctacgaggagatcaagtccaagaccggcggcggcggccagcacgaggtctccgaggaggacgtccacgacatgccgtacctgaaggcggtggtgctcgaaggcctccggaagcacccaccggcgcacatggtgctaccgcacaaggcggcggaggacatggacgtcggcgggtacctcatccccaagggcaccatggtgaacttcatggtggctgagatgggcagggacgagaaagaatgggagaagccaatggagttcatgccggagcggttcctccccggcggcgacggcgagggggtggacgtgacgagcagcaaggggatccgcatgatgccgttcggcgtcgggcggcggatttgtcccgggctcggcatcgccatgcttcacctggagtacttcgtggccaacatggtgagggagttcgagtggaaggaggtggccggcgacgaggtggacttcgccgagaagcgggagttcaacaccgtcatggccaagccgctgcgcgtgcgcctcgtgccccggagtacactcgaataattaatccattcctcgattcctagagaaaataattgtgcagtatattatatagagtaaattccttgtttgctcctgaaaagttacccaatctcttacatgcccctaccgtttggaacttacttgattccttctataccccaaattttcgattgaatcctctacatacccctaccgtttgggttccgtcagatgtttgtgttcatgtgtgtgttagcttgtcagtattttcataaaatgcgaaaatgcctctgtcaaccctaggtaacacagggccacatccgatccccaaatcctccaaaatagtatagttcccacacgcacggtgccgcacatcgccagctttcagccatcgttgcacgcgcatcgccgcccttctcccacatcccggcggtggcagcgggtctgcatcccgccgcggtctcggctctgcttgcggtcagcggtggcggctgggtccgcatcccatcggtggcgcggcggggtccgcatctggtgggcggcgacggctttgcatcctgccgcggcgacgagtccgcatcccgccgcggcctcgactctgcttgcggtcatggcgacgccgtctcctccctgcctcctccgcgccctccctcttgtcacctcaccctcttctcgggggctccgacgccggcctattacctccttgctccactgctcctcgccgtcggtaatgatacgcccttgcgttgattagcaaaatgcgaatagctgctgctgctgctagtgtttcttgattgatttgtttgactttatgcaggcggatgccttgaactgttatgggcttgtgccattatgctcatgatgtaaaaagtaatatatttgtgtactgctgatggtgtatgaatgcttttagatgtattttcattttcttcctattaaatggtgctaccgatcctcttgatatgctgatgaattgcaatggtgtttgagtaaacggctaggggtactgtcttttacccccaggctgtgtcggttagtggtcatgaaagatccaatgtcatgttatatttttttataaaatactgaatgctataacaaaagaaaatgaaattaattttatgcactaattttttagtctcacggaatacatactgtgcagtcatgaatgtttcaaacccagctgccaaacatgttcttagttttcagctcctccaacctcaagggtattatagacattttcaaccaaactaaccagggaatgctgctcaatctaacggtaggggtatgtaggggatccaatcaaaaattcaagggtggaatcgagtaagtttcaggggcatgtaagggattgaataacttttcaggggcacacaaggaatttactctattatatacggtacatatacgaatgtaagggaacaaacggccaaaatcatcgcacgtagcactggcagcttcctttctttaatgaatattctgtgagaaattttacgattctcgagagataccaagagaatatcctatgtgtgtactccctccgtttcgaaatgtttgacgccgttgactttttatcacatgtttgaccattcgtcttattcaaaaaatttaaataattattaattattttcctatcatttgattcattgttaaatatatttttatg

SEQ ID NO: 67876 - DNA, 24733 bp, Oryza sativa
attcctgcagcccaagaagtacaacgggcaggttgtgaagcaatcggtcaaggcgggtggcaggagttctagaaagtaaaaaaaataaacctaatgataatcatatttgatttctaaaatctcaataataataaaaatgagaggcaacgggcgggtcgtataggagtacaatggcaaagtcgacgatggttggtgggtcttctagaaagtaaaaaaatgaactccaacgatagttatgttcaacttttacaatcctaatgacaataaagagtatgcggcggatgggtcgtagaggagtacagtggtagcgtttgacgggatttctaaaaattataaaaaaaatgaaacccaacaagacaataaactccaatttttaaaggttcgggcttctaaaaagtaaaaaaataaaccccaatgataatccgtttgattttgaaatcataatgacaataaagaagggcggcagcgggtgagccgtagaggagtacagtgacaaagtcgctgacgttttggcggaacttctagaaagtaaaaaaaataaacctaaataataattatgttcgatttttaaaatagcgatggcaataaaagagaagatgcagtggacggtcatggatgaatataatggcagtgtttgtcaggacttctagaaattataaaaaagatacccaacagaacaataaactctaaaacctataagtttttagatccaatttttaaagattccaagaagaatgaatagaaaacagtggtagatcgagcaagcaaataaagaataatgtgacagaagtaaggggtaggaactgttgtgacttttaaaaactaaaaaaaattaaaaacacgaggataataaggtttagtctttaaaaatcttaagacaacgagataactatttaacaaatttgaagtaaaatcatattaaaaatatataattttatataggtgctagccgtgcaattgcgcgggtcacccagctagttgaacatatgattagcgtgctgttatatattctgtcaggttttgaacaatttcaggtttctagtcagtaaaccaagagaaaattcaaccagttctggtaaagcccggcccatattggcccactagaaccgtggccactttcctcggcccatcgtgccatccgtctctctcaccgtctccgtgctcctccgccgcccaagggtgtctccggcgactcgcccggcgccgcacgcgaagcccggagatccggctgcggcggaggcgagaaggaagagggagatgagggccgtggtgcagcgtgtcctctcggcaagcgtcgaggtgagcgggttcccctctcccactcgctagctaggaggaggaggcgagcggctgattcctgattggttggttcccgtgggttttttggttgcaggtggaggggcgggtggtgtcggcgattggccccggcctcctcgtccttgtcggcgtccacgaggccgacaccgacgccgacgctgactacatgtgtgtgcccagcttacctgctcttactatttcgttctcgcatctcactgaatctggaatctgttattttttacgtgtttattagctacttagcttctttagtggagggagatatcatgaattcgtaatgtagaatgggagaagaaatgatggttgttgataaatcaatgatactagtacttgttgccatgtttgatctggaaacgtgtatactgtatagtttggaaagagcttcttagttctagttcaattacaaaagttccatctttgcgtttcctgcaattttgtttatgctcagatcttcagtaaatgtatgatgtatccttgtgttatattgtcactctcatactaacatgaccttacgcagttgtcggaaggttctgaacatgaggctatttcctaatgagaagactgaaaaggcatgggatcaaagtgtaagtcctgactcatcttggtatcaatatgacaaaaacaacctattcaagcatgtcacatatatctcctgtacttcatttgaggtttgaagatgaacctaaataactttttccttcttgcaggttttgcagcggaaatttgaagttctattaggtaggagtaatataatacagcatttctagtcccagatttgaaaattcttaagctgtagtagctttgttgttattgacaccgttactaagctgatatactattcagtcagtcaatttaccttatatggaatcctgaagggtaacaagccagattttcatgtggctatgccacctgctaaagcaaagccattctatgcttctttagtcgagaagttccagaaatcatactcagctgatgcagtgaaaggtaatatataatgcatatctatcatttctttttgcactatgtaactagcagtcctgagttcctggttatctaattgttgttcttattacaatttgttcttttgtaatccacacaaatatggctatgttggtgtgttgcggatttaagtgatttttttccatgtttctcatggttcctacactcaagattattttataaagcacattctaagatgtattgctggtattgtacttcaccatagtaacttctgctatcaatatattataattgttcaactcttttattatttttcctttcactttccctgatatattaccatgaacatttatattaagtatttgctcagagaacaaaatttatttattgtaagccattgtcagatgagctatttctaacatgtctatacttttaactcgtcttggcagatggcatttttggagcaatgatgaaggtacctctgaataaacatatgctgtaattgcctttttgtgctctattaccctttaagatgtaaattcaatacttttgcaggtttctttagtgaacgatggccctgtaacaatgcaagttgactcatcctcattgcaaaatcctgctcagtcaaggtgagctttcctaaatttgcgtgctcatgctcataaggacatggctgattttattcatttttgtgaatctttattagcaatggtgatgttggctcagttggggacaatgaagcacaagtacctaaagagacttcttaatctctgtaactggtcttctacccttcctgcacatgatttgaacatggttatcgctgtcccacatcaagccatgcagaattttgagtttgtttttgaggtttgagcaggaagaagccctccagtgagctcgtgccatgggtgctacaagtcgtgttttcatttctccacttaaatattgattactggggaaatatattagtattcatttcgtcttcaaagacatgaattttattactgatctgtcattcatacacaaatatcaaattgattcagttggccttagtgttttgtcattgtcgtttaactccagcagtttacttccttcatcccataaaaaaccaacctagtactggatgtgacatatcctagtgctacaaatttaaacatatctctgtctagattcgttgtatcagaatatgtcacatctaatctcatatttgtttgttttttgggacggagggagtactcaagttcagcactaacagcttaaaggagtaaccgaaatgattatattcatttcttctgtgagatgatagcattatttgtctgagaaccatacatcaaagggatatgttcatgcatattattgcttgagcttttagctggttcctagaccttaattagtacttttgcagcatattattgctagagcttttctggcaacgctgctactagcatgaaactcatctctgaagctgatgaacgtacaagaactcaagaaggtgtattatattctaatttgacccactcctggccatttgctgccagcatcacctgcagttgcaaaacacaacgcagacgaagccaatacatccacccgtacaaaccctgaaccgtcaacaaaagaaagagagaagctctttcagcttacctcgcggcgtcgctgatcttgtccctgtagtcaccctgacctctcacagctgcgccggacctcggcacggcggcggcgttcgccgccggcgggcagacagacacggcgcggtatcggtcgtcctgcgcgtgcgcgacgaagccggtcacggtctgcgtcgccggagcttgcacgtgatgaggcggcggccgcacggacgacatggctccattgccgttggcaccgcggacgccggcggcggcggcgacgaagccgcccggcacgacggtggcgttgtgcggcacaacattgccaggcctggcggcggtggcgccgttgtacgccgagaccagcagcagctggtgctgcagcgtcgtcggcgacgaggcgtgcctgacgccggcggcgccggcgcagcacgcgcactggtcggcctggcggcggagcgcggcgttctcggcgcgcagggcggcgttgtcgcggcggaggcaggagacctcgcggtagcacccctcggaggggtcgcgctcccgccaccgcgcctcccaggtgagcgtctcggcggcgcggcggcgcgccgcctcggtggcgttggccttgatgagcttggtgaggttggccaccccgaagacgaggtgcagcgcgcggaagtcgttcatcctgttcgccgggaagtaggcggccagctcgcagttgggctcgcacttgcgccgctggtgcttgcacaccgcgcacgcccggcgccgccgctgccgccgccggtcatgtcgacggccggcgacaagccgacgtacgtacaacgatctctacaaactcagctgcaagatcgaagcattagcatatatatgcatgcgatggcaggatgcgagtcagcaaggagagagagagattgcgtgtacatgcatgtacacgtatatatacactcacaagatggtaaggttgaaagtagggtttacggttttgtaggttgctcacaggaagatttcaccgcagaaataggggcatggaaacttcttatctgacatctgtgtagctgcatgcagcgacactcccaatatatgcaagatgtatagtagctcatgtaccatgtgaggagtttggggacaaatgagtaaatgtataagtggaatgtagtagaaaaatgtactagtatctagtatcaaccgagtaatgtaggacagaaaaatgtatatgcagtagaaaaatgtgctatatcaacttcaagtgatattgtaagaagtggtatgtatgttgtctccgaataaaaaatttcattccagaatgcagcggcacaaaggacatgtgtgcttacattcagttatatttactgagtgtctttttttcagatagtggaaaggtcatttccaactgtgcagcagaacataacgattggttatttttgaaccatggttcctggcacagattagtttagcaacagatagaatctgttgaaatcatttacttctgatatgcaatcaatctcaacaaatatcactagacagagtaaaaggaggcattcagttcagccgtagctatgtgcgtgatgtgttagcaaagtacaatatcacattcacttttactctttcgaacttgttctatagttacttacccagaagtaatctacatgatacagtgcctttttctatccttggcctctattattttagggtgtctatggatcatccggcatatattttgatccatacaccaaaagaatgggcatggcaatgaactgccacacaagaatcacaaaacagatcagtgaaattttgaggtgttttgcgcatcaacttaacaaaatatcatcctgtttcgcctgacccaagttaatttgattgatcaagcaggtgttgctgccttgctgctttctgctccatgaacacctttgaagttcaagattcctgaaaggcctcgtcctttagcgaggtgctcaatttcagcaagcctcagtttaagatcctccaaatctttagataaactctcttcccgttgtttcaattccttgagatcaataaaaacaaccgttaagctatattttggcattatcaataaggaacctggaaatgaaaacaaacatctctctgaacctacgcatattgctaacttttactatgaagataacttaaatgatatattgtcaagtagaccggtgattaacttcttataacatttcacatcaagaatgacatactttacatattctaataatattctggcaggaactaagattttaaattaatagttaataagagattttttggtcaacagtgagtagtaaataggtatcctcattccacatgcaaagtttcaccaggtaaatggtgatttcacacttcaaaatgtttctaaagggtggcattcaaggtgtggttgaagaacacctagcagttcactaaaaacatttctgcatgtgcattccataaatttagacataaatccatattatttgggacatgttcaactctgcttactgcagcagccgctgtggctgcgacagctgaaaacgactgcaagacagcaggaggcatagtactaaagcatgtcttatcaactgatacgtcaggcatcgatcatgaccagttcctggtgattaaactaaatcaggttgccacctgctaattgttttcttatacaagattcagtgtagttatttgggttgttcattcctgattttggatgaactgtgcaaaactgggcatagtaatttttctgatgtgtcctctgggagctaagctaaatatgacactaagcacgttgatttccacttttcagtcttaaacagattgagtaaacccagaatgaacaggcctagtcgttatgatactagatatgtctatctccgtatttacatgacaaattttcagaacccaaactgcaatcatgagttataacatcttcctatggacatcaaatttaaattactctggctacagcataagggcttatagattagagttttgtatgttcattcttacgtgcaagattaaatagtgaatacgggatatatggctgttaagtgttgtagcatatttatgttcgttcaaactccaggagaaaaatatagaaatgagtcaatgctagaccgaaccacgttagaaagtaccacctcaagttcctgtttacgagcttcctccttcctagcctctgaccttgcatttctttgcacctcaaaaattaaagcagcaacagcaacctaaaaccaaaaagatgcaggtttcatttcctgatatttcaattattttctttattttttcacataacagagcaaggttacttcagcccagcaaatatattcctgtggctactataaatctattggcatacaaggttcattgtaggttaagtgaagtaccgaaaaaataaagccttctccaatgagatccgtagcagcttgtacagctttctcctcatttaaaggtgtgatttccacatctgttgcatgcccataaatgcgcctttgtatccttgtagtaacacgatggttaatctgtaacaattgttatagttacaatcggttagttatatgtcagacctcataagggcacaaaggatacggccacagcccacaacacgtaaatacatttgagagggctctatcttagaaaaagccagatgtacaaatttccaaaagcataaatcctaaggacaaggataaatctcctcaaggttcatgctccctgtattcctcaatccttatttctctaattaaaagaatatatgatgtgtattctaagtcagatatgtgaaatatgaagctccatatatggcagacagctcacatcatagacagaaacctatcatagatcagtgtccagccatttctgacaagccagaatcgaacaacctcaaatgggatgaaacgcttattgatgaatctatcagctgatgatcaagaccaactgacctacaattaaactacaaaatgcttgcacaacaccaaacagctaaagttgcttcttggaaattgctccacccattcgccagatggtactgtgctgaagtatcatcaagattcaagacagccacatttcctcctactactctttaattctttatctttacattctgtcaactctgcaaaatcccctttcacgggcacacatttcctctttcctttttcccccgaggggcacacatttcattaagtatgtaagtttttcgttaccaagaaatggatattgggagtaaatagccctaaccagatccccttcccacgagcctaacggatgctgctccgatcattttcccttatcaaaatttccttcccttaggcgctactttctccgaagaacacaacacgatgagggggagtaggaggaggaggaggaggccccgacctgcgcgatgcagatgatgaagttgcggaacttggggtggacggcggcctggttcttgaggcggctggcgatgggcttggacagcgtccgcagcgccagcgtccccagcttcgccaccggcagcgacattggcggcggcgattccctggcctcctcctccggcggcggaggattggtggaatcgtgaggggattcgattcgattcgattcgattcgatggggggagcagtacaagggtgggacgctgattggttgtgttcctgtgaaacggaacgggagtaagggagggaatgtggacttccttttgtgatgaatggcttttcgagttttgttgacttttgactaattcatcttcccctttttaaaattcaacttcttcaaaccgtattttcttgtcaagcaagtatacataaattaaaattttcgaatcagaaggggataaatgggtaattaagtggttacgaatattcatattcttgaggcatcaacaatccggtgtattcgagccatctattctattattaatttctcttgttttgaacgaagtgagcatagtttagttgtggtggaacaatttatacgaatttaaattttagatttgacacggatgatcgtatttatgactaatttttctttcagtggtagacaatgtacccctcgacttgtggagtcgtggtgacttcgtcaatcttaagataagatatgttggctcactttatggctgattattcttacagtgacacacttgttataactttgtcaatctcaagatatgccggcccagtctttcgaatgtgctcatatagatagatgtgcatgtatgcatttatagaggtgattgtgcatatgttgtgagcgtctgcgtttgtactatgtttctaaaaaaatattctaattgtttgaactaagttaaagaaatgaaagaactatcatttaccaagaaaataaaacaataacgggaaattattgaccttgtttcgtggttccaatgattttattgatttacttagttacttttgccggtttaagacatgaagggattttttcccacttttatgggataaatcgtttctgaaatgccatactaatagttattacctccgtcccaaactatactatatagataaaatctcttatatttgtgaacaagatagtatattttttaaaataaaataaaataaaataaatatgtgatatatcactcaaagtattccataacatttagggtctatttagatggttgatattttcagctctaccaaagtcggtaatgtaacaaattaactaaatatgtttcttccaatactacctaccaagatttagtaattctgaaaaatactatcaaattttggtaaagcttaactctactaaaatttgatacaccaaaatacgttaaaatttaacagtactaaatattggtatggttgatgtaggtaataattatttcgtcacttcctagatgggcatcagcccgttggtcatttggactaacgaaaatgcatgaacttaattatccttcaagaaattaagcacagaaaagtcagaacacagtataatctataatctagagtcatcgaaaaagaataactatatttgttcgggtagttttgttcttcttgtgtgataaggtgtttcaattggctttaggcatgcaccgttagctttcggcattaataacttgacaaaactaggcaataatgcatggatttctcgtaacatttaaccctatctcacctaggtaaaaaaaaaaggacatttttaccacatataccttctgttaacagcttctcaaattaaccatgctcaactacacatgctatgccctagccaattccatacattagctttttggctctttaacaaaagtgatagctagcaagtcagtgctagcttatgaacagttcaaagttgatactgactaactgtaagaagttccctcacgtatagccattttcttttgcaagtgtaaacagttacctctccgatcaagggtagatttagaaaatttgtgatactggtaagtgtcataatacactgctcatatatatttaattcatagtatcatcttctatatataaacatttgaaccatagctttcaccgaaaattgttgcggtcatctaacctacgcatatagtatccattatccaatatgtaagtatgtaactctaccaccacacttcatatttacacccttttgctattttttgacccaatacaatgtgcagtcatgtactaaggatcacttaatttttttgaaaattagatcaagcaaagctctttcatgctttccatgaacactagcccctgaagtctttaacaaaataattagtgaaaacatcttcatagaagatcctgtatcagcacaccttccattacaactaaaatgcactaagcatacagacaaataggcaattaagttaagcagcaagcactagcctatgtgtgtggatgtgcatcactaatcaaatgcaaatttctggaagggcgccaaaaccagtggcatcctcaactggataaccacctccccttgttggtaggttattgggcaccccattgctatgttgcaagctcccctttagcttaattcaaccttagaccatttgacatttggctaagcacagcaagacagctacttaaaaattgtttattattaggggcaaagatcatcctttatatatatggcactaaggctagaaataaaaatgcacatatgttaaaaacaggatcaagctagctgcattgaaaaggtaatttggtttgtgcaataatagagttgtaaagtgacatccccaattgcctttttttcttaagaacaaagtagtactagtagtaaacaaaggggagagatactctttgattaatggttcttgagaatatgcatagatctcttgccacctttttgcttgccagttaccattgcttctcttcttgctcaatgtcttcttccatgaacccatatagagcatttgcacaaaaaaaaaaaaacaactccgttgaatagttagtgcagccctatcaccatggctcaagttccatcaacttcaagtagcacgatcaagagcatggtttgtgaaaacaagaaatgaaattttagtaaattaaattgggtgctcttcttgagcccttttgtgagcttgcatgcatgcttcactccactgtagcttacttgcttacatagcttcaaaattagcactaactaatctcttcatggctacagaattagcatgcaaattaaggtttaaatccacccatgtatcgacgacgagcacagtgcttgcacgccaacgcccaagaaatccctagtttcctctctcccgacgccgccggcgtccttcaggccggcatggtggcgcaccgccgacaagacgtcgtaaggcacgttgccggcggcccccgtgagctcgctcattgcgccgccgaggttggcattgtgatggctcgcggcggcgaatagggctgcaccgtcgaacttgccgcactcgtcggccggtgaggcggtggcgccgccgggcttggtcggctcgaacggggacactaggggcatcgcggcggtggatgtcacggcgccgatctgcgcggccttctgcagcagagccgtcgcggacatgtcggtgggcgccgcgggcttcgcgtgctgctggttgctgaacacggacggcacgctctccgcctccttcgccgccgccgtggcgctcgtcagctcgctggcattcgacgacgagagcttgccgttcccgtacagccagctcagctgcgccgcgtcgaactgcggcggcggcgcgccggagctcggcgcgaagagatccacgtacagctgcggcggcactgtcgccgcgccaccgctggccaggacgccaatgtggcccatggacggcaacgcctcgccaccccacagcgacagcccgccgtgccgcgccacgccgccgtcgcacaggtccccaccgacgccccccgccgccggaccgagcatctgacccgccctgagctgccctccagccgccgccgccgccggcggcatcatcatgtttggccgcatgcccgccatccccggcccacccgacccggcgaacaggtagctctgcccgcacagcgacgtggccgtggccgccgccgccgccgcggcggccccggacgccgcgttcagcctcgccgtctcctccgccagcgcgtcgcagaacgcgcggtgcgtgatgaagctgtccctcctgcatccaatatccaaccatgcatggatcgcgttaagctatcgccaccatcgtcgacgatcatatcaaagcctggagctaacaagccatataaaactaataaactatagtcccctcttctaatgaatgtatgctaaaattttagtgggggcttttatagttgtaacgccggtagtaggggctcgagatcctcccgtggccgtggccgtggccatggcggggcggcgggtgtacctggagaagagggtgccgcagtcgcagcgatactcgcgggtgccgcaggtcttggagtgggccttccagtcggactggacggcatagcgcttggagcacttgtcgcacttccacttcttctcgccgtgcttgcggcagaagtgcttcttgatcccggtgaggtcgccgagcgcgcgcgacgggttgtggtggacgcagctcttctccgggcacacgtacacccgcttcctcggctccttcccgctccgctgccgcagcttccacggcaggttgtgccctcgccggtgcagctgcaggttctggtctcgctggaaccccttcccgcatatctcgcacacgaacctgttcgtcgccatcagcgtcctcggcgacagcgcgatcacctccgcctccggatctgcacccaccgacatcgccgttgatcagtcgagtcaaacacagcaaaatggggaagattttgaggttaattgtgttgtgcacttgcctggtgtgccggggagattgcgcttcttcttggcgggaggaggaggaggaggagggtgttcttgctgatggttggtgagaggagcgaaagggttggagatggctgcggcttcactagtcgccattgttatcaaattgctaagcttgtcgttggcttgttgctaattaatcgatcgatctctcttgggatcaaactatgctagttgctgatcgatctcctcttctgcttgactagttccctttggagacaaaagggcaacttttgttcttaggtatgggtcattacccccaagcataaataagctttgctagctagtggcaacaacaaaaccatcaaggcaggataaatatagagctttgctagtgagagtgagatcgatggagagagattgtttgtgtgtgtatgtgtgagaataaaatatttgaagtggtaaaaaggtgaaagttgaaaggtgtgtctttaggtgtttgtgcaagcatagcaagggttagctagtgtagctagtgtgtgtgggtgtgcaatgcatcatgacacatatgatgaggagaaagatagggaaagggggaaggagggggtggtaaaaagctgtggcttggtgcctttgcatttggcatgattagcccataatgtgatgcttcctgcatctgcatatccccccttctcatcaaatctcagccttcctccctctcccactgcaaaggtaagctactgcagctgctgcctctggagcctgcactgcaacagtgcaatgcatgggctgctactttctttggcctggacccacatgcaggcacacaccttcttaagtttttgaaaactagcttgttagttgttaaatagtactccctccgtttttaaatatttgacgccgttgacttttttaaatatgtttgaccgttcgtcttattcaaaaaatttaagtaattattaattatttttctatcatttgattcattgttaactatacttatatgtatacatatagttttacatatttcataaaagtttttgaataagacgaacagtcaaacatgtgctaaaaagtcaacggtgtcaaatatttagaaacggagggagtactagattgattggatcaaaatcaagaaaagggatttgctacaattgtcaattgatgttgtttgagccgtcatctcaagcggggtcccttgataggattagaatcacttgatcctgacttgacctggatttgaggctgataaaaagggtgttatatagtggggatcatgtggtcgaatttgttatcgtcttattgatcgttttgactagctaattgctatggttaaaattattatgttcttgctgactagacggaagagatcgatggattagtaatttaatttctatgataggaggagagtgatctcagcttgcgtcaataccaaaaaaaaaatatctgatcgatcgttggcgtttctttttcattatctgcaccagtgtaaaaatgacataatagtgtaagatagatggagtattaaatgcatagggccgagcaaatcaatccatttctctcaaaatttagtatgttcaaataacacgattcatggtagacacattgtctaaaaaggagttatagacaacaaaagtgctgctttttttccttgattaagttctgccttttcaaaacggaagctttcatgtgaagaatcctgtcatcttagatttgttaatttggaaagaatatacatagcttcgcttaaaagttagtaccgttttgattttaaaggaactggcgagatcaatcaaaaatagacagaatggtgcatcaaaacataaattaacaacgaaatatgtttctttctcttttcttgcacgccaacttccttgagaattgaaggaaaacaatacaagaacggttggcccgagaactactagcacacaataccacagattcactatagcactcgtgtactccttccgatccgttccaaaataattctatgttgaaaaggaaccgtcaagattcgttgtactattctattttaatctaggttgatctattttgaaattgatggagtactcccatatatggagaatttgctacattttacagtcgatctgcttctctttttttttgagagagtctctgcttaattctgatcgtgaatcaacaggtagctagtgtgaacgaggtaattaataatttctccattagcccgctacagctagctataaactatactttttcctcccttaaaagttaccaatatatattttcactccatattacgcacgcataggctagctaactatgcatccgatgatccgaaggtcaaaccattagtatacgcagctagcctttctactcgccttggatgccattctacgtatgtagtagtagcaatgtagcatagcacacgagacgacggtgacacagtagtgtctagctaccactgcactgggagctaagctagcgcacgcacgagagacaaccccagcatcgtcatcccccacgcgcagaacgagacacctccgtggattaggggacaaattacaatgcaaatcctcttatatattctaccaatgcaaatttcattgctatagcaaactagtaaaattgattaattactctgtacgtgcgtgctaatttgattaatcatctaggagaacctacgccggcgacgtagccatgatcgagctgggcgcgcgtgcgacgacgacggtgaggtgagccccagctacacgtacgcgggcggcgcggcgggcacgtgcggtggcggggcgggcggcgcgggaagcgaagagggagagaggccacggccagggggaaggcgacggcggaagcgacagcggctggaatatttgtcgctggatggcgccagcctgcttgcgtctgctcgctcgttgtattggaagactagttaaaagagaggagatcgagatggtggtggtgagattattaacagagaggtcaaaggagctagctagcactgcaggttaatttgtgcatctaaatctcacatgtttctagacatataggagagtatgctacatgcatgtatccactgatcgatcgatctctcgtgcacatgcatacgatctgatcagttttattgattccctagtttgatcgactacatcaggaacaaccccttttaatcccgggttgtaaactgagacgtccagtccgggactaaaaatatccatctttaccgccgatcaaaatagccaacaataaaaatggatttttattttttagtcccagttggtaagatggtagcgctaccatttttagtttcggttgattagtttttttctttttttccattgtttttttttgcttgcatttattgtcaccctcaaatccccacaaatcatctacaattgcccatccacaatatcatccacaatccacaagtcattgacaaaatcatccacaaatctaaaataatatacaacaaagtttacaaatcattctaaaaatattttaaaaaatcacaaaacaacagccgccgccggccgctcccgccgcccgacggtctcccctctcgtcggatctggcggaggggagactacctggccgtgcaccgcctcccatcccgctgccactgccgcttcagcggcccggtcgccgctgcggccgcttccgccgctcggccaccgccggaggagaggccgccacctgccatcgccgtcatcggaggaggggggaggaggggaaggggaggaaggggagggggaggaggtggaggagagaaaatgagataaggacgagaggcagcacgcggctcgggagagttttcatgtttttttttttaatttgggtcctggttgatataaacaattaggactaaagataatagggtctgacatgtttttgaatcgggactaaacatgatttttagtactagttcttactcaaatcgagactaatgtgatttttacgtgacttagcaaagatcacttttgtagtagtgtgtgtatccagccgtacgtacgtacgttgctggtataatatgtacaacatgtacatgactctttcgtgcgtatatagggtgctgtagttttaatttgatttgtaccgcaatttggtttgttggttcacattaaggccgagtttagttccaaattttttctttgaactttcaacttttccattacatcaaaacttttctacacacaaaaacttttaacttttccgtcacatcgtttcaatttcaaccaaacctccaattttaacgtgaactaaacacagcatcgctagagccagtcaattttggaactagccctagttaattcatgtcagtggccgggcgtgcaactgcaggcaattaatgttgtcaacgcctgccatatttacatgcaccctgcaggacgtaacgtatatgccggcatgcaacacaacatgtatagtacgtacgttacgtacgcactatatattgccatgcatggatggacttctcatgtttgtcttttgcaaatgcaaatcctttctcaacccatctgtaaattaattaacaattagtcacccttttaaaaaagaaaaaacaacatgcatacatatgcatgccaagacgaacagcagtttaccattccatgactttctggagtatagatccagcgtacgtacgtcaagctgattttttgtacgtatgcaacaagtgcaaatgctcaaggacgattctcaaattcaaaccaacatgcgtccacaactacattacatgcataacaatacaggttaagctctgcgtcatttagaaatgattagtttggatcgatgctgctggagtgctggtcagtacagtgtggtcacacaaacattggcgtaattaataaaggattcagattacatcaacttgcatgaacatacatacctaacacgtactgtaacatgcaatgcctagtcagctgatgtgtctgatggtcacatgcttgtctcacttagaattagattcctctttagctccatggaagcagtgtatgtcagggataggagatggtgaccaactacactgtttaaaatctctgactagatgagtataaaactatggatgtctagctatctgcgaggagctggtaattaattaactatattagttggctacagggtttaattatctatgtagttatgataattaaccgcaaaatttgcagagttaagtacttgcattgtactgtcgtgtctcgcttgtcacacactgatggaagctttcacctggtctctcgtagaactagaacggcgtagctaggataactagtagagactagagagagggtgtgatttttacttttaccttccaaacattttaaatttgagttctgtacttgcttccaacattgcggtaattaaggagatagagtcatagagggatcattcattaatacgatcgaatcgatccttaattagtttagctggctatatttcatttgaggtttatcatttcaatttctgaatatacatcttaaaaagcgcctttaatttgaagcaaaagatggtaatttaaccaagccactcaaaaagtaatcccacacatatatgtcgtcgatgctaattaataagaagattcagtcatgcatgactcaaaaaaaaaacaaatgctaattaaatgcatgcatgggtagtgtcatgaacatgtcatgtcagtcagatcagtcagcgtactaccggcaacgtgttggattttagagtcgctaggcgtgtatcagttaattacaattaaacttaatttgcacagctcttccgaaatccaatgtgatcgagaatatatcatgcaaacaagatcgcatcaagcagcaggcagctgcagtgaaggtcatgcatgcacattgcatgcaaaacatatcacaaaaagctagaagaagtgtgactggctgctggctgcaggtgaatatttggaagtgtgggaaggcgtctgcttgcgagctgactttagtcccaaggccctaaaccagatttatgctcctctaatagtattggtccccatgacggggaggataattagtctttttggcctttggggatttgattagtgttaactccttggactctagcgtatgaactcttgcaggccctaggatattctctcctcatgcccctagggctccacaggctttctaaagagacacaagattcctttccaaagtccacagaaaatttgcaactttttggtccccattttaattctaaatttcttgcattgcattgctagcagtagcaaggcagcttgggaggaagaggagcaatgtatatactttgggaaatgaaaactaacaaagaggtttggaaaaaagagaagccttgtcactatgagtatgtttgcttccttggattgaccttgggcaatggtcagtgtatagtttcaccgtcacaagggctggtggctagctaggctgctagtactagctaattgttgtttcttaattgaactatataggcaaattaatcaatctgatttggcaggaaactatatcgatcttgctagcagctattatattgaatgcattattgttgtatatattcaattattgttatatatagtatatagtatcatgttagttttcctttttttttacggggaatcatgttagttttcctgatgtatgcatatttacgtactgaaaatcaagacattatatatgtcatttgtatgctgagatgggtttaattggccgatcagatgaatcaaacaagcgtgtataaaaaaaaaatccctaattagctatagcattctcagatcgatagtatataatcaaaataacatatccttgatcgatcagttcatcacctaagcataaatttcttaattagtttttgtagagacattaattaattagagtgaagagctaggcgactttctcaaaatgaagagcagaacgtgcgggtgtgcaagctaggctagctgtagctaaaaactctactttggaaaagaaaattaaagtgcacaaacatataggatagctagctaggctccttttttcccccttttttctctcgtgtacatgctgcctcgctttcgttctttctgagtggagtaggggaggcgttgcgaatgcagaagccacgtatgccaaaaaataaaagggagaaaattaaccaaagctggcgacgtcgatcgaccgcttgtaattaattttaaacggatatagaaaccagaattaaggcttcgcatataaatgggttgggattttcggtggcacgtaaaataagccattaacacataaataattatgtaattattataaacttaaaaattgattatttatttgtttatgaaatttctgttaaaaacacttttgcataaaactcactgtttagcaatttaggaagtatgctcaccaagaacaaggaagtagtcgtttcgaagtagttaagtagaactcacccttaagagcaagtttaatagctaactactagctacaaatctacattagagttaacatgtataataggttagctccattttttccctccttttttctctcaatcaaaaaaaagtttttagacatgctatggatagaacggaatgcgaaagagatggggacacagattacccgatgatggttgcaggggagacctcattttccacggccgacaaaaggagaagtggaggaagggagcaagggtggtctctcactcgacttggctgacaataaggtgaatggtgagattaggcagtgctatggagccatggagggagtggtgggaggacagaactcgacgaacacatgttcctaagcgtcaagcatgtccagctctcgatctctccctcactctcatgttccctggttggttgaggtggaggatggcttgcacacgactgtgacgaaataaacaagcctccctcaaagttagctgccggcaaccgcatcatgcgcgtaaccacctctcctccccattcccttgcttccatccttacggagagcaagtttaattgtaaagtcaactgctagctataaacttatattagagctaacatgtgtaatagattagcaataaaattgtttctatttttcttcttacatatttactttagagcatgtgtagagctagctcttacatgagagctagcaatcatcatttttcaatttatctctctttcacataagtttatagttagcttatagctcactattaattaaacctgtgaggaatgaggagcctcgccaacaccccgtggttctcaaatgtacatgcaaaggcagagatatcttatgcctaccttctgcagcccgtcctcctccattagtccatccctttctactaataatcaatatatagtatataatataataagtagagataaatgtaatagtttttttaggaagataaatatattggttcacatgatcgtatgatttggagttttggacacgattgtgtggttccggcttagggtgggtaattcacgagtatgcaagttgtggcgctacaatccagccgtatgtatggtagttgtgtcgtcgtctactcaggggctcagggcccatgggctgcaacccgccgcttctcgcactgtgtggctgttcgcggccaaaaatagcaaggaacatgtgccaaactggcaacaagagtctttttgtcatgtccacatagggcctgtttagatccatttagaatgacaaataacaaataataaaagttttggttagcgttgtaaaagtactagtcggtgtttaaatgcatcttaaagttttaccattttagcactaaagaaagagaaagagagagggtgtggtcccgaagcactttttggcaaaatttgctactatggactaccaaatgccaaatgccaaatgctaaattgccaacttttgctactagtgtttagatctaaaatagcaaaaagtgctttaaaatggcaaaacttttgttattttggagggccctgtgtgtacagtggcgggggcatgggacgaccagtggcctggccccctttaataatttttatacataattatctaattacaatcaattagataatcaacttaagaaatagtgcattagctctcttcaatactgttagccccctcccattttaaatcctggcttcgtcgctactacttgcttgcgtgtgtgccgcccatcggtccatgtactaaagcaacggactcttaaattcaaacatgtacttctacacctcatttcctattatccaaacataccctgagtgacctaagaccctgcataacttgtgccaaatgaaagtaagtcagatgatggctagggatggcaacgggccaggtcaggcacgggtagagcaaaaccatgcctgacctggcaccgacaatgtcacggttacgggttagacataccctttacccttcgatatacgtcacatatcggtttggtatacctacacgcatacagatgtttcccgcgtactgtaaggaaatccttcacagagtctatggatgggaagaatcctactcggataagattgggtcgttaatgtatcgtacagggtctgacatctccgagttctacttggagacctctagatctgcaatataaaagggactacgatctcgccggatccgacaagttcccttgttctctttgtaacctgtgttttctaccatataatcccacatcaactggattagggctattacctatcaaggggcctgaatcagtataattcttgtcttttgtttgcttgatggcgtactacgtagatccttgtaccaacgtaccccaataccctctatatccggtctacgggtatcacccgttgacagtggcgcgccaggtagaggccttggtactcaaggttctactactatgtcatccagcttcgtcgacaacaacgtcagcaccagcctcagccaagtactccctgcttcaacaatgctggtatggactcaagtcggcgaaatcgtcttcccggtttacaccacgacgccgatctcaaccggtcctccaatgaccggagacgagaacgtagtggctacgaaccagggcgattccatgtcgaaaaatccccccgtcgagacggagaacggaatatcgacgacatccaagctcaagaaggattttgatacggccaaaccttgtccttccgacatgaaccacgagctgacaaagatgacttccgaagccacaaggtcttggtgtcttatccacaaaaccaagaaacacaccctgcaagattgctgggttttcctcaacgtccgtgctaaaattcgggcctgcaaagaacgtggaattcagcgtacttctccaactcgggatgtctattgtcctatttacaagacaaagaatcacgacctcttgagctgcaaagtctttctcggcgccatgaaagctcagtctcctaagtcatatatccccatcagggataacggcaaggaacaaggagcgactccaacttcagatcgattcattggggtaatcgatatcgaccctcacgaaccatcggtcttacatctccttgaggactatgggtcatcgacaacgagcgcgccgcgggaggtattggctatcgatgacgttggcacgtcagcgcacgccaacacagaagcggggaaccaatcgactactccagtccagcacatcagggccgttcaagcgatactgagggaaactccttacgatcccgttctgaaccttgaccttgagcgttggacagaacgactacgggaatcggtgactaacctcagcaacgcatttaaagaagctgctaccgcagcacaccaggagcagccaccaactggagaggccaatggtgtaacaccctgaaaattcgaccgacaaaaatctaaactctaaaaatatgggcattcaaaaactttttaaataaattgcatcatgccgattttctccgcttatttcattggaatttagtttcgaagtttatcaataacgaataaggaataattaactaggaataaaacctaaaattaaattggcaaaagaaataattaagatataatttaaaataaagatgaggtgaggatagaaatgaataaaatattatcgcgaccatatttgtatcaattaaatttaaatgcgattgaataggaatttactctaattaaattcaagtaaattatataaaaataaaatatcagtaaaataaatctagagtggatccattggttggaataacacaaatattgaataaaccatatttatgcaaaatttaggatttatagaatcaaatttaaataataaataggctaaaatcgggttaaataagaaaaaacactgttcctttcactctaggtgctcgacgtggtcccctaacccagccccctcctctttcccctctctctgtcgccaccgtcaccacgcgccgctgcccgtcgcgcctggccgcctcgcgccccgagccgccgcgcgccgtcgccatcgtcgcctgccgccgcgccgacgtcgccatcgccgtctgtcgccgtcgccatcccatcgccgctgccgcgccgcgcgccgttgccccgcgcctcgagccgtgccgctgccgcgccgcgcgccgtcccgtcgccttgcgccccacgccgctgccacgccgcgtcgccatcgcgtcacccgtcgccccgcgtcgcgccccgtgccgcgccgccttgcgccccgagccgcgccgcgtcgtcgccatcgccgcc

SEQ ID NO: 67877 - DNA, 672 bp, Oryza sativa
  unsure (1)..(672): unsure at all n locations
atccaagcaggaaattcagaacccagaacaacagattagcccattcgaatccaaccggccaatttccgatgtgcgaatcaacaaccatagcatttcacttaaatacatgatgagtcgcacaagctcaggctgctctttctctcacgcatttgcccccaaaatgtgcaacgcaaagcattcctgaccactcagctcacgaaaatggacccccgtgctccagaatccagcattcggaaatcctcgcatcgctcaaaatccccccattctctcaccccccccccccaccacaagaaatcccctcacccaagccgccttcagaatccagacaacaatcccctcgccgccgcccaccacggcgaaacctcccgcgcccgtcctggcatcgctcgagggtggcgtgaacccgaccacctcaccccgcgtcgcaaccaaccacgaacccccccaaccacagctcgtacgaggaaaccaaaacaacaggaagaactagggctcccggatctcaccgacgacaggtcaggcagggcgggggcacacgccgacacggcacggcacggcacgggaacgagcgggggggtcgccggggagcccgcnaggcggccgcggcggcggcggaggcaaacggattcgcgctggttgcccnagggcgtggggaaattggcgttcgattgt

SEQ ID NO: 67878 - DNA, 4642 bp, Oryza sativa
atgttttagatccatgttgttcacctattatttatatcggatctttgcacttgagcttgcatacgagtatatgacacttgtgatgttaatgaattctcaacaaacatatccatatcttttatatgcaaccggttggtcatcaagtgaaggatgataatcgatttgttgagactaatgttctccttttagatgtgaaaaggaataggtcccactacgatgaggctaatgaatgacaccatggattaatggtaaccaagccaatgacatcgtcatgttggcaagaatgaagtcaagcttgtgatgagaataaagtcttgacaaaggatggtaaagacctcggcataaacatggttcaatcggatggtcacaagtgttgatcttggctcaagcattgaccccaagttggatggcgcaaggcaaaggtataatagagctaagaatattttcttagtcttttcccggtcttggtgtttggtgtagaccggatttgctagatagacgccgtactatcaagaagagtctatgaagcgagcatgtggatgatcttgcgccatattagttcatatgcatgtaggtgtatttggtgggcttgtctagccaagtgtgttgagttttctcaagtcctaaacaaagagagaagtaggcaaatcctataggtttgggtagcctcatgtggttatgtccggtggagtatcctttggggtgtgagccctttctccctgagaaaagttgtgtttcttggatggatttttcatgggttggatggccctttgaataagctttccatagagtccaagaacgtcaaattctgagatccgagtcaagagatatcgccgttttactaacggttggttgtgctgaaaagtgacctgcagtctgaccgtaggccttaggacggtctgaccggatctattagccggtctgaccggcgtggtaaggccggtctgaccggccccactggtctgttgcactggtatgatttttggtggcgatacagagccgccagagccgcaaccggtcagaccgagccgacggcggtctgaccgagccatggacggtctgaccggctactacactgcggtcagaccggctaggttgagtgggctcaatgattgccctgtaacggctagttttctagtcgttacaaagtagtccggtttgaccggccactctattgcggtctgactggtagagcacatagttggggatttcgactccaacggctagttttgatggttgggggtatatatacccactccccagcagcaagggtaaggttttggcactccattgcattatcttgaacccttgcaagagctctcacactcttgtgcacttagtttatttagtgaggtgttggagagtgagttaagccaatccaagtgcattgcttcattgttagagctagcgtggcacttgatcatcctcggcaagcatcctagacttgttactcttggaggttgccgcctcctaaacggcttgtggaggtgttgcccggtgacctctccgaggagattgtggaggaggcctgacgctgattgtgagtggtttggagttcaccaccttcggagtgaaggaaaaactaccctagtgatcgaggcttgggtagtcctttccgtgggccggctcccaccttgcccaccccttgacgaagggggcgtgcggtggcttcatgattgagcggtggagttgtgctcgcctcaacagggattaggaaaccggcgagtttccgaacctcggtgaaaaatcccttgtctcttgtctcatttatttgttgcatttacatttgagcaagtttacatactagcttatttgtgcacttaacatttgagcaagtctattatcaccctaggcttgcaaaccttaacataggctagcttctttatgcacttacttgagactagttgatttaggttttgaattgtgtaaaaccgttttgatttatgcttccgcatacaaatttcggttttagccaaaagttttaaaaccgcgtattcaccccctctagtcggcctccttgatcctataacaggaagatgcccttcaattataacaggaagatgtccagattcataagtattaagatgtgtcatatccagcgtttacaactccgagatgcccttccgtttcgggctctggcagaataacggttttcgcgaaatccggtagatcccgaacaaattttataaaccaaaatttaaatacaaattctctgagtttaccaataagctcgcgaaaactagtcggctttggagaaattccaagcgaaaacattgaaatttcaaccggtaactaggaaaagaggtaaattgaaagtgttttcttttttttcattcgctattattttctttcctactataaagttcagttagtacacggaatacatcaactttttcaaaatttatatcctaatatgtactatgaatatcatactatttgtaagattttatttgattttcttccttattatcaatttaaatttgaatttagatgaaactaatcaaaatctcagatggtttctactttcgaggctcgtcgaaaccttaaaatttaacggaattcgatcgattttcgttggaattgttaatcctagtcatatccacctaaaaatccattatattttgggatgggaagctggacgaaacgcgaccctagcacgaatctgaacgggaagctgacgacggagatcgcgcatgcgggtgccacacggcccttgccctgggctgcctagtccagataaaaaatacggcacgatacgtacacgtataccgtatatacgaacctacttatacggtacacgcgtcaattaataggagacgaggagagataaacccccccgtattcgcaggctcatcgacttctcgtcttcctctcctctctctcgtttcgattcccccgcgagagattcgatccaaccaaacccacccgctaccagcgtcttctccttcgcgagcaagtaattctctttcctcctcctcctcttcctctctgccgtatttttttttgttttttagtttttttttcttcttcgcttccttcgccgccgtcgcgggttcgtctaaaagtccgcaagattcgtcgtcgtcctatcgccggtgggtagggatttcgtcggcgctgctccggtctgctgctttcgttcgttcgttcgatccgatcgatttatttgttcctggtttgggtctcgttcgattgactctagtaaagtctattctttttttcttggtttcctggtttaggttatatggagagcagtatttaggcgtttaggcttcagagatttgtttgatattaggctgatgtcgtgattcatgaatcatgagtagtttcctgcgtttaggggtagcatcactatgcggtactgctgattggttttcctgcgtttgtaggatgagattggcccccttgcagtctgtaggataattgcatgctaatgatatttccacccctaaaatcttcacttcattccaattcaactaccaagtttttttaattgttctcatgaattgcatgctcatggcttgaagacgtcgagtctttcctccttgtttttctttaattgcgactccacctaatctaaaagattcaatcttcaatgcttgctttacttgatggtttgaaattttactgtgctttgtggcgcaaagcggttgactttttagaggtttgttttacctattgcctattcaatctactgtgaaaaaaaaatctagctttatatccatgttgtgattttcttggggtttgagttgttcaatatagggagaggtgcttaatttggtttttttaaaaaaaagtttattgtgtttcctagacaatttagtgcaaggttacagactggtagcttgtaccctagccttggtaggagttacggtttaatcctctaaataatttctcatcgatgtacttgtggactgtctatgattggatgtatcaaggttttaccttttgtgtattatgcaatatgctggtctggttttcttgagcttgtgagttgtgattgtggcttacaacgagtcccttcacatatgtaagatctgtgatggaatgttttagccgcactagcggatagaagaacgggaataaaaataacaaacaagttgggacattatgcatcttatattatatgtttgagtcttttgtgtggagcattcactcaccatagtaagtattctaaacaattaaattcaacctatattaaagaaagaaaatattttagtaaattagtaaatatttattatttataaagcttttcacatgtatgcattaatcttctaaacaggttttttgagagtttgcaatgggaggaagcgaatacgatgatgactgggagttgcctagcgctgacatcactgtagttctttgcggcaaacttggctgtggcaagagcgcaactggcaatagcatcgttggaagagaagcatttgtatcagagtactcccatgctagtgtgaccagtacttgtcaattggccagcaccgcgctaaaggatggccgtaccctcaatgttattgatacgccaggtaagcatgcatcaatttattctgttctgaccttttgttttctgtgatgactattcattgttgttactacatattcatacttgttaatcttgtggatgttttgaatttgcgttatctat

SEQ ID NO: 67879 - DNA, 709 bp, Oryza sativa
  unsure (1)..(709): unsure at all n locations
aaataatgacatgaatatgaataccacctgcnnnnnnnnnnnnnnnnnnnnnnnnnnnnnnnnnnnnnnnntgtatatactttactgaagtcactccctaatatttttacaaagccaactgaaatggatgcacaaatttttttttttggccaaacttgtacttcagttctccatgatgttttgaaagccatctggctagttgcttcacatagtgggtagtaactggtatttaactgattaactactgtaaagccctggtttcaagagaatatgtatgatcttgtaaaaatcttataaatactaacaattgactccccagtgttgcttattagtagattagaaaaatggttcaacagcaataacaattcagtttcaaataagttttccttagctcacctgacgcagcaattttctgtggctaagaccatacatttcaggaggttccccataaccattttgatgattggatggaggatcagtttcacttgccatatcaaaagaatttaatgtatcttggtagccgtaatgtaggagatatgaacgaacaatcctgttacaagtgcacagtacatgtacataaggcggcaaagtataaaagatttaatgtcaatataggtacaattaaagattgagacaaggtaggaatgaaaggcggagtgaatatggtatcaaatgtaaattacgtaatatggtaaatttcacataaact

SEQ ID NO: 67880 - DNA, 3472 bp, Oryza sativa
tttttctttatctcagaaaaaatgcaatgcaaatatgcgattaggtttcaattttcagaagtctcgggttccattttaaaatggcaacccatatattttgattggtataaaatactagtcattttattattaccgtgacaatttgtcatcttaaactattttgcacacccctagagcaaccacaatgtataaaaaatgtgaccttaagacgatgtttgcacttgtaaagtgggccatatacattgtggaaaatagcattagtttagggtgtacctcatgcttaagatctaccataagcaaaaagaaatatttttttctctctaattcactttatgaataagagatgaaacaattctttttccattgtatgtggacttatcttatggctaaattctaagagcaaccgcaatgtatactaccaaagtggataataacgtgggcccggggttcaggtggtaacagttattacaaagctcacaatgtgctatgcctattctgcaaattaaggtggggtccaccttaaaaataatcattgtaaaaccatctcctatagccatgctcgtacgaaaagattctcatatctacagaaaatattattctttattgtcttgttaccggcagtagcacaatggcccggtagtagttattgtctctatccacaatgcttcttacctggctataagcttatattaattgcttgttactccctccattccaagttgatctacatatagttttttttaggttattactaaatgatctacatatttgtattcatttattagttctatttgttatttgtgcattggagtaaatggacattgatgcatgcatccatgcacacaagtatttataacccacatacaatatcttgatttgctattggctaggaaacagtggggatgatgcatgcatcgagtttgttgctagagtaaatatagcatgagagagttattagcttttcttggtcttggtgtacctatgaaatatgtagatcaatttggaatggagggagtacctgcttttgttcaacattgtggttgccctaaccataacattgtgggcatggctttaacaatggtccactattcatagggcccaccttaagattacactgcaccataaacattgaggatgcccatagtcacgtgaaatgactattttagttttgctcatggatctctatacactccctcggttcgttgctcgtcggctctagaaggggtttctgtagctgcaacatcaccgcccttcttcgggtctatttgggaagtttctgtagctgcaacttctcatataatcaaaaatcttaagctcccaaaacaaaacttccgcagcactgtaaccagaatatttatataactactttttcacgaagaacgacagtgatggctgaacatttgtcattgtgcgccatagacaaagccggagggcaccatgttaaagctagcacttcttgtagcaacacttatcaacatccagaaaggcatgcatcatccaaaggtgtcggttattgaagacggtgtgcatacggaaggatatattgggggcagttggcagtgtgtgacgtagcaattaccgtcgtagcttctccttctactttttttttatgtagatgccctaaagaggtagagctggggatggagggaacaaagagagggtaagccctgcacacgatgttagcccactgttttttcctcggcgaatgacaaaataggtggctaatcagtgtaaagcagttaaaatgaaaaaaaagcatcaatgtgcgcgacaaaataggtagtattatatctataacaagatacagagtgacatttatggatgcatatccttcgcattagcgtctgcgattacataggaacaacgctgtgcattacgctaatctgagttgtttatctgaaaggaatggatgtgatttcttattcctcatcatcttgctgctcctcatgtttatgggcatcatcttgaaatgctcttcgaccggtagctgaatggatgacactcatctgtctcgctccatgtttgattggtgtctctctaccctcgatgccccgccgctggcagggccatccattcagcgcttcgactttggtgttgtcgcatgccttacctcgacgaatgctggctagatctcgtgacgccgtcactacactcttaacaacccgactttggcttccctgtggcactgcctcggcgtcgttgtctcgactatcaaatatgactagagcatgacgaccgtgccgagagagcaagaagagatgaaaagtttcttttttgttttttattggaaaaaatctcaaagtaatcatgagcgcttgtttttcaatggatgtctcggatacatcataatccccaaaagttgcccctctgcggtcataacactaacactaatgcagaggatccgtgttcgacattcatcataaactaacgactcaagtggcaagcgacatgcagaggatctgtgtttagcttggcggcgacatcctgcgtttgggctctgccgtagttgttagttgtgtagcggtggttttcagccgtttttcctgtaataaaccgtgcaatggtatggtttttgggcccggttttccttataaactaggtcaattctcttcttctaaatataaaagtggaacaaacttccgccttaggtttaaaaaaaagactcaagtggcaagccatcaattttatcttctaactgtggattagatatgtttctcaccctatatggttagctcacattttgtcgtatttgtaacgtgtaaaaaatggtatataaacatcaatgttaaaaactttaatattattattcagttctgttacaaatcacaaatatttatatagggactagggaggtagtatattcatgtcagtgtaaggataaagcatacctcctctatatatgtgggttcacggtatatgaaaataacatacctaatagtatacacggataaaaaaggaaattatcttctcggaatataaggtgttagagtcctaatcgggaaagataaagttttcttagttcgtatcttgttatatttctccgagttctactgggagaggaagataatcttcactataaatacaagacctcctaaaaaaaagaggggacacgccaacagaggcaaatacctatctagacaaacccaatgtagcagccacatagctagacatgagggatctataactaccttcaatctcaccgagttcatgttcgaggaataagagtacactagctgtcgactaggtgtgagacctctatgacgccaagtcaacaaagtccagattaggtcatttcaaacatctactcgtgtgataccgatatataaaagacaccgattttggccaaaatgagtagggttattacctgtcagttaaggaaaccaaacttatataaaaatctatgtctcccatctcggttacctctgcttataccctggtttcaaccattcttatactatacaaataccgtctg

SEQ ID NO: 67881 - DNA, 4970 bp, Oryza sativa
taacaatgaatcaaatgataggaaaagaattaataattacttaaattttttgaataagacgaattgtcaaacatgtttaaaaaagtcaacggcatcaaatatttagggacggatggagtatatctctactattataaaaatttttgccggtactttttgtacgtcatccgtgtatgagtcggttttgaagttcgttcgctttttttaaatacatgagaagttgtataagaaatctctttaaaaaaaacttacatgctaacttaagatgatccgacttctaattgcagctcatgatttcctaaaagaatatatatatatatatatatatatatatatatccaagtgaattctcacagtgaatttcatcttaactaaatagtataacaataataaaattaaaatagcctttaccgtcgcaacgcacggactttttttttctttttttttaaaagtgcatcatgttttatatacttcacttatttcatgccagagaagaggttttttatttattgagctttgctatttcgggcatgttcatcaaaatcattaggaacactaaattttgacattggcaatttttagaggtgtttgatgtgtttgatttttgagctttaccaagttaagtgtttttatgagaggaactctaagactaccattttggtagagtagcaacgataataacatgtttaatttctgaaactactctgatttggtaatgcgaaaatttgttatggtcgaaagtgacaacaaattaaacatgccatctcatgtgagttttgtcttttattaagactttttttaaaaaaactcaaactttattagttgtgcgcatcctaaatacagaggtcacggatgtattcatcttccttatctttaaaaaaattgccgtgagtgtatccggagattattttctatatggtgaagctttaattcgttgagaacaatttcacttatggtcatgaataagaataggattcgtctgtgaaaccgaactaaattttttgaaaaatcaatcgaaattgtaactttggattacagaaggtcaatccaaatcacttaacatctcatgtataaaatccatccttactcccaattattgctaccacatcacaagtataaattccacccttcagcctagcctgctcacttcgaaacaagcctataacatgaagatagttagtacggagttcatcacaagccttccataatagaaccattaattttatatacaactgcaaagagagctacagtgatccatgcattccgttggatcaaacatgaatgcgcgagaccaacctctatattaatccacaataaaccccccaaaaaaataatctagcggtatatttcattgtttctacaataataacccctaactagcctgccggcactaaaccactggatcccatcagaacttcaaagttaagcgtagaggctgtatacacccccgttaatatagaagccggattttataaatttccattatctaaaaaaattagcctgccggtggcgcatcactgcacctttttcctccttagtttctgagcacttatgaatcacatatataagaggttgtttccaggaatgaacaggcaaacctgaacaaaccgatacattgttgtgtgcaagaagcctgtctctaggcagaaataatcaaacacgacgacaagatacaagatagttgtatcagcttggaagccgattttctcccttcttcaatttgtaaacatgtaactgtataacgatgcgacgctatcatcgtccaaacagataacgtgtaactttttttctttgctaatggaagatttaagtggggaagctctcccctagatgattactcaaaaaataaaaaatccgtccttagcccttaatttatacctcctccataaaaaaaacaaactagaagaggatttttttttggacggagggagtaattgttacccgtttggtttaggtactaccttgccttcaacatcaatgatgaggtcctctagctttaatttccacaataatgcatgaatcttcatgcacaatagccataaatttgattgctcagggaaaaaatatgtacaaaacccctaaaagcattcaagcacgtcatcttctgattccaaatataaggtcggtctacataatgtctgtactatatagaagtacatacattggtgatagtgaatctaccgttacttagagtggccatattcaaagataaatatatctttgtgtgtgtggcttggtttttttttttatgtttgtttgctatattttttcggacacaattatcatttctaagttaagaaacttaagattttttttttgaaatccattgcaagtcacaattattttgctagtttagagtaaaacctcttatcaaagctagcacaaaatgtctaaacgaagaaataatacaatggttagatcacgagtataaagcataaacactaaacaccccgaaacctcctagactaatagcgctgtgccaacactttctattcagttctcatccactccatgaccatgcaacggtgggcggccacacatgttttgcatgagacatgaaacaagctagcactgatagtgatatgtaacacaactctctcagtcataaaatatgttcatttttcaccatcttacacataaaatacaaaacaaaaatattaaaaacattcttattttatcaaatttcaatgtagtcatttctctgattatctatccccaatgtatgttttgcatgagacataaaacaagcttagcactgatagtgatatgtaacacaactctctcagacataaaatatgttcatttttcacccatcttacacataaaaatacaaaaccaaaaatattaaaaacattcttattttatcaaatttcaatgtaatcatttctctgattatctatccccaatacatttttaccttacttttataaactccgattcaataaccgctaaatataaatttattttaagataaataggaagagcagaaagctagctcggtcagcgctctcgtcgtcccttcctcccttccttccttccccttcctgcgtgctacggcagcatgaaaaaaacggccgccggcgctggcacgtgttaaacgaggctacgaccgtgccgtaacactggcgtatgcgccaacctggtagtactaatactcctacatcatacgagtggatttggtttgaactttgaaggagcctcgatttttatatctacgtcaacattatagttagtaataatagacatatctcatattttcgatgggtggctgctgggggtggagaaaaaaaagagtaaattaatattggtgggagctttgcaatttgttgggctctgtgattgtgtaggaatgatatggttttttttgacaaatcaccatatgtatgcagataattttcagggcaacctattggctccggttttaggcataactacaaaggtgtgatgaagacggtgagcttttaaaagctgcatgtcgtaagcttaagacgacggttatgcaactttttgtcaattatggatggagattcacaaatagacttcaataatgtgttctgatcttgttttggttaaatttacctttgtgtggtcatttcttctatcatttctgaactacactcgttttagagtgctagattataataataggctgtagctctctttgagcaaaggccgggatgactattccattatcttaaaaaaagtaataataaacacagattgatgttaatagccattttcttggaacaagtcaaaacccaaatgatgaaatgagtagcactccaatttataagctttcgaaccatttgacccaaaatgtttagccgtgctatcgttttcggtggagagaactaactaaattaaacctgcgtgcttcgcttccatctcattttaagggtgcagcttgctcagtgtaccgttaattaattatacagtgaaaatggtcaaacctttgtctagcttgtctttacccagacggaaaggaaaacacgcggtcaaaattattgaggatgtgggtgaaacaaccacctcgaactctatagtgagaactggagtactccgtatatgtgaaaacttgttgacattgtgtttgtgtggatatgttcaactcgagtggtacttcagaaatttgactgccgccgtattactctttctttctttcatggttttctcaagacggtttttttcacggcacgtttaaatcattattggatttgtagtttgtatacagcttacgatcgaattacgatgagggataggtggtaaacgaacaaggaatagagaagagataaaatgagaaagaaagaagatgggagcagtcaatgcatgatggccttgtttagttcgtgtgccattttttttaagtatacgaacacgcatttaaaatatcaaacataaaataataacaaaacaaattacatattccgtttgtaaactgtgagacaaatttattaagcctaattaatctgtcattagcaaatgtttattgtaacatcacattgtcaaatcatggtgtaattaagctcaaaagattcgtctcgcaatttacatgcaaactgtgcaattggttttttcatccacatttaatgctccatgcatgtgtccaaacatttgatgtgatgaaatttttggaagtttgaatgaaacactggtggagaaaccatctttgctcggttagcaaaaatacacaatagttccggttacaataaaaaccgggattaaagattatctttagtccggttcaaaagtttagagctgctttttaatctttagtcccggttgatgttaccaaccgagactaaagatctatttttaatcccggttgataacaccaaccggaaaaaaagatgcctactatctttagtcatggttggtgttaccaaccaggactaaagatctatttttagtcccggttggtaataccaaccggaacaaaaaattgtggaagaaagtacgaggcatctgccatc

SEQ ID NO: 67882 - DNA, 6570 bp, Oryza sativa
tgcacattattaagaatgtttttgaaataaaattattggacaagttttgaaactatcaagaaattgaaataaatattagacattttttttacatatgttcctttagaaaaagtatttctattttccatgtccactcacataatctaaaatttctacaataaattagataggtaactaagctaactaattcgctatacgcaagtttgttgttattctactgtaatagttgtactgaaataatgaataccttgagaaagtaagactatatctttctagagggaaaaaaatgatgctaattttgatgagaaattggtaataagagatgtttggattgacgccggcaaaagataagtatgtgggtgatgtcaagatatttggtaagataattttttttcacgtagtgtttgattcgctatcatacacacatactgacaaaaacaaaaactgcaatattgactgaagtttccgctaacgattttgccaaagcatcgtggcccatgcaccagctgcctatcggcccactaactaaactaattctgaccgaagatgccggcccgctatctcaatgttttaaatggctttttggcgctttcgttgcacagaaaatctatctaaattgagaagcacaacaggagttcacttggccattgcttcggttcgaaaggaaaacgtcgtattgtgcagttagtgagtaagcgtctttgtgaaaagagctccaaggtacagtctatctgggaaatagttatgttaattatttagtacacttaaaaaggctaggatttttgcggcgcgtaaacgaaacaagctattgttatagttaattaagtattaattactgtaaacataaaaataaacttatttgatttttcttaaaaaagaaacgtatgtataaaagacttttacataaatacattgctgggtagtttgagaatgtgttcgcatgatatagcgaagcactggctcggtcgaaccgccaaagacagggcattaattaggtggtcaatacaagtactccttccataaaaaaaaaacctaacctcattctaaaatgtgcagcgaattaaacatactctatgtccagatttattatactataattgtcacatcttagtattaggttgtcttttttttaaggatggatggagtagagcaatagcaatagtcccagtacactaagtacactcatcgatcaaagctcttattttcctcattttttttcttaattatagtcggtgcattgcataagcataataacgctcaacagtatctgccgcctaaccgcgtgcgttaatcatacgtacacagacccagtttggtttgatcctctatcaaaatttccgtagtgtcaattattgggtaagtttgacgcaatcaaataaaaattagttggtggagttgataagatgtgtcgaaaatatttcgagaggatagaacttaggctagctaaaaattatcaaatataaatgcatgacaattacattgtactctttcagttttaggttataaaatattttgactttagtagtcaaaattaaactgattcaagtttgacaaagtttataaacaaaattagtaatatttttaacccaagataaatttattataaaaataaaattaattattaatttaataaaactaatttgttaatgtaaatattactgcatttgtctataaaattagttaaatttaaagtagtttgactttgaccaaaatcaaagcatcttataacctgaaacggagagagtaatttgcactacaatgcaatttgtatgtagttttcaaaactcctatgataacacgctattttcgtgaagcgaaggctgtgagatagaatctcctcacctgtacgcgcactatgattgttttcttctcccaacatgcacaaatcttgaagtaaatgtaatgatttgaaattatgcagaagttacgtccaagttacaatataattatattgcaattgtactatatttgtatttaatacttttaaataaatttatcgataaatatatagagaggaaatagcaaaactatattttgatactgtagaaaaataaactgaccagtggcagtagtgacaagaaaaaaaccgtggcccattttctaaaccaatttctggccgaagatgccggcccactgtctcaatcgggcccttctcatgtaggccttctcctccgccatgaacagggccccgtcaaggcccatgtggccacagacgaaatagcaaaagtctcctcgcaaagatggccggagacgacgaccaaccacggcggcggtggcggcgcagggccgggattccgggaggggacgctcctcgaaccggacagagagagagaccgtacagggcgtttattcggtcggtcgccgtggggtgggggcgccacggccacatgcccgacgatgggcgatggccacgctgcgttgatagctacgtcacggagctcgccacgacggcatcccatgatgattcacgaccgccatgcacatatgctttgccccagcgtatggcgacgaagacgcgattgcgatgatggtcctggtcctggttatggttatggttatggttatggttactagtactcacgttagataggccaagagcggcgccatgattatgcatgtgtcgatcgatcaatcaggaggtgtgtagtacatgtgtacttcttggatgcaaatccactgctgtactgtacctgcagtacgtttcacctgacgtgtgggtcccacctattccgggcccacatgtcagtggcacttactgcacatgtattacaggagaggatcgtaactcgtacttcttcggttccagattaaagaaaatataatatctagatctataatagtaatgtttatttgttttgggacaaagaaaatacatggtaccatctccattctaaaataattgtatttctatcatttaaattttatcttaagaaaatatatttcttatatcatacaatataaaggattttgattggatatgacatattctaatactacgaatctgaagtacagatttgtagtactaagatatattctatctaactaaaatctcttatattttagtatgaattgagtatttctactaagcaacaaattagtatttaggtaaagatataatccctatatttctacgcacatcacctttctttaattaagtttacatataaaatatgtgcatgtctagtggtcattaaatagggttattactattatttttacggctgtttctaatcctctagtatcttagaaattaattattctgaaatgggggtggtactagtatgtacagtatgtatcatgttcgccacatccgtatactctactctattattccgccgatcaggaggcaggacgtatagtactccacgagagtatcgactggtatagataaaattattactccctccgtctcaaaatataaattttttagactttgacgcagtttttgagatgctaatttgatcaacaataactataaaagtaaaatattttagataaaaagagttacatattatgataaattgtataatgataatctagtaatgtcaattttacatgattgcgcttttttattttcttgctattgatagtcaaagttaaaaatgtttgatttgatactatgttaaaaatacttatattttaagatggagagagtaatagtgtatgtatatgtgatacaagtacaacggcatgatctaccccagtctgagggcctgtttggtacagttccaactcctaaatttaacttcaggagttaagtctggagtagagttgtggagctgtctctaattaattttgtgagagagctccatccagctctactttcagttttggtggagctgaaattgtttgtcagctctagaagggatggagctgtgaggcccagagagtcccagagacccagatctactccggtaaccaaactagataatgcgtgtcgttacgagaagtaattaaccgggaaacaaatcatgggttgttatgtggactacagcctcgacgacgcagctttgctagcgccaccggcgccggcggcgagcggccgggggacagtggccacgccgatccaggccactgtccccaaatccacggccaccgcaccggccagctcaatttttttcctttctcctttcccttttctttctccttctctttttcgtcgccatggtccctgcctctggctctgcaggcagtagaagtgagctcctgctgcacaactagggaagtgatgaaactgcaacgctaatcacggttgaccggcctcgaaatccgtgcctgtcgactgtattaactctcgctatcttcgtcaggagcctcaacctgcagcatctggacatctggatctcagttaaatttacgaacgggtcctttctcaagtccagttccctactgagagcactctataataatagagttaacttcctaatattaatcaatcttaaaaccaacacatataatagattagctataaggttggatataattttcttctcctctctctatctctcacttatatattaattgtatttgtcttgaagcttatgttaagctagctcttgcatgagagccaacacccttaactttttgttacatctctcctccacataagtttataataggcttatagctaactattttacttgctctgagcttagctatagataggagtagcacgcagtagctactggagtactcctccgtaaaaaaataagacaaactctatatttccgtgtccaacgtttaattgtccgtcttatttgaaaaaattaaaaagataagtcacgcataaagtattaatcatgttttatcctctaacaacaataaaaatactaattataaaaaaatgtcatataaaacggacagtcaaatattggatacgtagactcaggttttttttttttaaggagtactcaagtttagtgggaggatttaagcaggaggcgccatcatgagctgcggtgatgattgggtaggtggctggctaattagggcttaattaatcgggccggggctcacacctcgcctcacatggggaggtggtcttatccgtataggagtactagtgtgcaacgcgcctacgaggacgccacggtatacccgcgcgatttgcatctcatgtgatttcgatttttcttcggttgggtcattggcgagtaagagaaactagaccgaaggttcaggtccttttgaattacattaatggaaaaacaaagcaataggtaaaccataaacttctgatagaaatataagtgtaaaataaaagattagaaaataaaaaaaatataggaattaccgtttgattggagcatagaaaaaacgtaggaatcatatgaaagatagattcaaagggattttccaataggttgatctcttgcaacttttctttaaaatttctatacaattacccataccatagaaatttgaaagtataagatatgattcaatccttcgttttaaaggcttctatatgaattgaatcatccaaattttctacacttttcctacaaattaggccctaagccagaatttgaaatattgtaatttattttatagtattggttttttaatagttaacaacatgtatgtaaaaattttactcatagattgttattttaattactaataaacaatataaataagcacatgccgatggacacgtttatttatacatcctcaactcataagccattacagggtttcactcatgtatcttttcactttggtaaattttgctacaagacatcacgacttcgtgtttttagctccaggacaccgcacaaagttactttttgggaaaaacactcttaaaatatggttatttgctagcggacaccacgccattaaaataataatttccggttgaagaggagagagaaatcgcgtgaaatgtcaaaagtatccttgggcccacatgtcagctctcttatctctgtctacgaggcgaggcggggcgcggtgccaccaacagccggagcggcgtctacgaggcaaggcgaggcgaggcagggtaacaagtttgcgtttcactttttatattctgggagtaacaagttacaaatagacttcatgctatatactccatccgtccctaaatatttgacgccgttgacttttttaaacatgtttgatcgtttatcttattcgaaaacttttgtgaaatatgtaaaactatatgtatatttaacaatgaatcaaatgattggaaaagaattaataattacttaatttttttgaataagacgaattgtcaaacatgtttaaaaaagtcaacggcatcaaatatttagggacggatggagtatatctctactattataaaaatttttgccggtactttttgtacgtcatccgtgtatgagtcggttttgaagttcgttcgctttttttaaatacatgagaagttgtataagaaatctctttaaaaaaaacttacatgctaacttaagatgatccgacttctaattgcagctcatgatttcctaaaagaatactatatatatatatatatatatatatatatatatatatatatatatatatatatatatatatatatgggctgcaggaatt

SEQ ID NO: 67883 - DNA, 727 bp, Oryza sativa
  unsure (1)..(727): unsure at all n locations
ccgcgcccngtggagtactcgnnnnnnnnnnnnnnnnnnnnnnnnnnnnnnnnnnnnnnnnnnnnnnnnnnnnnnnnnnnnnnnnnactattcacgatatcggctacgtgacaatggaattaggggagattggcccattagccccaactccatcacgtttttcgtgaaaaatctccattagccctaactgcacgtgggacctacctgtcacttccatctatacctccctcccttctcttctctttcccctctcctctctctccaccaccgtcgcaaccgccgtcatcgaccacctccgtggtgggaggcctcgggagccgccgccgccaccatcctcgacccatccgacgtgggagggctcgggagacaacaccgtcctgaacgctattcacgacaggaggttcgggagccgccatcctcaacgccatctgcaagagagggctcgggagccaccgctatcgctgtcctcgaccccatccgtgacgggagggctctggagccgccgccgccactgtcgtcgctgtcctcgacgccatttgcgacgggagggctcgggggacgccgccagcatcgccaccttcgtcctcgacgccatccgcgagagagggctcgggaaccgncgncgccttccttgacaccatncgcgcgggagggttcgggagccaccgccggcgagccatccgacgcgggagggctcgggagccaacaccgtacctgacgctattcc

SEQ ID NO: 67884 - DNA, 816 bp, Oryza sativa
ttcgcttaaattttcttcacatatacgactgtaaagtttgttgatccacggcattttctatgtttacacattacgccgtgtcctacaccatggtacggaactacggtgtgaactactgttgctttctccggtccgtctctcttgcctgccactggagtctacacaactagccatggagtagcattgatgccatgaaaggctagctgaaagcaacacgatgcacttgctaagatacgtcgtcttcctcacggttcggacgtctgatggtcgatctccgacccgcggacatcatgctcatgctttctgaactgcttgcgcatccgtatcaaacagcttcttttcatcacaacgaagatatgtctcatcatccgggttaagcaaccgatcgatcgccttacaacgtactacgtgcccaaacatgaatgagttagatatattgtttcatctcaattttcgcaagattcggtcaataggaacaccttaattacaccggctatttttacatttcaccactaatcatgcatctctattcagaatttcagagcatggaagtaaaaagtactgaactaagtagagaaactaattaattaagaagcatcatatccatatcactatatcgccactgatcattcaaaacaaaggtattgtattgtactaggtagtgtttaattaagaactccactagagtagtaagaagcatgcatttggattgagctaagctactgaaacggtgaccctaacgcatacatacatggtgatctaggcccttctgggcaccagacgagcgcgcagcggcttcgccatgacggttgtgaa

SEQ ID NO: 67885 - DNA, 3109 bp, Oryza sativa
aaccaaccaattggtaatactcagtgtgattgatatattgaatctaactaagacaacaaagcaatctaagaaagaatcgatagatcacataggcaacacaagtaaaagcttaactagtatatcgcacttaaccaagaaagtactaattccgccaatacaagcgaagttgatgatacttactttctcgctagagatcaaaactaatgcagcccaaacttgaaaacaaaaactcatcgaaactagaaagttgtatattgaaccgttgttaaattaaaaggaccttaggtgtacatatttatacccataggttagatcaagtccaattctactacagttagatcagcttaggactctatcccaaataaggaaactacatgatacaattccgactcagacatgactctgatcggcaaactagctaagtccgaatccaacacgagtccatcagctcataactctgtccatagaaaatagaaaccaaaataaacgttccttataacggaacgagataaatttaccaaccaaatctacgaaaatcatggtgttaattctctattttgattcagtattggctaacgaaaatggccaaatttcaccgttaacaccactgttggctggccgcacctacctctggcttcgacaacatcgacgcgttgaaagttactttcctcagcttcaggggcacgtgtgtgtaacccttttgtatcctcggcctttagctgggacgagatcggatctaagcaacacaattaaatatctcgtgtactggtctactaggcatcgggtgctcctgcttgaagatgctacgacattattgtggtgccgcctttggtgccttgtctacatggtaggaatggacaccaacaatgagaaagaactaaggaaggatggcaaggaagcattgatggccactgcgtacaaaggtttgatatggggagtgggtatcaaacgagtaggtcaagaggaagggcagaaggtcgcccaatattcaacataaggtaaaagatcatagtttaaagtgaaaatattatgtatgacttggttcacgataagattttagttatagtccaaagtacaatttactcaaataacattgactggcattcttggtgtttcgtggtcaggagtacgaaacaacgtgataacattggcaatgaggtattggatgtcaatgccaagatctttctgtgttgaggtatatgtccattttgtttttgttagagtttgtttttatcgagatctatttcgaaaacaactttcttaagaaagaaaagagcagtgtcccctagaaatttgagtgatgtggtcaggtcagagcgcgcaaagcccaaatgaaagcccacaacctggatctggaatgtactccagtattgttttgttgggtcggcggcggcgggtgagagtggagaatgatgatggctctccgccgcgccgtcggaattggctccgccgccgccctccgctctgccgcctacctccgccgcgcctccccctcgccggcgcggccccatcccctcgtccctccaccgcctgccgcccgaaccttcgccgccccgccccaggtatcgtatcaatggatccccttcaccctcgaatcttaactagtctagtctagtgtagtgtactactatactccctaactactaagtatcttgttgttgtattacaaggtgatgaagaggagcaccaaggacgacgacgacgatggccctcggatcaacaacgacatcacctctccctttgttcgactcgtcactgaccaaggtacggtaccccctctcccgtctacccttgtcctcaccgcatgctctctcactttttgctcatttttgcaggccatagtgttgtccccaggcacgaagctcttcagcttgcggccaggatggacttggacttggtcgaggtacttactgccctctatctgctttcttcttgtaaccaaaccaacctaaacatactagtatttcaattgccatcaccatgtcaaatccatttctttgtttatctatctgtgactctttcatcattcctttttacacgatttaagatgttcatggatgatactgacagtggatataaacaaccaaaccgattcacttgtatttccctctacaacatatctgaccatttgccacatttcttgagatttgcccaatgttcattaccgtttctcttttattcaggtccgcagaaaatcagaccctcctgtctgtaaaatcatggattttcacaaagagaagtataagaaagacgttaaggagaaagaacgcctaaaaactaaggtatacttacttcctggctcagttttcttaactatccattgatcactcattcgaccaaggcgatcaacgtacaaggtttgccttcttgtgagaaggtgatggtggtttaaaagacctgtgttatgttatgtagctgtatggatcaaatgcccaacatactgctcaatattgatgctcctggttaatttaatcatcctaccattgggaaagactgttaaccatatcgtccctgcttgtgtttggatctgacaggctataacatatatctccttgtgttgttctggttttgtgcagtctgctattgtcttacgcggtggggagaacaaagaagtgcggtttaagggtaaaacagtaagtggttttttcttgctttagtttgtttattgcagcctatcatcttggctgcaatagattgctgatctggtaactggtatgatatggtcgtatggagtatctagttggcctatcatacttggttttgtccaaggcatttttttttcagtttgtttggatccatatgaacggtgcctagtttgtttggacttctctagtctttctgtttaaattattgaacctttctatggaagtatcaaagagtccaaattatttcaaagtttcttttgcagttacgtttgagaaattgttggtatgaaggcctaacttggaaggttgctgatgaacataaattgttacatgtaggaactaaaagacttgaaggtgaaagcagatggaatcaccagattaatggagcgaggttacagggtgaaggtcagcttacattccatttccctttcttgcttgtaccactgtagaaaaggtcactttgt

SEQ ID NO: 67886 - DNA, 1509 bp, Oryza sativa
agaaaaatcaggcttcctgacactccccaacatgcaagattgtatcaagctagtttgtttctcttttatttctcctaactttaaatattttttttccaaactacttatccgatctacgatacggtaccattgtattgattgtaattaaatctttatagcaagatatcacgtgattatattctcatacctgataacgatatgtttcaagatgtgtcttctgtatgtttcacaaaattcacataaactctatctcctctctctccacttcattcatgcatgcatttaactatcttcaaaatgatttttcttctaaactacttatccgatctacgatccgatcacaccattgtatttgttgcaattaaatattacaacaagacattacatgactatattctgatgaaaaacatacgtttcaatccgttaacacttgatgcctcatatgcgataacgacatgtttcagtgtgtattttcattgtgtttcgcaaaatttttaaaatgtttcgatgctttaaaaatacttatatctgcagagaaaatgctaacctttagaaatttttatattcgtagacggagagaacatgaaattcctatcttcaaaggatctctttggatttccatcaggctccaggagcacagctacacatcgatacgaccgaggtaaactaaattccgtcagtccgtctccccccaccaaacgccggtcaaccccacgaacgcaaatcaacgacatactgccgaagccagccaagcgcccaagacaatctcgattgattcgtcaaaaaaaatcacaatgtaccacaacacctgggtgtgacacacacctccaggtggagccaagcagttggccaggcaataatgttttatatgaaatacttactactcccgtacgtagaacaaaatggactgtactaccgttcaggagtctgcatcgcatgcatgtcacgtgttgtagtacttgtactccatccgtccccaaaaaaaaaggcaaaccctatgtttccgtgtccaattttgattgtccatcttatatgaattttttttataattcgtattttcattgttgttagatgataaaacatgattaatattttatacgtgacttgtcttttttaatttttttcatatttttttcaaataagacagacggtcaaacgttgggcacggaaattagggtctttttttgggatggcacactacagttgcacccgtagaacaaaatggactgttcccagatggaagcttcccggccttgaccattgttccatcgttcaaaaacccatgacatcattacgccgacgtatgcaagatcaaccaaccgggacaaggattttctacttttccacacctagtgtcatagcatagcaccatgtgactcaataattatataaaaaataaaaagtatagtaacatcaattataatgatataagtctatacacaaacgtgcaagactatattttatatagagtaaagtgtacggatggtccttaaatttgtagtggtgtgt

SEQ ID NO: 67887 - DNA, 886 bp, Oryza sativa
ccgacttatcacttgatggtaccttgtccatccgatacgcgtatccagacttatacaacactggtttgtacagctctgccaatatttagtgacaattcatgcagtttctgttagcatcatcttatgctttgctttgtctttttttactatcatttactccctccttcccaaattgatcatcatctaatggacttcaaaatttctcaaattgatcatcatataaccgcatggacatggatttcatcataatacaattaatgcagcatgagagaatgtgtgcatgctaaggtgtaattggcatggtgttttgatcgatgcatgcattgtgggagaatgtgtgcatggttgtcttgattgatgtgatttaaattatccttggtcttggtgcataaacatatactccctccatcccataatataacgcatggtaaaagttacacggtctccaaaactaatctttaacttataatttctcatatgctataaggtttgtagcaacaaaattataatcatatgaaagtaaatttaaatgtcaatctaatgatataatttttaacaaataaaattcatttcatattatattaaatgttggtcaaatgttttaaaggttgaatcttgaaatacgtgcacaccttatattatgggatggagggagtatgatgatcattttgggaaggagggagtatataattactttttgtcatcagaggcaacagctgtcggttttctagtcaaatattgctttgtaattttcagtagacgattatctgagaaaaatatgccaaatgatgggaaatgatgagggagctttgctgaagagtagcgattcttaagtacattgttctccatctaatatgtcacactattgcattttgacactagagag

SEQ ID NO: 67888 - DNA, 9387 bp, Oryza sativa
  unsure (1)..(9387): unsure at all n locations
gcaactcctccgtagagaccagcacatcaatgaaatggggagttgaaccccctaagagaaaccgtgtaggctgtagtccaaaacagggctaagcctccactaaggccctcgcagctcacagcaaaggagccggagaaaccaagtgaccacatcaaatttcttgcctgtttgtccctcatcttcgtttcagacaagaagacaagggagggtctcaaagacttcactaaccagcgaagttcacccactgtcgcagccgaccccaagccacgacagttccgaccccaagtcacaagcttgtttggttccatgggcagggacttatatttttttagagagggtccctctctcccaaacatctctttaggtcttagcaccgtatacaatacgactagggtcttgtttggtttcatgggctaatgtaagaatttaaacatgtgggctaattttgatctaaaatgaattagcccccctcaaaacattagcccctccaagagatgctaatggagctaattttgtgtgaggactataaaaaccagctctctctctccttctctcccctactctttctactctgtctctctccacctattagccttgaattaagtcatggatccaaacatgccaccctagactaatatttagccgaccaatttatgactaaacattggctcttaaaattagccctgggctaatctttccaacaggcatagtacaatactcgtacgtatcatatgcactatcgtgcgtacgagtactcttggcgtgtcacggtcaacatagatctcactgttggcgttattgtgacaatgcacaacttttttgacgtaggggcactgtactactagtagaaatactagcgttgcccaagagattgttcacgtgccacacacatgcggcgcacccgtcgatcgaatcgaggggagtgcacggcttttgagttgtgaccacgcgtttggtcgggcctgggctgaaatcgtgaaagtttgtcgggccggatcgcgggatcgaggcggatggaggcgcgcgcggccttcgaaacgggacgaattctcgccgaccgcgtttgggccgcctgcccggatttgcagaccgttttgctcgtctgggctttcactatgttttgggccgcaaatttctggcctaatgttttcctcgtccagactccagcgacgaacgaacagtggagttgcgaacttgcgatcaagctacagcagcagcttgtctgattttattcgataaccaaaacaaaggggtttatgcatgagtagtacatacgaacgtagcggaattcacgatgccagcatcaccatggctaagaagcaaaaaaaaaaaaagtatgagcgcttcgactgttcgacacgattaagatagtgtccagcgacgtacgtgcatgcatccgtacgtaacggcatatacgtagcattattattctaggtcgtcctcctgggcacgaggcgcgcgcggagcggcttggccatgacggtggtgaactcccgcttctcggcgaactccacctcgtcgccggccacctccttccactcgaactccctcaccatgttggccacgaagtactccacgtggtgcatggcgaagctgagccccgcgcaaatcctccgcccgacgccgaacggcatcatccggatctccctgctgcctgtgacgtcgaccccctcgccgtcgccgccggcgaggaaccgctccggcatgaactccattggcttctcccattctttctcgtcccttcccatctccgccaccatgaagttcaccgtggtgcccttggggatgaggtacccgccgatctccatgtcctccgccgccctgtgagggagcaccatgtgccccggtgggtgcttccggaggccctcgagcaccaccgccttcaggtacggcatgtcgtggatgtcctcctcggagacctcgcgctggccgccgccgccgccgccgccggtcttggccatgatctcgtcgtggagctttgactggatggatgggttcttgaccagctcggccatgatccactgcagcgcggtggacgtcgtgtcggtgccggcgttgaggaactcggagcagaggttgaccatctcgtcgtcggtgagcgggcggttgccgtcgtcggggagcttgatgtcgaggagggtgtcgacgtacgagtgctcgaacgtggtctccttcttcggctccgccgttggcgccgccctgccgttttcttgtactcccggcgcgcgttgatcagcggcacgaacagctccgtctgccgccggcggagggcgtgcccctttttgaggcgcccgcggaagaggtgcttggtgaccgccgggaagaaggcgaagacgggcatcttgctcgacaggtagaggagcgcgtcccgctgcgcgacggcgatcgcgcgcaccgcgtcctcgtcgagccgctcgccgaagcacatgagcaccaggaggcagaacatggcgtactggaacgtctccacgacggcgtgtggcgccgccgcgtcgccgttctcgtcccgcagcttctcgacgagcacgcgccgcacccacgcgcgcgccggcgcgaacagccgcacgcgcgacgggtgcagcgtctcggcgacgaggttgcgccgcaggaggcgccacacgggcccgtagctggcccgcgagatgaggttgtcgctctcgccgagcagcctcgtcgacgccatggcggggcgatcggccagggacgcccccttctcgacgagcgccgcgtgcgcgaggcggcggtcggcgacgaagacgagcagccgggacgcgacgcggagggagacgacggggccgtgccgcgcgatcaggcgccggaggaggggctcggcgtcggccagcgaattggtcagccacaccgtgctcccgagcaacggcacggccggaggacccggcgggaggcggccgcgcttcccgccgccgcggccgccgcggcgggagaggatgagccggaggaaggggatgaggacgaggattgcggcgacggcgacgtgccacgtgtccatcttcgagtgagcgcgagcaccgcgtaccgtgtggctacttcagtgggactcattttatatggttaacacgtgtcgtaattagcacgttattaggaggtttttaactgcttgtgtttaagtaaattcggttgtatttatcggtttattatgctttatgccaccgtcgcgatctcgattcgacttgcggacgaagtgaacggaagggtccacctccgctgacgtcagggatgatgatgaacaggaataaatacgaagaaaaaaaattctagaatattttcttatgcgacaccttgtttccacatgactcgtatgatccaaggtctaacgacatgttcaagaaaagagcagataaaagaaaaccaattctgaatacgatttctctctcgagaaaattgcatccaatccaacaagtcatagtttgttcagacttcaggactctaacacataataattttgaattaagatttgaaaattacatccgaacaacccgtagtttgttcagactcttaaactcataaaattatccaaactcaatcgtattcagcgttgacttgatgcgtctccctataaatgtaaagccgttttgtctcacccgacgtacaacaacgacaccaatcgacgacgacgcagatggataacctggtcatcctcgccggcgtcctcctcctcccgctcctcttcctgctccgcaatgcggcgtcgtcgaggcggcgccgcctcccgcccggcccgccggcggtgccgctgttcggcaacctgctctggctgcggcactcggccgccgacgtcgagcccctcctgctgacgctgttcaagaagtacggccccgtcgtgacgctccggatcgggtcgaggctgtccatcttcgtggcggatcggcacctggcgcacgcggcgctcatcgccgccggcgcgaagctggccgaccggccgcaggccgccaccagcacgctcctcggcgtcagcgacaacatcatcacccgcgccaactacggcgccatgtggcggctgctccgccgcaacctcgtgtcgcagacgctgcagcagtcgcgcgtcgaccagttcgcgccggcgcgcgtctgggtgcgccgcgtgctgatggagaagctgcggggctccggcgaggaggcgcccaacgtcatggaggcgttccagtacaccatgttctgcctcctcgtgctcatgtgcttcggcgagcgcctcgacgagcccgccgtgcgcgacgtcgaggaggccgagcgcgcgtggctgctctacatctcgaggaggatgagcgtcttcttcttcttcccgtggatcaccaagcacctcttccgcggccgcctcgaggccgcgcacgcgctgcgccggcgccagaaggagctcttcgtgccgctgatcgaggctcgccgggagtacaagaggctcgccagccagggcctcccgccggcgagggagacgacgttccagcactcgtacgtggacacgctcctcgacgtcaagattcccgaggagggcaaccgcgccctcaccgacgacgagatcgtcacgctctgctccgagttcctcaacgccggcaccgacaccacctccaccgggctacaatggatcatggccgagctggtcaagaacccggccgtgcaggagaagctctacgccgagatcaacgccacctgcggcggcgacgacgagctcctggagcggaacgtgagggacaaggacaacaagatgccgtacctcaacgccgtggtcaaggaaggcctgcgcaagcacccgccgggccacttcgtgctgccgcacaaggcggcggaggacatggacgtcggcgggtacctcatccccaagggcgccacggtgaacttcatggtggccgagatcgggagggacgagagagaatgggagaacccaatgcagttcatgccggagaggttcttggacggcggccatggcgccggcgtcgacatgcacgggaccaagggcatcaagatgatgccgttcggcgtcgggcggaggatctgcgccgggctcaacatcgccatgctccacctcgagtacttcgtgggatccatggtgatggagttcgagtggaaggaggtggaggggcacgaggtggagttcgccgagaagcgggagttcaccaccgtcatggcgaagccgctgcgcccgcgcctcgtgcccaggaggagttagacagtgagacagagtccagaattggtttagttttgtgttcattagttagtgttagcgtatatttactcgtgattaagttatgatccaaatgtccatagtgactagaagtatataattaggtttgaattaagtgccaaaagtgtgttttgttttagcaaattttgagcagtgcgtactcgtttttatcgtgctaatttacacgttttatatatgaactcctatcgaatcccaatcaaaataagcagagaggtttggactagagacaagacagcatgacttacgcacaagaaaggaagggtgaaaggttcatcttttatctcctatatactatcagcaattcaaaggaaagagtgtttttttatctcttaccagcaaattcatatcaccaattcgaatatccaaaacaacataggtgcctatgaatttcttttaacaacaatggaagaacaactttgagcctgtgaaaaactttaacttgtttacctcctagaaattgatgcacctaaaaaacttgtttagaaacatcttacaaaactaatgtggcacaatgtgattgaatattccttttctcatacccgctataacatatcagatcactaagagagtaatagatttacactagttggagagtgttagagtatatggtagttaaagtcatattaggataggattggtttgtttggattccttctatatctgtaattcttccttatctcttccctatgtactcctatatatatcgcccccctgaggctcaatacaatgtgtccaatattcacagtatcccctcttcctgtactatccaacatggtatcagagcgggcgatctagtgccgctctcacgcttccgccaccgctgcccccgggagtagcgatctcccgagggcggccacatttttttttctttctctgaggtcgttgtcgccagagggatcgccctcgatctccttcggtggcccccgtcctgttcgtcgtcagatcgatctaaagccatcttcagatcgttcgtgcgtcttcgcgtcatcagcatgcagcagtagcagatcgcatccgcggatcccgtcgacggcgcggctctccacgtcgctgcgccgttggctcccggtcctgcctcctctgttgccgtcctctccgtcgacctctctcctctaccgaggctgctgatgccgggggacaggagccacgtcctcgccgatcatccatgccgtggatctggcggccactccaggccaccgtttcgtccgtcgccccctggtcttctccaacctccgcgccagccgtcgtcgacctcgccgcccttctcaaccccggcgcacagggggagggagtgctcatcactgtcgcttccacacggcaattttctgccggcccctgcagctctgctgctggtctccaccacacaaacctgttgacaggttgttcttctccactgtctctcggtgtctctctctgctatgatcctgtgcgtggcagccatgtgaggagagagagactagatggatggtgtgaagatatacagcctattgccttggttgacttggtggtgacttgcgtcagattcaaagggttgtgatgtgaacggctggtatggactgctgctattgtgttgctgcttgtattttttcccctttcccaatcagtgattgggtttgcgtcgcccaccgcctcgttgacatctgcgcgtctccgacatcggcatcgattctgcttcaacttcatcgttctgcctcgcgcatcttcggcttgatcacccattccagcgcccagctacaacgacttgtacaaccgatcatcatcgagcacgcgtctacgccatcaagcttcgggttgccgctgcgtcgcccccctcgggccacagtgccgctgcctgtggtccacacctccactggttgttacagtgttgagacctgagaggcaccctcctcagtgtggcctcaccaccggtggacttctcgccgctgcatcgacatcgagctgcgttggtcccactacttcgccttcgtcttcgtccagcatgattcatcgccagtgtcgccgtatcttcctcgactatacttcgctcttctccggcaactgcgtgctgctccggcaattctccctctacgccgttctcgcgccgcgaccatcctagaggccttctctgctagtctcctccgacattggcgtataatttctggtggtcccctacctagcccgcacggtattggtaacaccgttgtgcgcgtttgtcccgagtcgtccccgggtctggcaaacctggtgtgacgtcttgtccttcatggttcgactatatcggctcttcgacgtcatcttcctcaacgaccgtcgcgatcgtgtccccgtcatcatctcccgcgcgtcctcgcgcacctcggttcacaacgctctcccatgcgtccacgaccactctacggcgtcctatgtgcgctccgcggctcggctacctcgacatcatcggctccccgacttcggctacatcgaccacggctactctacgcacggcttcagcgaccacggctctcccggctccttcgctttggctacatcgactatggcacaaagggctattatccgtgttgagcactcttgccggtttattctccagtccaagtgtccgcgctgctcacgcttggactgaggggggatgttagagtatatggtagttagagtcatattaggataggattggtttgtttggatttcttccatatctgtaatatttccttatctcttccccatgtactcctatatatatcggccccctgaggctcaatacaatgtgtccaatattcgcagtatcctctctttctatactatccaacagagagtacgtaatagattgaccttaggagagtgacagattaacgatttcgtatgaacaaanntaatgtntgnnnntnngnaccaaacgtccttcnnnaaggnnnnnnnnnnnnnnngnaannnagtagaagagatttgattggntttatttgttaacctgtacggaattcgaataaaaaactggtccaaatttgtcagatttggggaaaaaatttgggggaaaaaaaacccccaacccggngtctaagatttnaatcgctctgatttatatttaaacaaggaaaaagtacaccgaaggtccctcagcttgtcatcgagttacaaaatcatcctccaaccgtaaaatcagatatttcacatctcctaactaatcaaaaccggtcacaatcggtccctcggcggttttgatcccggttttattctacgtgactgctgagtcagcacaggacccacgtgggccccacatgtcagcgtggccacgtcagcctatctctctccccgtcttccccttcctcctctctctatctcactcattcttgtctctgtggctctaggcaggggagcaaggcggcagcggcggcgggagcaggggagcaaggcgtcggcggcggcagcggcggcgggagcaagggagcaaggcgtcggcggcctccggtctccccccaccctcttcactctgtccaaggcggcggcgacctccacgccccacttcctcaccgacgcgacgagcacctgcacgatcctcgttagcgggctgcccccggaccgctggtgcctgtacagcggcgtgccgatgaagaagctgacggcgacggccatgacgacggccgggatgccgaacccccacccccacccgacgtgcgtctgcacgtacaccagcaccgacgacgccaccagcgcgccgatgttgatcaaatgttctccatacagtaattattcagtaacctgtatagaaattgatgactactatgtgattacttaactaatagtacctgacagaagaagctcatattattagagtctgaatagatggaagtttggaggcattgcttgtcgctgttattcaaatgtctggttgctgataaataacaggaaaggaagcttagaactgctgtataaatgaagtcagtgtgtggacatcttcagtgtagaattttaaccagagaatcttataaggcttgttctgaaaaaggtgatggatgctgtcctcgacatgtattagaaccagttgaagaagctgctcttgctccgcttctccccctcgtcgttctcgtcgaactggtcgacgccgaacgacgacacacacgggttgatccctcccgttcccagcgcgatcaggtacagcgccaagaacaccacccccgtctgcgcttggtgcggactgcgga

SEQ ID NO: 67889 - DNA, 3331 bp, Oryza sativa
aggaggaggcagcggaggagcggcgggtgcgcttgggagcagaggctgaggaggaggaggaggcggctgctgctgcggctgcggcggcggcgcgcttgcggctgcgcgtttccatacaagcggtgacgggcgggggggagggggtggctcgcagccgtgcctaggcggcgaccggcggcgggcgcatcgatcgatcgatcggagctcgactcgatctgcggcggatcggattcgctcgccggagaggagaggatggatcgaggggggcgagggatttggggattttggggcttaagacggtgcggtggacgtggcttggctttggttccccccctcctatagccgctcttcaaccaaacggaatggaatgcttctcctaaaatcaacctcccattttatttttattttacttaattttattataacaagactacatattttttaactaaattatcacaaactgtagatataataagtttatatattggaaaacttccaattttatgcttgagttatcacaaaactacaagttttaggttatgggagggatcacaatcttaacaaaattcaaacatcttgagctagctcaaacggtgcatctcaaacggatttcttcaaaaattgtagaatatcattcaacatatatcaaaatccgttcataactaattaaaaatcaacgtccagacatggctcaaaacttgcactagccaatcaagattgcaaataatgtttcagtcccatatacaacaatatctaataaactaggtcttacatatttatatgtatcccacgtaagaagagttttatttttagcggtaaatatctatgttcatgatcttagaaagcgtttctaggtacattcaaataagtatggacattttaccatatcaagcataggtataagtatggacattttacccatagcaaagcatgggtattttgctagtattgtaacaaagataattcactgttgccatctctatctatacttatagggtcctcctagcgttgagggcaatattttttttattgaaaattgaggacaatatttagtaagacgtttaaaactttgatatcaaatacttgttattccattacaaatgtcttgaaaatataacttagcctcaatattccacagcaacaatttgtaaaatcttaccatctgtacagtattatgacaacatgtatacttgggataacttgcaaggttaacttgcaacccctaccagctcgagtctttggttattatttacgaatgttttcataacatgaaaacggttacccatccccttaaaatctttgttgacctatattattattaccattctgaagtataaaaccaaccaagggattccactgtctaacttatcttccctgggttattaaggttaggagcactataagcaaggtataccagtttataaagcgaagtaaggattaaacagatgtacaatgacgagaattgcctccctatttacatttgaactgcattgcgcatacgcaacgagtgcatatttacatagaaatgtatattcgcatgagcacaggcgcatgtacccacacgtcaaaaggtcgataaaagatgaacaagcaggtactgcaaaagacaaccgtggaagtagtagtacgtgattggtaccgcaaaatgagtgaacatcctacgaaataacatcttccgatcgaccttgtaaacaagaaagaaagaaagtagagaggcagctcaggacacctccacgaccaaaagagaagaaagaagctactactgggctcgtccacgggcacggggtgggtggtctgtcaacagtcgaataagcttgtcggatctccccattgcatctcttgacgatttcactttttcttcctgcaccaaccacgcctacactttgtcagcagctaatccaaatcaaaccaattgtgcatcaaacagacagtggttttgccgctagctataaataatgtcatgaatcagcgcttaacaagccatctgcatcagcgatcaaccagagcttagatttagccgccccattattgtgaaacacttggatgtggttccaattgttgctgaggtttcaaagagacgtacctttctggtatccacaaatatatcaggacctgtgaattctttgagcatcatagctgacacaggctgcaatctcctggtcgaggaaatgaaaggtaaacttcaattccatgacaagcatgcttttttttgcgggacacaaaaagcaagactcttaagcagtaattatgcaagaaaaaacatttctgaagtactcaccttctagtgttctttctattgcaaggcttagaagcagagagatcctctattttatctgtcagtttttcagcctgattgtccttggttggagacttcgaacgataaccataacaaaatatgactattagaaaggcgcaataaaaagaaactagcctaacagagcatgtcatttttctttttacttcttaactaacaatattccagtagaatatctccaagtgtttatagacttagcattatatttttcatcataatgcaacaagcaaagaagtgccatccgccccagactagacagtaatgatcttactattggagctttccttggggaagattttccatttagcgtacatggatacatgcctccatgatcatccactacatgtggaggttgagcacagcctacaaaaattgtgttccattgataatgtaatacaacatttcagaaggatatagacaatcatatacaacatgcccacaccaaattaagcacgaccaatgcttttgttttatgagatattacacattacataccatattccacaatggttatttctactgttggcttgcatctttctgactgaggatcctgctgaagagcaccctaaagaaaaggcacaaacatatgtcttagactttccaacaaggcaacaacgatttagcatagaaagaagaagcgccacttgcatgcaatcatatttcatcctgagaaatagattaaaagaataagaatagcagctaaccttgattatgtaaggaaatattttcagtgcacaaagggattatggacagtgttctacaacttgactaggatattattgtgttatttttggaacttgaaggagctcagtaccacagtgaaaatagaatatgcattacgctccacatccccatacttccatagctctaaagaatcaatctcttctttcttcccaagagctctcttcccagcctagcaagaaacatccccttctaaacccccaatggcagccatcaccagttcactaccctccccaaactcccataatagaaaaacacaacgaacaaatcaaaggt

SEQ ID NO: 67890 - DNA, 2579 bp, Oryza sativa
gccatgggtgctagccctagcatcggcatccccatgccgcccgtgcgagagcagagagcgagacggaggaagaaaggagagaaacagagaaagagaaagagcggaaagaaagcaggcgctgacatggacaccctgacatgtgggacccacgtgggtcccacgctaactcagccgccacgtcggataaagccagagtcaaaaccacttaaggaactcaagtgaacggttttgtaagtttagggatgtcatatacctggttttgcggttaggggatgattttgtaactctatgacaagttgagggaccttaggtgtactttttcctttaaacaaaatgaatagagagtaagcccaacagcaaaaaacatgttagcccaaaaccaacgaactgcatcttaggcccatttaaccagtcgaacatgttatctcaggcccgtttagcccacaaaattgcaatatgaatactagcagtctagcacaactagctttggctgcgttcgtttctccaataacaatagttggatgaaattttggatactgatggtacacttttcaaactactaaacggtgcgttttgtgtgaaaacaattgctctaaaatatcagattaatccattgtcaagtttataataattacacgttattaccacctcgttttacgtgaaacacttaatatttatcctcatcttcattttcaggatatccagagaggaacacacgcttgaaaaatctgtcacgtgctagttaattagcaaaaccgaataaggtacttataaaaactaaagtgtcattccttcttactaacatatatctttagggagagctcccaccttttcgcctcaaaagggaaaataaatatgtgcgcctaagttgatcctgatgcccttaaatccaaagttcaaacatgtggggtggcttcttaagaaagaaaagaaacctaaatacttggatgtaatcataaagattcccaccgaatcttcaccgatcaattgagattaattagaaatgacgatagccgtttaagcggagaaggacggcttacattattgctggttaccattcaaaacagaaagaaaacagtggcaccagattctgcggttttctacagagcttttttcttaaaaaaaactagacacaatatatacacaaactattctaacacacgcacactcacccttataaatgtacacacgcacaccttatccttatcagcatctccagaagattaggctgtcatattttaatattgacgaagccactgcgggcgtctcgttgtcgagggatacgtcttacacatgcacacattattcttatgaacatctctggaagactaggttgtcatatcttgatgtcgatgaagtcactacgggtgcctcgttgttgagggatacgtcgtgtaccattaaaaaaaacaattagccgtaaatatgagcacatgtgtcaagcctagaatttaaacccagatggactggtttcaccataagaaacttaaccaattaagttacgctcacttcacggagccctttgtcactctcctagttgacaaataagttttcaatgactggtccatacaggaatatgttcttccattatttaattttagttgctaaacatgttttcacatactataagttgttcgtccattatccatttttctaataggcaccttgttttgcatctttgaaagcattttgaatggctgataggagataaaaaaatgacccctttttttcttcgattgtgtttttgcccttctttctgtccaagactactataggataccaattcactacgtgcagctgtcatatgtttttgataaatctaggttacctattaatttagagtaatttagaaattatacactaagttttataagtatgtgatatatttttgttggttttttttaattttgggaaggtaatatgctttgataaatatgggtctcctattaatatgagagtaatataaattttcgacatgacctgcaccaaacagtaatgtaattagagattatacatggttcttttgaaagtaagtgacatatgtatatgaatttaatttattatttggtggtggtgatatgacgataaattcttggcacctattaattttgatttaatcttgtagttatggcatatgtttaagttaatcattttgtatgcagcgagaattgcaatggatcgacgataaatgtaccatgcgtcttgttcaggcctcctttgaattggaggaaaaatataggaaaaagaaaggaattgaaatcctacactatttatgcctttgattcataggaatgagaaaaggaaaaacgtaggaaactttcgtattcctacgattctagaggaaaaacatagaaaatttaagacaaaattggttatatagcatcgaaagttcacctttttttagctccaacagataacggttcactttaatagcatctaaagttcacccctttccatttttaacactttcgtcaattctcgatcgttttctatccgccttgatcgttattgactcagccactcacacgatatgacctttttacccctcattgccatgcattatacatgtacttgtgagg

SEQ ID NO: 67891 - DNA, 921 bp, Oryza sativa
tgacgtaaaacacgaggactgggagatctgcttagctcctgtgcaggtccaaaggttggtgatatgagggcgtgccagttagtttgatcctgcaactgacaagatatgcaaatagtagatcaaaacagccgatcggctgacaagccgatggagtagttctagccgatagccgataatagccgatgccaataccagccgatagcgatagggtttaagcaatcggctatatgtccaatgtagatgatgatataaaggcaatcggctgatgatggtgtaataaaataacaatataatccagtataaattaatcggtaaataatgatatgataaataagcatcgatccgaaagttaaagcacacatcggctggaggtacgatgtcatgaaatccacaaagattagattaaacagtgaaacctttgttgtcatctgctaaatccaacttatatatatatatatatatatatatatatatatatatgcaatccttatgagccgatgcaacgtccagataactcaccggctgaaaccccgatgaaacccttattggcattcaagaagcaggctagagattatggttctaagcacgacttagtagatcaaacttaactgatacagcactaagtatgaaaaagaaacataatatctagacaatcaagccgttgactgagttttcagggtggtagatgtataagttaatctaatctagcatgacgatttagccgataccggcataaaccctaaagcgagaagcagccgatagagctaaattgagatgctaagactagattaacatagacatatgataaatagccaggcaaatatattatccaaaccagagtaatccaagaggtcgaatgtatgatgcagccttgaacgacgccgacgtagacgatacaattgcctggaccggtggaacatt

SEQ ID NO: 67892 - DNA, 5432 bp, Oryza sativa
  unsure (1)..(5432): unsure at all n locations
aaaaacaactgtaccatatattaaaaacagagatatcagaaatttgcacaaacaaatcacacttcaatgttccctattgatttactgattcatcaaaccaaatgccatttgatatcagcattcacctcatgacacgtaaaaaacctgacactgatactccaaattactccctccgtttcaagatgtttgacaccgttgactttttaatacgtgtttggccattcatcttatttaaaaaatttaagtaattatttattcttttcatattatttgattcattgttaaatatactttcatgtacacatataattttacatatttcacaaacttttttaaataagacgaacggtcaaacaagtaagtcaacggtgtcaaatattttgaaacggagggagcaaatgagcagtgagactctgattagtgcctgactcctcctgggcacaaggcgcggacgcagcggcttcgccatggcggtggtgaactcgagcttctcggcgaactccacctcgtcgccggccacctccttccactcgaactccatcaccatggatcccacgaagtactcgaggtgcatcacgccgacgttgagcccggcgcagatcctccgcccggcgccgaacggcatcatccggatctccctgctgcccgtcacgtcgaccccgtcgccgtcgccgccggcgaggaagcgctccgggatgaactccattggcttctcccattctctctcgtctcttccgatctctgccaccatgaagttcaccgtggcgcccttggggatgaggtacccgccgacgtctatgtcctccgccgccttgtgcggcagcagggtgtggctcggtgggtgcttgcgcaggccttccatgaccacggggttgaggtacggcatcttgttgtccttgtccctcacgctccgctccaggagctcgccgtcgtcgccgcaggtggcattgatctcggcgtggagcttctcctgcacggccgggttcttgactagctcgcccatgatccattgtagcccggtggaggtggtgtctgtgccggcgtggaggaactcggagcagagcgtgacgatctcgccgtcggtgagcgagcggttgccctcctcggggatcttgacgtcgaggagcgtgtcgacgtacgagtgctggaacgtcgtctccctcgccggcgggaggccctggctggcgagcttcttgtactcccggcgagcctcgatcagcggcacgaagagctccttctgccgccgcagaagggcgtgcccggcctcgaggcggccgcggaagaggtgcttggtgatccacgggaggaagaagaagacgctcgtcttcttcgagatgtagagcagccacgcgcgctcggcgtcctcgatgtcgcgcacggcgtgctcgtggagccgctcgccgaagcacatgagcaggaggaggcagaacacggcgtgctggaacgcctccgttacgttgggcggcgcgtcgccgccgccgccgctgacgccggacgtcgtctcacgcagcttctccatgaggacgcggcgcgcccagacgcgcgccggcgtgaactggtcgacgcgcgactgctgcagcgtctgcgacacgaggttgcggcggagcagccgccacatggcgccgtagttggagcgcgtgatgattctcgctgacgccgaggagcatgctggtggccgtccgcggccggtcggccagcgtggcgccggcgccgacgagcgccgcgtgcgccaggtgccgatccgccacgaagatgagaggcgccacccgatccggagcgtcacgacggggccgtacttgtcgaacagcttcagcagcagaggctccaattcggccgccgagtgccgcaccacagcaggttgccgaacagcggcacggccggcgggccaggcgggaggcggcggcgccgcctcgaggtgacatcgcgcaggaagacgaggagcgggaggagaaggacgccggtgaggatggccaaattatccatcagcgttggcagctgttttcgcttgcgttggttgtcggacgaggctaaactgttgtgtacccatacattttataggtcttcggctcaagtcagtagcagtagactcagtactatgggatgtaatatgttaatcttattcttttaataaaactagctgggtggcccgcgcaattgcgcggctagcatccaaataaaatcatatattttttaatatgattttacttaaaatttattaaatagctatctcattgtcttaagactttgaaagaccaaaccttatcatcctcgtgtttctaattatatagtttttaaaagtcacatcagttgctaccccttatgtcatcttcttctttatttgtttgctcgatctaccactatttctatttattcttcttggaacctttaaaaattgaattttatagtttttagagtttattgtcacattgggtttcgtttttataatttgtagatgtctcgtcaaacgttgtcattatactcctctaccgcccgtccactgtttcttctttttattgtcattgaaattttaaaaatcaaagataattatcatttgggtttatttttactttctagaagtcccgccaaaccgtcagcggctttgccattgtactcctctacagctcacccgcagcctccgttctttattgtcattgagattttaaaatagaacatgattatcattgtttcttttttactttttggaagttccgaaccttaaaaaattagacttgtagttttattatttttataatttttagaagtcccatcaaacgatgccactatgcccctttacagcccgtccgccgcctactctttattgtcgttgtgattctaaaaatcaaacataactatcgttggaattcattttttattttctagaagtcccgtcaatcgtcggcggctcagcaactatactcttatacaccccgcccgctgcttctcctttttattgtcattaacattttaaaaatcgaatatgattatcaatggggtttattttttatactttctagaagtcccggcaaccgccttacttgtttgcttcacggcctgtctgatgtccctccttttaatcgtcattaggattatatttggtgttttattaataatttttatatgtcgtatcaaccgccaccactctactcctttctaggctgttacttaatttatctcgtcatgtgttgtagatggtcttttctttcaatagtctttatttttatcacaaattttagttatttataaattgtatttctaattgaaatcttatttttctttttctaatttcagaatttattttttttaaaaaaaatagttaatacccgtattgggttcctttaatggttttatttttattttcaatttcagttgtttgaaaattggtattcctacttaaattctcttttaatttttctaattttggatattattttatttttttaattcgaaattttaattattcttggattggggtcttatatggaatcctctttcaatattgcttattttttaatccgaattttaactaattttcaaatggattcctactttaactcttcttttattttcttttgctaactttggatttattttattttaattcgaattttaattaatctcatattgggttcttatatggactcttctctttaatattccttatttttaattccgaatttcaggtatttttaaattatattcctacgtggactctcctttccttttctaattttggattttattttatttttattccaattttaattaatttcgtattgggttcttatatggactcttctctttaatattacttatttttaattccgaatttcagctctttttagagtgattcctacttggactctccctttctttttttttctttttctccgattaatgtgggaatttctagcctccacagcgaacgtggtgtcttcttttcgagctgtcttaataatataatagattttagaacatgttctgtacatacggttttgctaactagcatatgatgcatgttttaagcagccttcctgtttagtttttctttttgactgtcagaacttaggtttacattcgtgctgtggctggaattttatttagaattgatctcaacaccttgggctcgttcttttccacaactaaagactgcaacttagttctttttcattagcatgcttctcgaaccgttaaacgatgtgtattgtaaaaatattaccgtttgaggctaatccatttttctctgtgtcaggttgtgttagctatccaagcgaattggtgtttcaagcgcatagcaatgggagatagaagattgagcttatatggaatagcaattgtgttcgcacatctgaaaaaggggggatgtagcctagtggttgcagtgacctgagtaacaccctaaggttctgagttaaaatcttcatatgagcgaatttcaaattgagttatttgcagtgctaagttctcaatttaaattgttgcatatatccatttggatgtagatgctggataaaaaaaactattctctaacaaaagttgtgttcgccgaatccactttctgctgaacactcatggatgtaaatgtgttatcacacgtgggattaagaccttgtccagcaccacatggcgggcagccctaatgggctatcgatcgcccgccaatggggggtngcgannnaatnnnnntacccccctccccctccctcctncacccgancccctatttaccaaactcattcccctcacgtttatacacctcaagtttacacatttaaagtttagagacccaaagtttataagtcaaaagtttatatatccgattcaaatttgaatttgaattcaaatatctttttatatatagtatttatatacatctaaagtttatacacctaaagttagtttatagacctaaagtttatacacctcaagtttacacatctaaagtttagatacatgtttcaaatttatatttgaattatatccgattcaaatttacctgtttcaaatttgaatttgaattatatcgattcaaatttaaatttgaattcaaatattttctatatatggtatttctatgcatctaaagtttatacacctaaagtttatagacccaaagtttataagtcaaaagtttacatacccgattcaaatttggatttgaattatatctgattcaaatttgaatttgaattcaaatattttctatatattgtatttctatacatataaagtttatacacctaaattttatagacccaaagtttataagtcaaaaagtttacatacccaattcaaatttgaatttgaatttaaattttttatatatagtatttctatacataaatttttctaactctttattttttttaaatttttgtgtggtgtactgtagtaggggaggagtgtatctagtagtatagggagggagcgggcgg

SEQ ID NO: 67893 - DNA, 634 bp, Oryza sativa
  unsure (1)..(634): unsure at all n locations
aggggttgaacnntcgnttgnnanganncnncanantngaggaattcggaaccccccaggcgccatcgacggcggccaagatttgctacccctcgccgtcgcggttgtccacgtgctccgtccagctgctgcagcgacgacgttcttcctctccatgacgctcatctacacccatgtccgtgctgttggccgcggtgaagggggagccggtgccgccgccaccgccgccgggaacgtgccgatcgcgacgaccaccgtggagctcctcgccaagctggtcctcgccgctgcgcttgtcacggtcgttcttaccctcacttccaccgtccttgctgcctcctacgccgactgatcgacgagctgagtttcttcctactgctggtaagcgatttgagccatttttcttgagtcatctgtgctggttatgggatcgacaatgttcagacttgtccgagagttagtgttcatcctgtgctgtaacaagatcggattatatgtgctgcaagtgtgcttttctggtcattttgtatgtgaccagctgcaactcttcgatacttattaatggcttgtggatttgatggactcgtgttgtggtatagcgcacactatgttgcagtagcattatatcgtgtct

SEQ ID NO: 67894 - DNA, 10826 bp, Oryza sativa
cgctcgagctcgacaggctgtacggacggacggtggtggtggacgtggacgcgtggctgctgctgccggccgtggacgcgttcaccttcttcatggtcgtcgccgtcgaggccggcgggttcctccgcggcctcctgcttctgctcgtctacccgcttctgtgcctcctcctcggcgacggcgatggcggcggcggcgcgagggcgagggccatggcgacggtggcgctggtggggctggaggagagggaggtggccagggtgggccgggcggtgatgccgaggttcctcatggcggcggcggcggcggagggcgcggaggcggtgagggcggcgcggcggtcggtcgccgtgagcgcgacgctcccgcgggtgatggtggaggcgttcctgcgggagcacgtcggcgtggacgccgtcgtggggccagagctgaggtcggtcgccggcgtcgtcgccgggatcatggatgacgccgacgcggcccgggtggcggcgaggaggctccgggcgctgctcggcgacgagatggatcagggcgaggccgacggtgccggcgccgccgtggggctcgtcggagaggggaggagtggtggcacggtgcactacctcttctcgcgttactactgcaaggtgagccgagctagttacgttgagcttttcctttttactgctctctccatacttaaaaaaaaactccatttttcagtttttggatataacatttcgcagcacatcttatttattaaaaaaaattatgattagtatttttatttttattagattatgaaatatgaatagtactttctatgcaactattttttctaactttttgcataatttttcaaataagacggccagtcactatatctagaaataaagtttttatgggatagatggagtactctttctgtttattttacttttgtacgaagccgtcatatattttaggacaaagggtgtaattagtttcaaattaaatggagataagagaaagttgcatttgcaccattgtgcatctcaaccgaactctacatttttcatttattcatctcgagatatctgctttggtgtttataccaattaggtagtacaacttatagggatagcgttgtgatgtcatcttcttgtcttctttttgtttttctttcaaaaattcattttgatatccatgtgtatgccagcaccttaattattttgtattcgtcgtgtgctcacgtggattttgtatcatgaaataggtgcagatggacgtgagaaaaaaaaaagtcgatctgtgtcttttggtatttttccttgtagacatcacatggtattttccctaaacactgtagtaccaaaataggagtaagtgacaaattaagcagcaagcgacacatgccgacctcattaatttgcttaaaagatgagtagatgacctccacgattggctactctctgtttttcttttccaatttggtgaacatccttttcgcactatccaattataaagtactgttaactgatgtccctagcaaagaaaagggccaacgaatgtccctagaaaaataattaaatctaattaatgtcccagggataaaaaagctaattaatatgtccccagaaaagaaagctactaattaatatcatttgcgaaacaatgcataagtagttaatgtgaattagtgattaaagaatgaatactctttcctttctatatatacatgctcctaataataatttaaagagttttttctttgattcgatattgttgcaatcaactactgttacttagttaacaccgttgttatcacagagcgtgacgtgtacacaattaatgtcaattaattaacgtgcatgtgtccaatccttgcaggaaaccttcactgcgactgaggctgacaagcggcggtggcggccgctgccgccgggcggcgagtgcggcggcgtcaagccgctcgtcttccacgacggccgcctcgccttcccgccgacgccgtccgccgcgctcgccatgtacgcctacctccccttcggcgtcgcgctcgccgtgtcgcgcatcatcgcgctgtccctcctcccctacggccgcgccacgttcctcgtcggcgcgctcaccggcgtgcactaccgcctcgtcggcgccggccacgacgccgccgccggcggcggcggggggaggctctacgtgtgcaaccaccgcacgctgctcgacccgatcgtggtggcggcggcgctggggaagccggtgaccgcggtgacgtacagcctgagccgggtgtcggagatgatcgcgccgatccggacggcgaggctgacgcgcgaccgggaggaggatcgccggagcatggcggcgctgctggcgcgcggcgacctggtggtgtgccccgaggggacgacgtgccgggagggttacctgctccggttcagcccgctgttcgccgagctcggcgccgacgtgaaccccgtcgcgctcgacgcccgcgtcgacatgttccacggcacgtcgacgacgccggcggccaagtggatggaccccttctacttcatgatgaacccgaagccgtcgtaccgcgtcgagttcctgccccgcgcggcgccggcgccggcggcggaggacggcggcgacagcatccgcgtcgcgaaccgggtgcagcgacagatcggcgaggcgctcgggttcgagctcaccgggatgaccaggaaggacaagtacatgatgctcgccggcaacgaaggcgtcgtggccgccgccgcggcggcggcggcgaccatcaaagccagtcgttgaacaggtgttcgatccggtcgtcgtcgccggcgatgtatcgcacatgcatacactgcaaactcagttaccataacaacagctaggaagaacttgcttcacacagttcttatgatactcataatcgtgtaattaaatatataaacacgaaaatagtttattaaagactttatatagctcattttggtccggactctggggttttgatttgaagaaaatttctaaaaaataattaatagtactcttaattatctattgataaaattaaagaaaatgcctatgaccatgcgctggattgcaagataaaacaaaaatcagacgccatcacgagtcatgactcatgagcaatgcattcactaaactctgtttttatttatcgatatctgcaagtccgcaagcatacatgcatgtaacaaggagagggtccaaataagtgagtttaatgatttttcttctcctaacctatttatatggtacgtgataagattacactaatgtatttaaacaagatctcatattatattttaataacaaaaatatatatgtttcaaccaataaaatttgatgtttcatagcgagagcgaaatgttccgatagagattatattgtatttcacatttttaatttttaatctatttttatgttttagtaatcagaattcaatgtttcttcatacatgtgagcaacatgtttctgatttggatttagctgtgctttacttttttttaattcatttttatgttgcttcccttataaagatgttcaatccgtgtatttataattgtttcattcgcggtgatttctcacatattttgtttcgaatgttttaacaactaaactttttttcttcaaaatgtataacttaatattttgatcaccttgttttgaggctcaggtcgggtgtttgacccctagtcttgtccataaaattaatttaaacttagtcgggtatataacttaattttcgctaacattagcttgttgctcggaacaaagcttatcatgggtttcaatttaagtaaacaaaactgttctcggtcctccaaagattccaaaccacgttcaataagaatacatacttccttttgtttacaaaaaccaacctaaatttagatttattcagattggttgtcctataagaagtcacatattattctaggttagtttttttttttgacgaatggagtatataagtaaggttaggatttacctactagcctccgtcccattgaacatactgtcttaagtgatgtgtgcgcatgcgtcttctatataataaaaaaaatacacatagttaattacttttgcatgacattgtactagagcatcgctttcaagtccgttaaatagcactatatatgtggttagtctgttacttgggagcaatattaattatttcaaaaatggcatcactgataaagtcaaacattatttagtcagcatcaacattgttgaggcctattccatgtggtccatgagatacccacatgcagatgtagtcatcagatatccgcacaacactctattcaaattgtactaatgaagatttgtgtaatcatttaattaacaattagcatcaacatctcctttccctcccaaaattaagcatcatgttattttcaataagcacgtcaagacatatgttatggatcgtactctgtgtaaatataaaatatcatggggttatcacacgtaacaggcagcattgccaatggcattaaacagaacaaacgatttagctcaaaggcagtcatggggttatcacacgtaacagcagatggcaatatggcatatgcttgggagcttgcgcatgttgttaaccaagcaattggctccaggcagggtttaccgcggggaacagtaatataaatacaatagtaaccttcttaaatttaaataaatttaaaaaataatttaaatttttgataaattttgtacgattttttacggttaccacggttaccgcgcggtaaccgtgcttaccaccgggacgcggtttggaaaaccctggcttggtaagcttttttttttttcttcccctttctttccgtgtgtttggggtattggggtgggggagggggattgcactcgtacacctgattttatctccaattgtaattctactatttcttcttcaactgtgtgattttgtcctcattttttaaaaacttattatgccctcgttctttttaagaggactaaacgatgttaaaatttatgtatgccctaacagatttggccctacttgtatgaggactttaattatgattttacctctgttttgacatcaaaattttaacatgaactttttacttattcagctaaaaaaaaagagtgcacacatgcttgacatgaattttaaaaccgttgaatcttcctctcgcggaatagggcaaacacaagattctgttaaggaaaatggggacagtaggaaaagtagggcaaaatcataattgatgttaaaacaaagataagaatacaaacgctgcttttttaaggcaaactcaaaagcgagtgcatcacacctatgaatgcatattttactcacatacctattttaatatacccttacataagtacttgtttaactagatgcaaagtgaatcaaggttcgctctacctagcgaagggtgcaatttactttttttaaaaaaaacactctgttagtgttaaatcatgcacagcgcgcgctataatgtactattagtacattatagcgcaatttatttaatttagcagtatgcgctgtaatgtactacaacacacaaatatttttttctcccaattcacactggatggtacagtagttctacactcagtaaacgataactaagggtaaacccgtgcgctttttgaactttctacagaagggcacccgtgtgtatatcatgtaaatgtggctatgcaaccaatttgcaggagcgttcggctcggcacaaatttaatgatttcgtttccaatttgtctagttgatggaagttcagcaggatgaagcaacaggcataaaagaataaaaaaggtagataaacagatacgagcagaaggatatcccgaaatcgaaattattgcgacacgaacacagcacgacaaagattgcgatgcatttctccaaggacgactacgtccaacggcatgcgtgcatccggagtgtcgagttcatgttcatctccagctaatactttggataagtgttcagatctagcttttttttttaaaaaaaagaaaaaggtccatatcaaagtagttcagataagtacccttcacgttttaagtacaaaaggagagtgctcaagattgtcaatccatcgctacatgcatgcatatatgggtattttcaagatgagcaaattgcatatattggtccatgttttttaaccatggtttcacattggaccaccattaactgaatgctttcactttacaccagattttattaccaaaatatatcactttggaccagtggcccacttgccagtgtggctgaggggaaaaaaaaaggaaacttctcggttgggaaggaaccagcgagtccgctgactcatctcctaccacaccgtcgatctctttccaacttcacccaaccatctcatggcggtgtgggcagagatcacgctaaagccttgggggcaacatggggagcttgggactggaaagactcgtgtggaggtcgatgttaggcgacgtcagcaaagaggagctcgtgcacgtccaggtacagcaaaagtcgagtcacggaggcgacggtggtggagaggagcttgagctccgggatggcgcgcgggcatcggagtagccgtggagatcgaggttgagccgggacggcagagaggagcttgagcccaagtatgacgtgctagtgctactgaatattgaggtcaagcgaggtgcgacgacggcggagaggagctctagctcggggacgacgtgcgggcgtaggtgaagaacgaagtcaagctagcgagggccgacggcggcggagaagagctcgagcttgaggacggcacgctggggcgacggagccgcgtaggtcaagctggggtggtggataggagctcgagctcaaggacagcgtgtggatgctgctgcctgctggtgcctggaggtcgacgtcgagcggggggagacacggcagaggtcaaggccgagggtggcacgccagcatgggactatgggagagttcgaggtcaagacggggcatgacgatagcggagattgaaatcgagactgggaaatgcatgcatgcgggaacaggcggaagtcgaggtcgagccagcggacgacatcggcggagattgaaatcaagccagggaatggcgtgcgagtgtgggcggaagtcgagatcaagccaccggacatcgagcttgattttaatcaccggccggcacgacgggaacaaaagtcgagctagcgtgacgccgtgttggcgggaggttgaccccgtgctggctagactacgagcttgagatgcgcgggcgtcagctctgttatatatgctcgagctctcttaggcgtcgtagtcttcgtggtctacagccatcgatgaaaacagttggagatgatcagatagtgatgagagattggctctgagagactgactatgggccatacgcccaaagtgaaaggttttggtataaaatttggcctaaggtgaaaacattatattaaggatagcccaaagtgaaaccatggtaaaaaaatatcaaacatgtaatttactctttcaagattgacaattcgacatgcttacaacccaaagaacgatgaaaaagaaacaaggagaaaactcgcgagaacaaacaggaattaatataccccctccaaagttataatcaaaggaaagaaaactgtcacgcatgagaaaacgtgatttttttttaacaaagacgccctagcatagcattaccagtacagaaaagaccatgccaaaaaaaagaaaatttcaatcaaatttgataaagccttcctttcacggatatattttatattttgagtgttttttaatttttaattttcaaaataaacgttcctagacttatttttaagataggaaccttttggtcacaccgatctgactgacgtggcaacattgttctaccacgccaccctgactggcatggtaggataaataacaaaactatcacgcccgccgcaggtggcatgactgtttggcgtggccaaaagattcagattttagaataaattttagaaaggtttattttgaaattaaaaaacagaagttcaaaaaatactaaaaattccatccatcacaaaacaagaattgagaagacaacaatactgcctgccatttgacaatgtttcactaaactttgtacatcaatggataagtaaattttagggccgccgagggaccgacatgatctccaaaatacaaagttaaacattgttttcaatcgtaatatattcacaaaacatctttcaaactaatattgttgaggtactcctgaggagacatacataaatggtttcttctaggttcaacctcattagatatttgtgttatctgatgagtttaaaagggttcaattgcttgtaacccaacacagaactctgttgtgattgcacggagtaattaagatatgccctagaaaatcaagttggatacttgtagagtttgattggatttaaactaactaaattgcacaagctagtgtcctacaagtaaaaagtagttggggaatgcgaataccttgcatgaataccgaaccatctagaaactacagtagaaaagtaagaaaagtacaactcaatagatccctttttctcaaaaaagaaagaaaaatatcaactcaacaggtctgaatgccaatttccttataagattagctaacacgacatgagtatatttctagaaatcaaccgggaaaaaacaatctagcagaaaagaaaaaccataccaatctagctgaagaatgttcaacaggagaaaaaggggaaagctgtaactaacattattttaacacttacaacattcataacatcaaccgtttcatcgaccacatagataaagacatacattatctaaatccattttgacagttccaagtcccattgtgatggtactgcaaaagaatgagcaactggaacacatatcactgctaatataccaaatttcttaccttctgaaactacatgacagaaaataggcgctaagctgctaagacagtaccacaccattgactcagattcctcacataggtgccctgaaaatccgggaaccgctctttaggtactaaaaaatgtaacataacattccatcaacatctcttagtaagatggatgctaccaagtccgtatctgttataagtagcgattcgcaattcattaactactttgccactcttacctggaacaggacctcaaggacttacctttgtgtcagtcagtttctcaaaccgtaaaagaggctctctctaaatgcatttaaactgcacaacttatggtgaaaagctaaaacgaatgttgaactcaccactaggcaaaagctaataccgcccataggtcctcccaaagtcatcatgtctctcatgctcaaactcgctgtatgcagcatgaggccttggggctgaatagctatcagtaatatacggatattcactcttcgagtcatttggtggaccagtagcagcaaattgtgtagctctctgatcatagtctggataagaagtttgggcataagaagtcggatgagcttgctggtgccttttaaagctttgttcaagaaattcatcccacttccttgaatgcatactcctcatggctgttactctcttcatgtggttttctctcatttctctcaatgactacattgaaaataataatgacatcaggaaatactgaagggttacttggtagacattttcaacataaaaaggaagttgttagaaagcaaccacgctgcaattatgaaattgaagccacaacacccttttgtgaatacatctaatttcaaaacataagccacagctaacaaaattatccgaatatgaaaaggttgcctgccgcagtcaatacaactcaattaaatcaatgacagaaatgttagtatgttataacatagaacaaccaaaaggaataactaatcatgacaagtgttttaggttgtgttgttctgaagtaacctccaacgtttcatacacacaaattaagttgctggaaattctgcaaatgatgatgggaatcaatggagtgcactcaacaattttaaaaataaaagacacaatggaccctcaaatattatgtggaatgtggattgatgtactccagatttcacttcacatattaatcatgcagttataaaaacaaaaaatgttgaaaaaataaattgaacagagtaagagtttggaagttcagctgtttccaactgaaaggctggaagtggaagggcaaaaatatactacatgccaaatttaagcaatcattgggtaaactaaagaacattcttatttgcaatgagccaatgacagaaacactgaaacatatagttctaatactattcatgctgtggctacacaaaatagaccctgaaattatcggttttcttataaaagaaagtaaagaatacatgtgttgcaaactcttcttatcatggacagatcaaaccaccatgttaataaaaaataacaagaactctcaatcagataccaccagtgaccattttatattgaaaataagttacctaacagagaaatgatgagctattcaatatgccaataagaatttacctcacgatgcttgtagttctcttcatcctcctctttgtcacgggctatagctaactccatagcttctcttttgaactccatttcaagctcttccaaagtttgaggataggaaggcaggtcaaacttaaggcttaatcgggaatcggttccacgcgtctcagtgctccaggtatttggcacatatgtagctgcatattggttattcccatcatttgatctaagggaatcatcaatatatgagggttgacatggagattttgattgggctggacggcctttagctccatagttggcagaagcttcagcaaaaggaagaac

SEQ ID NO: 67895 - DNA, 718 bp, Oryza sativa
  unsure (1)..(718): unsure at all n locations
cttgaattgcaaaacctatnnnnnnnnnnnnnnnnnnnnnnnnnnnnnnnnnnnnnnnnnnnnnnnnnnnnnnnnnctaatgtgcattgccctcaagcacattatgaagcacattatgaagggctgtaacagcgcctactaatgtgcttgagggcaatgcatcaactacctgagtgggtaaagcctatttattgcgacaatcattgctcattcacctaccgttgctactaaataccacttttaacgctgtacattaaagaatcttgcgctagatcaagatccatgaatactggcaaacacttgcactgatgggcaatactatctgctgctgatatggtgtattaccggctccatcaagaaccatgcagactgctaggagcctatctgcacctcatataatgaggcaccttacaactcaatggtcgaggatcatgcaacgtctgactcaaaaaaccctatagtgacccaacttacaattcactgagcacatttttacatcgtcaggactggtaataccctagaggtacgcaactatatcgctttgcaacagatgcgcattttgactggtgaatggacacccaataggaccgcacatatcgcgcttcccaacaggtgcgcacgctcaatggggactgtacactcgctagagcggtacattacgctcctttggcgttgttgcctcncttaatcggcacgttacacttgtttacccgctaag

SEQ ID NO: 67896 - DNA, 12949 bp, Oryza sativa
agacaaagctgtgcgagaaatcgggtacttcagcaagcatgtgttcctcctctttcccgtcaggaggtccatgatgctagagtaggttctgtccttcaagaagcttcattcccttccctaccagcacaatcaaggaaggcaccagcacatagtcagagctcaaggactgcagcaaggattggggaccagcagtttcgtcctttatcagttactagtaacaggaatgttgctttagcacagcagggtacaagaacattacctgaaaacacccatgtatctgggcttgcacaatacagcaagagaactgagaacatgcaccaagctgttcagcctcagttcctaaaaaataattctttgatcccttctggctcaacaagccgccctgtgcatgtccccagttctgctggaaatgaaaggcaagacacattcagcaacagccaggtgttatccagtgtggaggacattcttgcagcaaataaagccctggttgagaaaatgcgggctgcattaggaatggatcaggatatgttcaacgcatttaaagagatcgctggggaatatcggcaaggtgttatcaattcttcagagtacctttcatatgtaaagcagtttggtctcttgcaccttgttcctgaaatggccaggttattgcctgatgctcagaagcagaaggagcttgcagatgcctactatgccaatttgcgccttacaagcctccaagaaaatggtgggggtggaaccgataactcgaaacaaggcaatcagaataagaaggggaaggggggagttcctgacgccataggaaccagtaatgctgcaacagatccgctgaaagataagttgctgaatactgccatcaagttccagtcaaattacatgccccaggaagggtgttgtggcgtgcagcgaaaagaagggagaacaacagatggatcttctcagggtctgcctttgaagggtgcttggcaaagccgtgggggccagagactcttcatgagcaaagcaaagaagtgacgaattggttttgcaggtcaagttagttagacctgccatttgagccgctacgaaatgtcaaggtttgtgtctatctggtgtgtgtctgatagttgagtacatgagtgcagcaatcatgtgtgatgcgtttgcattttgatttttttttcttttttgtctatcatgtgtggtgcgtttgcattttgatttttttttctttttgtctattttttgtgtggtgcgtgcgtttggtagaccatggaacttgagactagaacggtccacaccatactgcatagtggagttttgcaacttcacatgagtgaatttgggctatagacggttctgttgctgtcaactcaaaactccttttaatacgaagttatggtcaaaatcgtaccttgatagagataaaagataatgtcaaactcatatgttctgtaaatacttttgccgaggaagtgctaattactactcaaattagtgcaagccatgtcggtcgttcactgctttgccgacaagtcagagtttgatttgcatctttgccatataaatacatttcattgatcgatcatccatagccagccagaagacaccgacgaggcgtgaccggaccgccaccgccatcacctccgcatggagcggcttggcggcgtgccactagtggttcccctacgtggagcacctgttgggcgacggcgacgtacgagcagctagctgttcccagtgccgatgacgtcgaggccgggcacctacaactacaagcgtgcggcggccggccccttgcctttttgtttggttccctcccaaacattaccaaacctccttgctaaacctagccaaatatgtggctttatttggcttataaattgatggccacaccttatgcaaggtttggcttaaaagatgggtgtataacatgtgggtctttgaattaaaaaactgtagcaaagtgtggcaaagtttggtaaaacgagggaatgaaccaaacagcctctagccctagccttgccttaagagtaagtctattttacctccctcatctcttgcccctggttaatttgcctccctgaattgcaaaaccggatatagcacctcccttatttttaaaaaccggtgtaaatcgactcctttgatggttttggaggtggttttgtcctacatggcgcatgtgggacccacatgtcagtaagaaaaaaaaaataaaaattttacacccggtacgtgtcagtcatccttttattttttttcgtcacctctctttcccattctctctctctccctggcggagtcgtcgtctccggcgagcccttcccaatcgcccgcaacccagtcatgaacaccgcggcgtacctgttcgacatggcgggggtcctcgccggggtctcctggccacggccccagctcgggtcagccccgtttggtgaccagatggatcagcccattggcctacccggtgttgtacagcaccctctcctccgcaccgacggccttgccgacgcatcgccacggctcgacgacgacgaacgccgtgccgcgatgtccctctctactgctgggtttgtctccatggcgtcatcgcgcgcggggaggatgagctcccacatgatgggccggggctgctagtgctgcgaggtggcagggtggccttctcctcctcctcatcgtcgttctcgcccgatgccgagctcctccaggatgatgaaactcgagcatcgccggggaaggcagcgggcggcgtcaagctggacccctcccccgtagtcgccggcatggccatgcagctggacacctgagcaccgacgacgactcctacttcttcagcaccccttacgccatgtcgttcagatatagctccatcattaagaagcaagcaggcaggcaggcaggcaagcaatcaattgaacaacgcaaaccaaaaaccgctgtagcagctgctagctagctctggtcacaactcgctagagccaaccgcaatcgatctcaacaacgaatgcttgaattggatttcgtggcgtgcgcagggaggagctcgccgaccactacgccggagaaagagagagaacgggagagaggatgactgagatgtgggatttttttttattattttttttaactagcaatagggtcccatgagcgccacgtaagatgaaatcgcttctgaaaccacttaaagagtcgatttgcaccagtttccaagaatggaggaggccttgtaaccggttttgcgattgagggaggtacagtagacttattccccttgcctaattaccccttcggccttcaaaaagatgtcgatgtccctcacgaaggaagaagctgtcgtcgctcctccgccaaaacttgtcggctagctcaaggacaagccgaggcagtactcttttagctcgatatgctaaccaagccatgaaccaatcccaagctcggcttggcttgtttccatccctaggtctaggtgtgccaactcctgccagacagtggggtggctcgaaatcgagctcgcctgctttatattcacgatggtcgccattgccaacaccatgggcgctgggaggaagaagctaaagtagtccaagggcacttctatccaggatggcattgtaattgtaccatctacgccacgcagtggtgaacaagaataaaaattattgaaaatcctatacatatcaattagcaaattattaactactatactaattaatatgatataaattagctagaattgagtaatttacctgtggtcctgtgaccctggtaagcactacgtaggttcgcccattgacaccgcgctagttgtcagtggtaatttattaaatcccatttaaacggtggtgtttcaataaaaccatttttttgcaatggcgtgatctcaaacttctccgtgtcagcgtacgtacggaaatatggaattattgttctcaacttgttttttaacccttatatatggtcatggactagtactccttgtacgttatggaggagtatttattttctctggtcttcccagctgtgttgttcaaggagtacatggttgcatctgattggagtagtcatcagctttatttttatcttctctagaccgtgtagagtgactgtagagtgtagacgtaggatacagtactacacaggaaaggcgttcataaatgcgaaaacgataataactgtaccacctatagaacagtgaatttacttccttctgacccagaagtaaatgtctgtgcaatagcatgtggtaaattaaagtcttgcatctgcctcaacattactgctaggttttagtacctttttttctctttttcttttttaaaatactgtgatatgttcatgtctgtcccatgattagtataaaaagctcttaagttcaatcttcagtgtagtactagtagtttgtagggttgatttgcatgcatggcatgttgttttatattaattaacttgcttctaaattccaattgatatagtaaatgagagcttcctggctagcttcctctctctcatacacacaagagacaccatcataagaatgtcttgcaggtatgtcacttctccaagggacagtgtagaacctcaactctgaccatattcaaacacataaaatgctgagcacgatcagtaattacttctacctctgtttcagaatataagcatttctccacatttctaaaatttatctgaaacggagagatgtgatgtgacacaccagaaatgcttatgttttgaagcagagatagtaatatatatagccatcaccatacaataacacaataatgatcacatttagcattattcatgcctcgagctcgaaacagtggtagtactactacatgatcacgaacttaattaaaacacaaaatataagaagggacctaattaaaacaaacaaacacaaccaaccaacaaacagatagaataatcctcctccaaatgcatgtaaagaaaagagatagaagagacactactcataatagaacgctagctagacacagtgcaagctaactgcacatatgaagatataacgcgcgcgcgtcatatagccatccatattgcatgcaacgccgtgcgctacatagagcacattacccgcgcagcagcggcgacgccgccggcgacggcgaggtctctcatggcttcttggcctgcttgtcggcggcggcgggggagccgggcatgccgccgccgaggccaggtgagccgccgccgaggccgccgaacatgggcatgctgccgaagccgccgaggccgccgggggtggagccgctgctgccggggaggctgaaccccgggatgctgctgccgggcatgccgccgaacgccggcaccgcgctcccgaagcggtcgaacggcgggaacgtcgtcggctgcaccaccgtgtccttgctctccgccgccgccgccgccgccgccttgatgttcctcgcctccgccgcgccgaccaccgcgagcaccagcaccgccgccaccgccatcatcttgctcgacttctccatctctagctcgatctctcttgcaaaagctaagctaagctcgagtgtgcaagctgctgctgctgctgatcgatgtggagttggaggaggagggagagaggaggggagaggatttatagcggaggagaagctcatcgtcatcgatcggcagagaagacggtaggtgggaggcgtaactgcggatgttaaaggagggggtacctgctgctgttactgcaatcctgtgatccccattaatacttttgctcttacagatcatcaatataaatgtagtacacatgtaggagtaatatgatatggagtagtatggctctcaatgactttggatgaattggcacaacggaaaggaggaggaggagagaggagagaaatgaacaaaccctagctagatctgtggttgtggttgggagctagtagtggcattcaaaatgttgtgaaacccttttaattagacagcttgcattgcatgtaaggggggttagtgtactaagaccaagtataatagcaggctataagccaactatatgcttatgtggaggaaagagaatttaaaaaatgcagaggattggctctcatacaagagctagctattcacatacttcaagacaaatacattaaatatataggtaagagatagagagaggaggagaaaaaaagaaataaccttatagctcatttactatacatgtttactccaatataaattataagcttatagttagctctattattaaacttgctctaatgaactagttatggattggtgtgcctgatgatgatatcatatggcacttggtaggcaatggaaaacaagagagatggcatattaatggcattgcctttttttttgtgtgtccaactgtgattaaatgtgggatactactaatgaaggacttagcatctattactgatattaatttaacataaagaaaaactttattgatctcagataattaattgcatcaatgtgatattattaatcgatctaagagacaacctgtcaacctctgcatatagctaggatatggatgccctaggatatgcagagagcctgagattattaaaaaggaaaaagtacgaattacccccccaaatctatcgcgctcgtccgaattacccccctaaaccacaaaaccggacattcttcacccccaactatgcaaaccagacaaattaccccccctcgacccaatccgcggtggttttggcctatgtggcgtacacgtggcaatccagtcagcattttattttatttttaatggtgggacccacatgtcagacccctctttctctcttcctccctctctctttctctctcttcatcggttagcggcagcggcgcacacgtcggtggccggcacgcatggcgcggcgcgaggaagggcgatgggcggcggcgcgggggcgggccggcggtcggcgcgcacgcggcgcaccgggaggtggaggggatgggggagaggcgggcgtcggcggccatggccggaagcgtcggggggaggacgggggacggcggacggaggcgcacgttgggagctggagcggtgtcgggaggaggacggggaggaggagcaagagaggcggaagagggaggaagcagcggcggaggaggaggccgttcccgcgaccaaatccgtcggcgccacacggggggacgaccgtcgtcggatccgcacgggcgacggccaccgcacctccccactaccgtcagatccacacggttgcgcaatccaccttgccgggagaggagaggggagaggaggagtgggggagaagaggagaagaaggccgttcccgctcgtcgggtcagggcggggcagcagctgcggcggcggtggcaactgcggtggaggcggcgcatgaggtcctgtgggcgcacggctacgcatcgacggcggggcggcaactgcggtggacggcggcgcgcggggaaggggcggccgccgtagtgccggcgtgtccgagctccacgccaccgcgacggtatgggcatgaacattatgccgctacaaaactataacacgcataagattaataccaaaatccgagatgatttgaagttttgaacccaaacccacagagaactctaggcagctctcggacaaccgacgtataaacgtacccgtttgttctccatttaactaattaaaaggaggacatttttgaaccaggagaaaaagaaagaaaatctgtttagattttagagcgattaatcggttgaagctagacagggagatcaaagaactgtttggccatgactttctataagcatggatacgtacgatagagaatctagttgatcgtgacacttaacactaggaaagaactcgtgtatgcgtgtgagtgataattaatgtgtatcatcctggcaattataacaattaatcattatatatcgccgctcgattgattcatttcatcgttggtatacattatatatttatatggttgtgtgttactaccacgctaatgaaaacggaccatatatatgttcttgagtgttcttcaactttcacggggttaattattaatcaatttattaccacggtcagatcataacctcatcgctgcctgctagtcttgtgcgtactagcagcacaaatccagtactggtttgacaaaaaatggtaggatcaaatatgtcagacattacagcttgcgtgcatgtggtgtagtagctcttctgttctttactccagttcagagagaatcaaattcgctagctggagtactatttccgtaacttggatggagcttcaacttcgctagatagtaacaatgggaggttaaatttctacttgactaatttaatttagtgactatagcaaatgataactattactgttgttttgtttgttataatttgcctttagcggctgaggaataaacacaacttggaactaccagtttatactttgcatacatctgctgttaattgcatgcacctgcagatcgatctactcccataagcagatttatagctcttggaactttggaagaatggtagttgggtgacataatgctactagatgcatgggcacggccaacatgccctgatcagggatatggccggggtcttttggctcatagcatcatactattacacctagctagagattcctagttagctagaaaatgacaagttgattattcgtgtggtccttttatatatctctgctacttaaaaatatggttgttctcttttcaaaccatcgcgtgtaatgtcagaaaaccccgtagaaaaaactgaatcggcccacctcccatcatacacaatttttccccagctaaaaattaactagctagaaaaactcgatagaaaaaataaaccctatataaaactattattccttgaaatcccattgcaacgcatgggcatagcgctagtgagtttggaaaattggtgagattttcctattgccatcatatcttgaaacgactcttcaaattaataaaataataaaatggcgtcactgttaatgttatatgtgcataaattccttttgctcttaatttgattttaattgtggcatttctctaatgtcctagttaaaccattttttccaaaaaagaaaaaaaaacctaagccctcatttcttccgtgcgatctaaatagttataagagatccttcaaaaaattagaaaaataaatattgtattgggtgtcttagcctataaaaacatgcataatcaaactcgtctatatgtacggacgaactaaaacaacaatccaactactttggtgccattggaattgttattttgtttctgcgtgtgtggattaaatttgaatttacatgttagtacatggatgtatatgacatgattatgtatttcaattcatttttaaatttatttggaccatgtatatgtgaaagcgtaagattaggaagctttgtaataaagttgagggaatgtccacaatacctaaatttagacagatccaatttaaaagattttataggttcattaattaagacttggcagaagaactaataagtttctctaacagttaaagacccttaagatcacaaaattaatttcatttcaaaattatttgcaaaaggatatcaatttgtaatacatgaagccatacatcgttataagcaataattaaggacgaccttataagatatatatataattctccatagtgtggtagtacgtactgcatcagaatatatgctagctatgtacactactagcctagtttacacgcagtacatgtacgtatacgcccgttgtgaattgatcacggtgtgacgactttgagccatggatagctgtatatataacgatccacggatcggagtcacgcgccagccatcgctagctaagctgtgtagccccacagaggcaatactaacccgtttgggatagaatttttactggattattactatttactatcaatttcattataaaggtaaaaaatattataaacatatatataaattttacagataactcagaacaattggtctaagcaatacagtagattttctaaaggcattcatattttttaaaaaatatgggaaacgtgtagtgtaaaacaaataatcggtgtcactgattcgatgaagtatatgaaaacaacatggcccactgtaaattagggggtgtgtacgtgaatggtttagacgacgcgatgaggcttacaatcttgtaaatggccaaaaattcagaaattttaggggtcaccaaaattttttaaaaatattaaaattatttaaattttaaataaattatgtctgaattctaatatattttggtcagctcataaaaacttgaagaacaaaaataaaataaaaaattcagatgggatagtttcttttttagataatggattagattaaaaccggcctatacaaatttgtggggcgagacagtttcatgcccagaggatatgtgaaactaccgaaatttccatcctagcacgatcgatcaagggattggaaacctctgacgaacgtggtgcctgacatgtggaccctacctctcgcgggcccacctatcaatgaccacgtcaggggaagttcacgtcagatggtccctttcctcgatcgatcgagttgatcgattggtggcaagtggagagcgccggcatgcatgctgcgtcacgtacgtcggtgacatcgatcgtcgttgcccatggatgcatgtctgattagctctaagctgcggcgcccatggatgagtgagcgagttagtgaccacaagtccacaactgatggacccagcagctagcttagctgatggagaattaacgagacgagacgagctagatcgacgtgtgagatgacatgagacccgtgcaaagacagaggaaggcaggcacagcaaattagctggaaagaatgagagagaaaaggaggtatctagccggccagttaaccccccaaaaccgaccggtacgtagtgcacacgctgccagcttaaattcctcaccggacaccggacaccggccaaccagcaggcccctgccctcctccgtgctccctagagctatcgcatttaggcctggtttagttcttaacttttttttcgaacttttaattttttcatcacattaaaacttttctatatacataaacttgtaactttttcatcacatcgttccaatttcaatcaaactttcaattttaacgtgaactaaacacacccttagctaattatccaagtaggtacatgggggctttgatttcttgtttccttttcctttcccctttccccgatgattcttgctcagccaaagtgtcaaagtgatatatactctgtgatttatttcccgtgaaactaatcgatccatcgagctaaatcgctctctagcacattggatcctgctggtatatattctaccattctggtgcgctcgctcgcaggtgaccacaattccgctaaaatcaatcaaaatgcactaacctatagccagcgcgccctcctggtccctggggagtagtgcactgtggtggtggagtagtactccttaaatttgaacatagtttatatttagattaaaatttaaaagtgaaattcttttgggaccgagggtgtacgtagctgactagctggtggcgttgccatatgcgtacgtatctggttttgcttagctcaacgcagtaaatgagagctacgacgacagctgagcagggagcaaaggagggaacagagagattcagagatgcaggtgtatggccctgtcctgccctggatccgtcaatcgacagccgatgttgcctggcaaatgtcacatttctttgcaagttactactccctccgtttcacaacgtaagtcatcctaacatttctcatatttaaattgatgctaatgaatctagacatatatatctatctagattcattaacaccaatatgaatatgagaaatgctagagtgacttacattgtgaaacgaaggaagtagtacagtaattaggatgggaagagtacgcacaggagtgtgtttagttcctgaaaaacgttagaagtttgaagaaagttaggagtttgaaaaaaaaagttaaaagtttatgtgtgtaaaaaagtttttgatgtgatatgatgtgatggaaagttaggaatagggggaaactagacacggccatacatatcgagaattctcgagatgtttcattcattcattaacttgggctgtagtttttacttgctgtccattagccatttgctgcatgctggtgtactcatcacatcggttttccgcctcgcctggacgacagccggctaatccccatgcgcgattctccagccggtgacagctccgtgaatttcgaccccgtgtacttaacaatacttacccctgtttgcttttattattaaacttctgatacctaaaaatattatgcacatatgaacacgccttcgttttcaatcaaaaatttaggtaagagagatttgttgtcggccttcatctctctaggtatgtgttcggtgcactactggtgggtctggtgtgtatctatgtgggtacatctctcatgtcataaggaaaacactacctcatatataatttcttataaaagacaatatttaaaacccaatgtcagtttccacttagatttgagccttcaacggataaaatgcatactaatatcagggcgatattcttttaaaataaaattaactgcgtggagattgaatttcgaaaaaaggccggtactatatattgccagtgtaatcatctgcttggaataaaggtggtgtacattcagagtgcactctactgttactactacaactatacaagtacttagatatcttaattgcatgccaatacaattatacaagtatagtatagtagtactagaactagtacacagtagcacataggagaattatagacctttttatggtcagacacccaccgactatatagtagaaatttctggattatatatagtcggtgcattgcataagcgtaataatattcaacagtatctgccgcctaactactta

SEQ ID NO: 67897 - DNA, 827 bp, Oryza sativa
cccaacaacatggcagggaccttcctcttcgtgagaggaagtccttgctagtgaacagtagaggggaggagagcatgagggtgaggatgacagtccatggatggaatggatggggatgaggacaatatctgatgattttttatgatacttggccttaccttgatcttttaggggactttccatttcttcacatgcctttgtttatgagttgaaattgcttacgtaattctagatgactaggtttaatttccttatgattatgagtattggtaaatccaaagcggaacgattgtttctactgtattgattaatcattttcttggtgaatggctcagagtggaagaaaaagattggggagctgacttacgcaagttgtctgctggggctgctcttgttgctctaacattgtggcttgatcagatgcaagtaggtcttaaaaataatattaatttttatatggtgttgcattagttgattgaaagagaccaaatcaatgattaaaaacttgttttgagtggagaaatagtaaagtttgttcactagctttacttatagtgtattgtttttttgccattgtcatgactatggacagtacagcacacacttttgagtcaaatgaactataaattaagaagaatgaagtgactacagacaagtaaaatgtgtggaatgtaggctatttatctcagttgtagtgtctaatgcatttctacctttgtttgacattgtatgcaattttcacgtagagaatcgtgataggttttgtgacagtaacatgatgaagcattgtcctccttttttgctagtctatcggcttgaagcacaaa

SEQ ID NO: 67898 - DNA, 19861 bp, Oryza sativa
gagcttggtttggttgtagggacagtgaaaacaatgaatacttgagtccttcaatattaagtaaataaataagtttgtccatgtaacatagataaggagagtagaggataccttggctgattattaaaagaaaagaaaagaaaataaaagaaaataaaagaaaagaaagatacctcagctagcctgttcccctggtgcttgagggactcagcattatcagatggctttgttccaggacagtccgtggtaaccactcttgtttcctccttttctgtctcatcattgtcactgtccaccccaaaaggtaggcctggcttagatggtgccactgagggctgcctattcgtcttagcattcttaccccaagttattttcatcttggaactgttacatgagatgggctgacaggagtcagtttctttaactagaaaagcaacattcctttcacgtactcaaccattgaaggaaaaaaaacacccatatttctacaaaaacatagcaaattaagtagggaaacataaaaacaccagaaaaaacagtcctacagattccatgtagtgctcatactaaagtgacacactaccatactgatctataaataatatacacatcaatactttcaacatctccgaccagtgggcatctgttgaagcattggacttaggttcttgatattagtagaaaacaagtttgaatagaacacctgtcttatctgtaggctgcagcacaaccaaaaaaggactgctaaagacctgagacaagctcaagcagtcaagctgattataaaattcgtcccatttgcgtatggatatcgcataggcctccattcatgaagacaacttcaaactactaacttctaaagtcagaagatgaaccagtgttagcctcttagagcatctccaacaggtacccaaaccaaattccctatagtcaattttttgggaattcatttagattggcaagtgatcaattctttcagattgctatatatttgttctcatacgtcgtgaaaaagaaatatatgcatgtgatctttgtggaaaaacattggcagcaatggttaatctttgtagaaaaacacatgaagcacagaaggaaaatgtgatttttgccgttagctgataggtgtgaaaaagaatatgcctgcaatctgttagctctgggatacagtcatacgtaatttgattttcgcacgagctgttagcttttgtttagagaatgtaatttttccttttaaaaaggggataagtttaagaacctgcaattttctgtgaaatgtgttcaagaggagtgattggaagttgctatgttgtgtgccattgtgaaggcttgtggaaccagtgatttttggtactatgttataaggtatctatatacatgtatgcagagaacaagtcattttaaacttgccaatagaagaagaatgaaccaatggaaacgagcaacaacaaatgcgaataaaacaaatgtcctgaacacaaacctgcgtacagaaccaccacggcgccgtggtgcattgtcaatgtcatattgatgttgtgctatgagtgctgctgccagaatgagttcatcatcatcatctgatgatgacgaatccaagagttgatgcataagaaagcctctcattgtgatgtgctagaggaagaaaaccatcatgaagagcaaatatgtagagataagaaaaatagccactcggaataaataatttgaagagtagattgcagagaaccccattttttgtggttaaagttccggaaaaccgcacatacttgcacacaaccacggatttttttaatggtacaaaggtttcatgaaaaacccaaatttattcaaatcacaattactactccattagcatatctgaaacaattatattgaaaggagtgaagaattaaaccaaacacacataggccccgttcgaaccaagatgaacttaagggcacacaaaacaagaaaaccattagtgtataattaattaagttttaattattacaaacttgagaaatatatatatttaatattttagagcaacttgaaactgcatcttaattagaaaaagaacgggttatagaggcaagcacgaccaatgaggacatagggaatggttctctttttgggaatctgttgattggagatgctcttgtgcatgcaagcatatcatcaaacaagttgtgcgcggtgcggccaccgactcactcaagcctacagaggcgagcagcactgcactgaccaaagatcgctaggcaaaacagcgggacaagccgcgcgcgcgcctggaacaacaagaatccgctcgccggccgagagacagaccgccctcgcggcggctgcaacatcatatcacaacatggggttgagggagggtgccgcgggtggctggcggaggactcaccgatcaagcctggaagcgctgctcgctgctgctgcaggaggagaagggctggagcttccggcgaggagaaggaggaggcaagcggcgagcagagagacgacgacggcggcggggttgtttccgctgctccgggagaagtggaggagattccggcggagtggctgggctgacgtctccaatgggccttttggaagaagtattcgggcccagatattgggccatccgggcatcactgcggcccatccaagataagcataagagggtttaccttttttcgattttttttgctatgcatatccattgacaaatttctcaaaaaatactctctactacttaatccgtaggtgaggaatgcgcgatcccatcgcgctcctcctccggatcgcgacccgcagttagcgagaaaataacggcgccccccaatccccggttgttgcgtccccttcctccgcatccaacctcgcgccgcccccacatcgccgcgccccatcctcctcgccgcaccatgcctccactgccggcgcccccttcctccgcattcaacctcgcgcgctccccatctcgtgcgcactcccagagattaaaggagtgtaggaggatctgataaaaagtggagctattttcattgcgacgaagttggtcagctccaattatttatctttctatatctctctattttttttacaaagttaggaaggagaaggatgcactgcagtatcagttatcgtatgatgtaactctctgtttgtactgctatgcttatttagtacttcctccgtttcacgatgcaaggctttctagcattgcttatattcatttagatgataatgaatctaaacatataaatgtgttatattaacatctgggcaatgttagaaagtcttatattatgaaacggagggagtagtaacatttatcagatatcgtctctatttagttctgccttctcaatctaaaataataagatacgctattaatatctaggctgaatttgatcatcgtgtgttacgaatggaatgtggtagacctgtttgcgaagttacagtgtcaacagccagtttacttgcatattagattgtcctaaatacatacatttctttactaaatgtagttcttgtcacaactaaaatatgtgatgtttgcaatcatatgtaagttgtctgatgaatttcaagaagatgcaggtaaaaggaagcctggcaagatcaaatcaaatgggaaaggacgaagggcgaaggctgtcgcaatttcccccaagctcgcaaacttgagctggtcagaaaccagtactgagaattcagcttttcatttatcactatttacatatgctagtaaggtgcccatgcgttgaaatgggaaatgctatatatcaatttcaaattatgttaagtgaatagatatcaaatattcattgagtgaaaatttgttgaacacatatgcagattaatttcaaaacagaaatatgttttcattacataagcataatgaaagctttctgcggcatgaaacaatctcatggtgtttattaaattataaaaagacaacatagatagaagactgctatgaaaatttaagagagaatcccttatatgccactgaaaatttgtctgatcccttggatgccactgaaaataagctcttcacttatatgccattggttcaaattttcgctccctctcatgccactgccatccgttgactggtagttgactgttaactgtagagtgaaatgacgtatttgcccttcttgagttgataggcatgcagtaggtgttagtatgtcagttatatactacattttagctaggcatcacatatatttggaataaatgaatatatgaatgtatagcattaatctatatattgaatatatgaatatttttcagtcacataattttgaggcacatatttctctgtttttcatagtagaacaaagcaatctgttatggcattaatgtatttttcacatacattaaccatgtacttctcgaacaaaagcttcaacaatatttactagggagcacaacatttctctgtttttcacagtatcgacaaaacattcaagtaatataatagattgcttctgacagacatttaagataatgtgtaattgcacattgtttgtaatgcacggctaaacagctaaaataacaaacagattgtttgctagaggaaggagatatacacagtagcacagaatatgcaacaaatattatagggagctgtttaaatgaccagagagtaccaaaatgcatactgacacagtaccaaaatacatgttcaggcttactgacatggtgcatcagagggatgttgggcttggcccacttggacaattgggccatattctcatgtttgggccaaagggtatttttgtcatttcagtaaaaaaactgacaagtgattacatcctatcaacagtcaactaccagtcaacggacggcaatggcatgagagggagcgaaaatttgaaccaatggcatataagggaagagccaattttcagtggcattcaagggatcagacaaattttcagtggcatataagggattttcccaaaatttaatgatgtcatacaaattaaagcacaaacaaaaaatctagaacaacaagtatttccagatattgtatttttcattgataacaattatgatttgtagtttctttggattgccagaattgttttccctgtgttcaacaaattttcactcaatgaatatttgatatctattcacttagtataatttgaaattgatatatagcatttcccattgcaacacacgggcaccttactagtcaaatgtaaaatactatataattatagtgtaacctaaatttaactactatatccgttcccaaatacaaaccatagttattagaataggaccatcacgtgaagttggagaaaaaatacggaaaaagctgcagaacttggatacgaacccaaaacctccatgcttccacggaaagcctcaaccactaagctatacggcttattgtgaaaccaatataacaaacatctaattgaacctgtttaaaccggcggtttgactccgaccaataaaccaatgacccgagtgccttaccggtttgatcaccggtccggtcttaataactatggctgcagcttccacagcttctgagaatctgtagttacatatcctgaaaaatgaactaagaagccagaagctggagaagctgggtttcagagcttttccagattctcagaagctggctaccaaacaactgcttctcagaatctaaagctccccaaataggcccataatataacttgtatgtaaattttacataattttagaccatcaatttactctaagatttgtgcaaatggggaaggagaaaattacaacatgcacataggtaagggattcgatcccataacctctcgtgaatagtttttaaaagttgcatacaaccgtatattatagccacgtgcaaattacaatgtaattatactacaattatatcctatttatatttggaaaaaatctgggagaaaagttatcgacaaatatgttgcaatgtagatgttttctactttttacctacagtcttattcaatttggagatgattaaaggtgattagagggattgagaatgaataattccataccgcagtggttgtgaaataaattatctctaatccctctctcatgaggattaaccgaatatggcctaatagaagaaatcattccaaatcactatttatacagatgaccggactaaaacttctatataggcaggaatatctttgctccttttgtctgttgtgatggttttctcatcttggttttactatcctagagacattgttagcaaagtggtggacatggcatagtatagcacggtggcgatcatttagacatcacatttcttttctatgcatagggaaaaggacatagatgtaactaactgactataattcatatcaaatttggtaaagtgcattgctagttacatagaacagacaactctcgcattgccctcctctaggggcggcttgggaggcgacgacccggttgccccctctcccccaccttcctcctccgcctcgctgccacctgagtggccgtcggcaaagctgcgcggccacaaggacggcggtggcggggcttctcgcttctcgcgctcgggcggccaagggagccgcctagggtagtggcggtggtgaccgccagatccgcgtcgctatggctggatttggtggggtggtggctggcggcggggacagcgatgatggtgggtatggcgaaggcgacaggaggggcgagctgcgctaggcatcggtggctaacggcggccgggatggcaatgacggggcggatccggtcgcgctggaggtggatctagcgccctcagaggaggatctggccccccggcgatcagatcgggcgagggcgagcacgcagcgggagagcccgtcggggcggtgactacgcgaccttttagtgcggctcggccaagcctcgcagtggcgcggtcgggcacgacatcgacggtgatggggcggcacggtgcacgtgcggaggggcggctgatggcggaggagactggtgaggcgctaggaggcgcaaccggtatggaggctggcgaggcgtgtctggctcgtggccgcgacgctaggaggcgcagggaggctcgggtgccagtggcggaggccggcatgtcgcatggagatgtggccggcacagcaggaggcgaggctggcagaggtggaggccggcgaggtgcatgctagtgcgacacgatgaggcacggccggtggcggcatcgggaggctggccggcgggggcgccggtgtagtggtgcccacacgccaacggaggtttagatggtggtggagcaatggtgtgtcagctgtggatatgcaggcgacggacaacgtgtgaaaacccagcccggccttggtcgggttggcgtttcgagcatcactcccctcttgagggcgttgttgtgccgtctcaacccctctagcggcacggccaggtgaaagcctagtctcagttctctttgagaccttgacggatgtcggcggcggcggagcttccgtcgcttctctccttggagacattgtctttggcatccccttgccgaaaccttcgaaatagccggcgcaagctcgctctagattaacgtcttcttatgtcggcgctttagcttctgcaagttgtccacatcggagggtctagggggagagcggttccattctctctctcaccctatctccctcaaccccaaagatgtggatagagcgggattttgtgtcggttataagggctgggttttgggcaatctcggttgtagttcctttgttggtctagcggcggccggtacagtgctagccttctctagggtttatgtgttggagttgtcggtgggtgggtggtggtatttttttttgtttttctggttatgacctcccagtgttgtaatcttgtattttttttgttctatcaatatgaacttcattaaaaaataataaaatgtaagtttattcgatgtcgatctacaggagttgcaaagaaaaaaaatagcaattcctacgagaaaagccgtatgaacccaaatttctaacatgagttgttgtgttacttttgcctttaattaattcatagcttttatgtgcatggctaatcttgtgtaacagttacatacacttattttcgacattgtattctataattatagcattcatttaatgataaaatagtagcattctatgtgaaaacttaatttatgtcgtactttcttgggtttctatttttaaattttagaacttaattttaattttgagaatcaatttagaagtttttatttcttagcttttgatctactataaatccctctattccaaaatataacacctaattagatgagccatatctctaaccaaattcgtcgtactagtctcatctaattctaagttgctatattttaggacatagtccattatcgtaaaatcattttttttcatcaccacgtgtcttccgcgtattaagatgtaaccccacgaaatatatatccaagcacgacatttttgaaacaaggacactttggacactagaaccattctaccgctacaaccatgaaaaatacgagggagagaaaacccaaaatacagtaaattgtttctatccaaacttgaatcgagccgatattcaagcgacatctcgaaggtagagaaaaagaaagacaatcatctcgaactcaccctcccacgcgtccacccactattggcccccgcagattagactccgctcccgccgcgccacacacgcctctccccaccaacggcaacccatcgcgtcgcatcgcatcgcacccctcgccgccgactcggccgtgccaaatcaaattccaaaaaagtaggccaaaaaaaaaaaaaggaaagaagaaaaaactcactcgactcgagcgcgcgcgccatgggggagcgcatcgccgcctcccttcttccgggtgcctcggcctcgcctgctccgtcccctccccccccgcgcccccgcgtttccgccggggccgccgcctcctttccatgctgctccacaagcgccggggggctccgcctccgctcccgcccgtttcgcttcccgcaggttcgcaatagttttagctcggctcgtgtttttttttttttgggggtggggggggggttgaatcgaggtgttctgagttgactgatgcgtggcacctgcagaaggctgcgacgacgaggagcgggcgcgccggcgcgggggcgcgggcggtggtccggtgcatggcgcgcggcggcggtggcggcgtccgacgcggcgcagctcaagagcgcccgggaggacatcagggagatcctcaagaccacctactgccaccccatcatggtacggaacgcccgcgccatctcagctctcgcatccatatgaacagagaagagtcagagatgatgaaatcctgcgatcctgctaccatgtacaggtccgtcttgggtggcacgattctggcacgtacgacaagaacatcgaggagtggccgcagaggggcggagccgacgggagcttgagatttgacgccgaattgagccacggagccaatgctggtacttaatttctcgtgtctcggcagtgcaatttcgaattcaggaaattcgtggagtaatcgtgctgatttccttcataatcgtatggttttggttggaattttgataggtctgattaatgctttgaagcttatccaaccaatcaaggacaaatacccgggtataacttatgctgatttgttccagttggcaagtgctacagcaattgaggtctcagacttcttctctctgctctagtgactttgctagatattttttggatgatcggtagtctatgtgcttgaatcttttgagaaaaatttcttgcaggaagctggtgggccgaaaattccaatgaaatatggacgagttgatgtcacagcagctgagcagtgcccaccagaggggaggcttcctggtcagtgtttccattaagttcttcattctgtttctgatcaacgtttgcatttatgaattgtgagaggaacttatcaaagagtgaccttctggtgttgataaatgccccccagatgccggtccacgtgtgcccgctgatcatcttagggaggtattctacaggatgggccttgatgacaaggtgtggatgatgcaaaaaagaaattagttgcctatctgctatttgttcttcatgtatgttgtataaccatttcttttggactatttatgcaggaaattgttgcattatctggagcacacacacttggaagatcaagacctgacaggagtggctggggaaagccagaaacaaaatatactgtatgttttcttgtccactttggaaactcaacaggaaaaataagttattttcagcagtaggaagttctaggcatggccagaccttcaatgttctacactctgggtatagaatattacatttttggggcatttgcaaatttgccaccggttttttcaatattgcaaggatgctactcgaatgacagttctagtgatatttttgcaattttctagtggcagttttgcaataacgattcaaagtagtggtaaatttgcaattgcccctacattttttgagacattcaggcagaggtgaaaacaatgcatgtacttttttgtgttatcttgtaagtaagcaccatattatgcttttaaaatccgtgaatactttgtccttatgctgtaaataaataatgttttaattcaggattttacaaaatgggttatccttacgtttcttttgtatgcatataatggtaaaatagaattaggatgctaagaacttcatagctaacaactttgtcattctctaagccctgatacttctctgtggggaaatgaagattaacttttcgatgcaatcttaccttaatcacaccagcacaatagcaaatcagattagtttcagttttcagactgacatttaaaggtggcttctattattgtggtctacagaaggatgggcctggtgaacctggagggcaatcatggacagttgaatggttgaagtttgataacagttacttcaaggtgtgttagcattttgtcatggtttacaaaattatttttttcatttgaatatgtgatgattcagctgatgataatgtttcaggacataaaagagcaaagggaccaggatcttctagtgctacccacagatgctgcattatttgaggatccgtccttcaaggttatttggttgtgctcaatttgtggcttgaatagctcataggtcactgtctgaaatatctgcaacatatgcaggtatatgccgaaaaatatgcagaggatcaggaggcattctttaaagactacgctgaagctcatgctaaactgagcgaccttggtgcaaagttcgatccacctgaggtgaggactaccatctttttttttcattttgatctcctggcaaccaattgtgcctaaacaatcataaacaatacgaaagacacttaagctcttaagttcttttattagaacatgccagattttcttgctcttgtttgcaagttcaaaacatgactccctgattcctcgcccacatcgagtagatatcttttggaatgtattttttttctagagaattcagtaatgtacttatgtgacaataagatggagtactggaccttcaggacagaaatatagttcaaatagtttttctttttaccgaatgtaatccaaacactgggagtttgaggtagtccatcatatcaatctttcttctgcaatgcaacgaaatggggtttactatggcagcttttcttagctgttcttcatgtaaaaaccagtgcaattgtaggttggatatttacagagtccaactttaccagccttcgatcaggaagtgatggatgtgattttcctgcagggattttcactggacgatgaaccagccgtcgaagagaaggatcctgaaccagcaccagcgccagcagcagcaccaccacctccaccagtcgaggagaagaaggaagctgaaccaactccagtaccagtaacggtaggagcagcagtggcatcatcgccagcggatgacaacaacggtgcagcaccgcaaccagagcccttcgtcgctgcgaaatactcctacggaaaggtatgcactctccacgaagcctagcttctagccctagatttgatggacaatgcatggtatcttgcaatggcttttgcagaaggagctgtcggactcgatgaagcagaagatcagggcggagtacgagggattcggaggcagcccggacaagcctctgcagtccaactacttcctcaacatcatgctcttgatcggagggctggccttcttgacgtctctgctcgggagctgagagcgatggtctgatgacctcctctgacgagtgttttgagttgttctgcctgtgctaagatttgcgtgtttctctttccatgttttgagtcgttattccgtaaataaattgaggtaaaaggatgggcatgtgaatggattccagtactttctgaacttcttgagtaattcctctagagaaatatttgtcggagagaaatgtcacattatctagttgtcatggctcatgactacattctctatactgagggaaattatgacattctctaaactaaggagggaaataatgaggacaccccatatatcactctttcttatggcatgttcagtataaaaggaaagtgcattttcctctccaagaacattgtatatatatttacttcttaaaaatagggagatggatttttatccctggaggggatattctcttgtattttttatgccatctaaatagttagaaaaaaatgattttttaagacatagatcatcatgagatatatcactctataagttcaaattcgaattctacagttctccgactgtggtggcagtcctctcctctcctctttcctagaggatttggtggcagctgatcggggtggcaacaagcagatgggtcagcgccagtcagcgatagcatgcaacgcaagatcaaggccgggacaagctcctccctctttggccgccaccgccatctctcccttcttaggctgacgccatcaaggctcgtggcgaggaggtacgtctaagaaggtagcatattgctaggcggcgcaaatctagttgatgaggccacatgaggttcatggtggcacaaatcgaggttggaccaacgagctctacggtgatgggatcaaatctgtagcgacggtaaaaggcccttcttctcctcccagcatctatgtcattccccaatcccgttcacggcattgtcgtctttcctcaagtctagtagatctgggttccactgctttgagctccgtgcgaggagtggctcaggaaataggggaccacacgcatcatgtgggtacggcttgcccaacggggcttgtaggccatgcccccacaggcgccctcaccttgataaggccccgtgccctctgtacgacctgagtggctttgcgaagaacacatcttaagccaatgtggagctacgacatcgacgtggagggctagaactaatcactaggcccctacgctacgtacccttataggccaaaattactcctacttgtgtattgaaatcataggtggcacatcctttttaggcatggctcgtcaagtggctcgtgccgtggtggctctcgtgctgaggatagagcacaagcacaacttagtaagaagacgggtaggctgggccaacacgagcccatatggcacatgttcctcggcctcgctgttccgccaacgaagcttgctggcgatgcctccgtgcctctctgctcagctcggccctgtctcggctgtcacaagttgtacagtgcaccaccgctcccaaacaccttggcccaagccactgccaccgtcagctcgccctcaacgtgtaggtgctagtgaggccttttttttttccttctatgagacttacatgtgggttctatgttggataaagactagtaaacttgccacatcagccaaaaccactttccaaaccaccaaggggtatattttgtatcggttttaatagttaagggagtcaatatatacgattttacggttgaagggtacgaattggattcggtcaatagttgagggactcaaactatacttttccctagttgaaattgtgccaaatgaaggccggcctaaatgacgactaattagggcccaaaatgtttatgggccgagttcatgcgcatttatgggccgaatccatggtcaacgactatatgggcctaattcattactcattatagagtccgagtcacaccgtcactcctcggctgcgcggccgtcaatgaacgctcgccgcgccgcccccgaccactccatccaacctccccgccaacgaccttgaaaatcgactccagatccggcgtagctgctgccgcgatgctgagcgcgcgaggaacggggttaaagttcagttttctctctatttttttttaagaagggtattttttaccggcctctatatataaccggatatatgcggtcatttaaattaggaacttagctccgcaaacaatctaatctaaaattcgttactatggagatttaaactcataatcttggttactaattatctctctactaggacccatatggaactttaattatgctctccattgcagcgaggtggagcctggaggagattgattctagctattcaggacgacgtcgagctgctgctgctgtcgctgctgcttgttcttgttggtggaatccccggtcctcatttggtgcgaaaacgaggaacatgtcagagaatgcaggtaataatttctctgccgtcactttctaatactccctccattttaaaatgtttgacaccgttaactttttatacgtgtttgaccattcgttttatttaaaaaatttaaataattatttattcttttcatatcatttaatttattgttaaatatacttttatgtatacatatagttttacatattttacaatttttttgaatataagacaaacggttaaacatgtgctaaaaagtcaacggtgtcaaacattttgaaatggagggagtactgtttccttggggatagcattgagctacaggggatgaatttgccaccacattgatgtgaaatcaccttggttggactgagggtctatgaggttatctgatctggtaatcctaagtagagtagttagggttgcttaattgatcctgtagccaatgggatataaattatgaatagctcgaaaatatcatttattttcctgtaacaagtactcactactttattttttagcagtaagcaacatcatttcagtaataacatgccggggaggaaagctgcttgacttggcaatctgaactctcaagttttaagtcttccccatttgcatgtcttctagaatacgttgattcagcaaggcaatgtgatacgacattgaagttggttgctatcgttcgttcaatgcattgttctttttccaattaatttctctatcgctgatctttcgctgggctgatttattcagaaataacaactgcgcaactataccttgtagtgccttacagtagcagtcaatactgtccagggaaagaacattacaaaacaaccttgagccatatcccctctactctagccaagccatggaacacttatctccccagaaattgatcctgccattaggtatactactatcctcacttgttctccttcatgccattgccgtgccatccatcgatgagcaagctgcagcgcttattgcctggaagaccaccctgcaaacccagcaacccctgcagtcgtgggatagcaaggcatggccatgcaacaactggcgtggcatcaggtgtggcacactacaagggcaaagggtgatcaccaagatcactctgcacggagtgaggcttagaggctcactggaggccctcaacttctcggccctgacgaccctgacaagcatcaacctttcacacaacaggcttacagggatgatccctcagagtatcatgtctctcaaagagctcagagccttgatcctgcacaaaaatcagataaggggctccttattccaactaggtttaacatctttaacaaagctgaggttcttagtgctaagcaataattttctttcgagttcaataccaaaggaaatatgtagtctaaaaaggcttgtgagcctaaacttgtcaagcaatcaactgggtggtcatataccttctgaaattgggttcctcagtaagttgattagattggatttgtccaacaacaacattattggtcgtctagacagcttgttcatgacaaacaagccaggtaaatataacaataaatcatctttgtcaaatctaaaggttttagcactatccagtaaccaattaactggtccaattccccatgagttgggagatttagtgttacgccccgaactaatcccgaccggaactagcccgtgacgctccaaattaacctgttaatcgataccagtcccaggaaacagtgctggtatcacagggagacagaatatcacagcaacagaggtctctttattatagagtagaggtacagtcatgttgggctgcggacagatcccgagctcacaactgcattacaaaagggaaacggaagccaggacttggaccaaacaacacaggcgcgacttgggaactagaccgaaaccctaaaactcatcgtagccggcttgctcctggaagaactcctcatcagcaggttccgcttcatcttcttcagcaactggggggggggttatttatatagagcaagggtgagtacgggagtactcaacaagccatgggaaataagtgtttaatgcaggcttcaaggaaaggctgttgtttttgcaattgattttatttgaactcttttctaaaaacaactaagtgagtgcttctcaaacgacacggatgagacagtgcgtctcgtccggtcggagtatgtgcaatgtatcagtctttagaattgaaacaaggttggcacccggccgatagcttttcaaacggccacccgggccaacaactttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtgggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctccctgataagctagttactcagccaggggtgtcccattccacccatgtggtcgtacttgtcttatgtttggatgaaattccaaggaaacggtccttaggtgcaagagcgggaaaccgtacacccggtacgttccccggtccgcggttttggaaattcatttagttcgcaagcaccgacccagtgtcgggttttccaagtcttttgtaaaacccaagttttacccaagaaattactcagattttaagtttgaaggcgaccgtcgatactcgcacagggtgcacgaatatcgaggcgcaactagatggttacaaggggacatgatataacaattaacaaaggaagggtcaaatgcaacgaattaggtaggtctgccaatctgccttgcagacgggacaacagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactacacgcgaaatgggacaactcaacaaacggcgaaaataaagccctattaataacctctaagcgtgccattagatagatctcgagatttgaggaattttggaagttgaacggagtcaatcggatttacggttgggaagatattgaatttctaagattattggatttttggtctaaaggaaaaggatttaattaaatcctttttgaaaaagaaaagaaaagaaaagaaaagagggagggaaattagactttcctcgggcggctagggcgcggcccgagagaaatggggcggctcggccgagctaaatgggccggccggcccaaggcggcccaaggcggcccaaggcacgcgggaggggaggagagagagagccggtggatcgggctcaccacgcgtggtcccgggtgggacccgcttgtcggtgacacggttcaccgtgcggagcgagcacgcggcgcacgcgcgcgggcgggggagggacgcggtgcacgcgcgcggttcgtggtggacgcggatgcggcgggcccacgcgcagcctcacggctcgcggtggaacgcgcgcacggggaggggctgaccggggtcggctcgacccggtcttggccgagctggcgccgacgtggcgcctacgtggctgccacgcgggccggcgggaggtagacgacgacgccggccggaacggacggcggtcgacagcggcgagcggcggagcgaaccacggcgatacaggcgaaagcgagcacaccgggtggttgctcaggtcgaggggagacgagccaacggctcggattcgtcggagggagcttgacggcgacgaattgcggcggcggcaagcggcggcgggagaagggggaagcggcgacgaggtcacgaggggccaattcccggcggtgagagcatctacgcggctacgggaatccgttgctagcgtcggattgggcggagctacgccgagcgaggccggcgacgagcgagtgctacggagcacgggcggcgacggcggcgagcacatggcgagcggcggcaacggtcggggcggcgccggctagctacggggaggctacacatgctactaccgaaaactaagggggagagatggagcgaggaggaagaacggagggaggcactaccgtgcgggcgggcgcagtgacgagaggccgacggcgcgggagtaatctctccggcctcgggccggggaagaggaaggagagggcgcgcccggagtccccttccgcgtccacgaacgcaccggctctcccggtgcttggcgatgaacggcggaggcgagacagagcacggaaggcggcggcaatggcgcggtggcggcgagcgaaacgggagggggaatcgatgggagggcgccttggtttataggacgacgatgtgggtttgggaaccgaccttgggcggcaaggctcgagctggcgcccacgctcttgtccaaaacggtgacagaggcggatgacgccggcggcgaggggaaaaggaaaagagggagagaaaagggggcttgcccccttgcctcttcgggaaaaggaggagggaggggaagcgacgcggctaagggaggaggagctctgcctccgtcccttggaggctagcgcgggagtggcggggccgaggcgatgacggcggggcggtttggagcggtgcgacgacacgggcggcaggcgcggcagaggctgacggcggcggcgaccaggcggtcggccaccacggcacgcgcgcgcggaaaacaacgggcggcgcggctcgggcacgcgcgctggctgcggtgccgagcggctgcatgcgcggcagggccgcggggccgggcggcgcaaacggtgcaggcgcgacgcgggcgacgaccacgcgggcgcgcgcgcgaacgacgcgcggggagcggcaaccagggagcggaaaggagggctcggctcggcgcgggcggtcacgcgcacgcgc

SEQ ID NO: 67899 - DNA, 32243 bp, Oryza sativa
gaggaagcagagtgtcttggtctattttgcgtacatgtacattcaatagtattacacttagggataaaatcttaaccactaatttattatattttagccgtaaaaaaaaatctgatagttttaagattgtaattatgtcagaattttatcttctttttactctatgtataatgaattttaaaatgcaactttgcacgtaaatgtaatactattggaagtacatgtgtgatttttttaagaattttttatgataatttttagttggtgtacacggtgggtacacacgagggtctgtgtgcataggatacgctcccgtaaactgcggacatcacttatgtgtgtgtgtgtttgtgtgacctggcctttgtatgaatggaagtgatatccgcagtttataatttgtatgtatatatagcactggtattatggctgaagatcgagtagagaagaagaaaaaaaagctagtagaggttaatactagtagtagtatatagttaaaaggaggacatgcaaaggccattttggtgttaaataatggagtgtaagtaaataaaaaggaagggggggcggcaggcttcacacaaagctggcgcgcacacagacgcatagcatatataggatgatgcgtgtgttgtattccatcatcatcaggtagcgcgcgcggatagatcatatctagcgtggacgatggcgaggcatcggtggtatgtgcaggcggtggcgctgctggtggtgctgaaggcggcggcagggtctgcggcgccgccgacgacgacgaggagcaggagcagcagcacggtggtggccgggatggtgttctgcgaccagtgcaaggacggcgccagaggcctcttcgactacccgctctacggttggattgcttttgcatttgcatataaagatactacaatttgattgcaataatccatgatgatcgatgatcatgggggcggcggcgtgcttgaggcttgagcaagctacctgtccgtcatctactctactgtgtgcagtgcatgctattctccttgcctacctaacctgatcaattagtactttacttcctttattattctttccttcagaaatttgtggttaatttggatatgctgtaaaatggaaggaatgcatttgtggtgggtgcaggtgcgcgggtggcgatcgagtgcggcggaggggagagcccggtgacggtgcgggagtgcaacaccaactggttcgggggattctccgtccgcatggagggcacgcccgagatgaaccgctgcacagcgcgcgtcgtccaggccaccggccactgcggcgccgccatccccaccgcccctcgcgacctcaccctcgccttccgcatgctcggcctcgccctctacaccgtccccccactcctctcccagccgctccgtcccatggacttctgcccatctccattaacatctccatctcctcccgccctcgcgctcgccccctctccgattccgactccaatcatcgcgccgccccccgtgtcctcgccggctccccctctcccgcccctctggcgccgcaggcctcgccgcctgccgcccatctggcgcccgaccccaccctcgctacccgttgacaccatgccgccgccgccgccgccaccgccaccgcagccgcagggctccgcctgcaccttcgagtacgtatctatctactagtccttccttaataatttgaacaacatatagatgattaatgaaatgaaatggatcgtcagcaagtgggcggacgttggattgcacgggtgcaactggaaggtggtgacgcccaacacgacggtggccatggcgttcggccccgccgcggcgcagaggtacggccccgacatgacgctgcgggaggcgctggacgggaggggagacatgtaccggacgctgctgcgggaggccacggcggcgctcctcaatgcctactacaaccccagtggctccggcttcctgtaccccaccaccgccagcgtcatcgaccacatcaacgccgccctcctcacccccacgctccacaagcttctcctcgagggtgcgcgcttccgccgcgccaactccgactccaacctgccctgccacctcaccccctgcaactaattactactcctgcttgcttactcgatcgctaatgcactcgtttttcattttattactcgctacgctaatgtattactagtgtctcgactcaatacttaattggtggatggattttaatactacactactactactggagtactatagtacaatcgattcaattttattattacttaattaactaatagtagcagaacatgcataccgtatgtactggaagcatcatcccttgaccagccaatttattatactccactcgcgcggtcaaaccaagtcaatacgacaaaagcagagcagagcagaggaaacgtttgctgttcaaactaatttaaacagggagctactactacagactactcctccactagaagtagaggaattaccactagtagtagagtagtacattccaattccaattacttgagtagatccttggattattcattccatcaagggttggattcaaaaactagacatccaaattcattcattaattagaggtaggtggagtagtaagtaaaagaagaaaaaaaacgaaaataaaagaaagaattaggagcagattgggcaaagcacgaggccgttctcgttacactcgccgcagcgcaccaccaccaccgcccgcgtcttgttgctccttgcagccgccgccgccggcaccggcgtggggagggagaagcagagcttgcggctgccgttgcagtcgaagcagggcaggaatcgcatgccgccgcatccgtcgcagcagccaccacctgggcgcgccctcggcaggccctccagcagcgccgcaagcttgccctcctcctccaggcgcgccacctccgcggcgccgccgacgtggttgccccggacgaacagccgtggcaccaggggcgcgcggtcgtggtggtcgagggagatgcggtggcgcaactcctcccggaagccgcggtccatggagatgtcgcgctcccggaaggcgacgccgtgcgagtggagcgcggcgcggacggcgttgcaggcctcgaaggtggcgcgcacgccgcgaagcgtggtggtgtagagcagaaccccagcaggaggagcaggaggaggagagtggtgcgtgggcctccgtggtttctgtggggtggcggggtcgaggagaccggccatgagctcccacgagttgatgacctccgcctcgccctgcttcttcagatgcttctccggcggggctgcacatggtgggttggtggtggtggtgggtcggggaggcggcgtgggcggaggaggaatcctagtaggggattgggattgggattgggattgagctgatgatactagaatgttgtcgaggatgccgtaggtggaggaggtgagggagacgatgtgggaggcggagacgccgatgatgcgccggcggcggtcatcgtcgtcgtcgtcgtccacgaacgcggaggcagcgcaacccatggtattggtattggtatggtaggaaggaaggattcgattcgaggatgattaaggagaaaggagagtgaagaagaaaggaatgcattcaaatttcaaaacttgaaaccgccatgccattggatggcactgtactgtactactcctacattactctattgggcctgcctctctggtcgttgggcttggcctactcctgcatcaccatgtatgggcctaacttaccatgctttaagatggtaccaccagttaccagaagtaatcatttagatcctctttattttaggcttttaaccgatcttttagcttactagacaaaaaaaaaaaccgtgcgttacaacggaaataaaacacgagaacattaagaaaaagttgagaaagatttacattatgtaattaattaaaatacaaatttcaccatccttcatataaagaagatatatttatattcctatttttatttcattcccattacatatgaaatcgcaattatacatgtatacgatgttgaagaaaataaagtatcatgaaaatcaaggtaaatatgggtaataaaattttccaaatattggaactaatttttattaaattctccatgattaattacattatctgattttatttttcggaattttctgagctccattactaattttaaccatacagacatcatttcagtttttatttaaatgaaaatctaaatgaaaaccatactttctctctgggccattttcagcccatttatttcctcagcctgtagccgagccggccctttttccttcggaaaaagtacatccaagatccctcaacttgtcatcaagatacaaaatcgtcccccaattgcaaaaccagataccgggcatccctcgagtaacaaaatcgttcgctttaggtccctcgtagttttaaccccagttttgtccgacatggtggccgagtctgcgtgggacccacgtgagccccacatgttaggatgccacgtcatctatcccttcctcttctatcagttttctcctcatctggtaggcaggctagccggcggttggggaggaagtcgacggggcgagccgggagaagaggaggttcggcggcggtggccagcgatcttcgatgcagcagcggcgacgaccacgcaggagcaggccggtcggcggagcgggaaggcgacgggcggagcggcggcggcagctgcgcctgccgcaccggcgtgccggaggaccgggcaagcagggggcagagctggcgacggcgcgggccggagcgaccgaccggcggagcagcccgcgccgtcgccggcgggcggtgggcaggcgtgctgcaggagaggaaggggctgcggcggcaggtagacgccgtcgtcgccacgttcaagctcggcagccgccgttgtactgctcgacggcggtggccagcaactacaccaccgacagccagtactcgctcaacctcaaccagctcctcgcactgaaaaatggtcaatgtgtggttaacgtgtggctttaactttgcagtccctatagatgaaaactgaatgtgatttggttttgtgttggccatctgaacttgtgaattgattctgacattggcaccatgtatgcaaatgcacaatactcggaggctgagagcaacgatggcttctacaaagcttcgctcggcacggcgcccgacgaggccttcgccctcgccatgtgctacgccgaccggaattgaacggaatgcgagagctgcctacgcgcggtggccatcgggatggcctccctctgcccgcggagccgtaatctaatacggactagtagtctcttgcctcattacacgtaaggggaaaaaagaactggtccaagctagtttttttacttaacagtgtaaaagtgtcttatgacttttcaaaaaacaacaaaaaaatcagcttattttgtttacttaatagtgtaaaaatgtcttatgacttttaaaaaaccaaaaaaaagcaacttatttgagtccaataaagagggtcccaaatccagctattcaattgctaggggtcaaactggactttttcctatcaatttattcacgatccatccatccatccggcccattaatttccttcccattaaggcaaagtgatgattactactccccatctcaaaataaatcgatttaatacttagatatgattaatattttctagtataaaaaatttagatataagcatatctaaatacgttgtatattagaaaatatgtcatctaatattagattggtttatttaagacagagagataagaagaagtaaagtactccatccgtattttaatgtatgacgttgttgactttttgatcaacgtttgaccattcgtattattcaaaaactttatgtaattattgtgacttaatttatcatcaaatgttctttaagcatgacataatattttcatatttgcaaaaaaaattgaataagacgaatggttaaacgttactccctccgtcccataatataagagattttgagttgttgctttcactgtttgacaactcgtcttattaaaaaatttgtgcaaatataaaaaacgaaaagttgtgtttaaagtactttagataataaagtaagtaaaaaaaataaataataattccaaaattttttgaataagacgagtggttaaatagtataagtaaaaactcaaaggagtagtaaaaatatcaacggcgccattcagagggagtagcagatattattgatacgatgaaacgatggatggatggatgcatgcctgccttacctttaatttttgcatcatcccattgattgattcgctgattggctcacccggccttccatgatcgagtagtaaattgatccatgattgcagcccaagaaagcgatctatccacagtacgcaccaaacccaacccccaccaggaggttatgactccgttcaggttcaggtgtgctacctatctgacgagaagcgcaccatgcaggcagctactcctactacttttccttgttcacatcatccatccatccatgttcaacctaagtggagtaataactatacttgcattaacacaaatgaactgctatagcttcatcgtgtaacacatatcacactccaaccaatcatacatgcaacttaaaaaaaaaatcgatattctaatgcccatgaatattacttatacgcaagtgggttttcaatggaaatttagtgagataagtgatgtgccgctaatttttgtctcttttaaacatgtgttagagggtatattcgtgggtgtgtgaatgtggtattgtgtgtatggtggtgtgtgcgcacgtccgccatgtaattgaaaaaaagaagatatatgcaactcccataaaaatatcgatatatcaatggaacacttcacattttttagattatttgttagttaactgatattcccgtaaaaacaatcattttttaacagatatgcagggcgatatcttactttgggctagagggaggctcattgccttcctcctcctccggtccctggcctattcttctttctctacctcatcttcctcttccctctctccttgttctctatatatggtgatattcagcgtgggtatgcatcggaccctggatctgccccggactacagtcaatgcacatgttggatacgacgatatagccatcatatccaacttaaagtttattttgcttttctctttaattaatttggtgcgacaacgacattacactaagtctgaaattggtggattttgccggtctcactacctttctccctaccggtatgtatgtgtgcactactattaccacacaatataatgtacgatcattaattatttgtaactatatatgcaacagatagatgctgatgagatgcaggtctctttcgtgcatgtcgtctaaagtgattacaagtaaagaaagaatctctaagtggatactatgaaatgtctatatagtagggtgaaatggatcaaattaatcccccggcctctagctactaaggctacaggtgcagtgtttcagagcaaggttaatagtatagcccactactaacttcaattcatctatagctaatttatacaatagttgattactatactataaatatatggtcccacctgtcatacacacactgcgttttggagttcgtgctgcaactggctacaaatctgtagcctgctgctcttctctctcatcttttatcttattaaaatatgtttatagctggctaatagtctgctattgtacctgctctcacaggttccattaatagccaattgcaaggtaattatcattagtctagatgagctgcataactagcctacgaccaggcctggacatgcatgatcgatgcatggcacaacgttgcaaatatgagtagtatttggtatttcaggttataaaatatttttgattttggtcaaagtcaaactgctttaagtttaacaagtttgtagaatagtaacatttacaaccgaagacaaatttattatgaaaatatattcaattactgatttgatgaaactaatttagtattataaatattattaatttgtttataaacttagtcaaacttaaaacagtttgactttgaccaaagtcaaaatgtcttacaacttgaaacagggggatattattttcaggggtgggggtggggggaggaagaagggattgccgcatgtggggtctaacaccatgttgtccattttgttttcatgtatgtgccacttcagaccgaaaccgccatgtacttattaagagttaagatatgagagtagttcatacggtttcaaaaattcacaagtgttaaatgtctggtgttaatgtagtagttgaggagtaaatcatgcttttttaggatcacaattaactgtacatgtacaatcttccctactactgcaaatgttctatatatcctccctccgtttctaaatatttgatgctttcaaaattttaaaatatgtttgaccgttcgtcttattcaaaaaattaagtaattattaattcttctcatatcatttgatttaagtaattattaattcttctcctatcatttgatttaagtaattattaattcttctcctatcatttcattcattgttaaatatacttatatgtatacatatagttttatatatttcacaaaagtttttgaataagacgaacgatcaaacatgtgctaaaaagtaaatggtgtcaaatatttagaaacggagggagtatatatgaccgcaaaaatgtatatgtgtgtttgtattatttgtaagatttttttaaaaaaataactactgcatagagtatatgcatatacatggtgaatggttagatatgtaagtggtaagttcaataattacatcctcaaaatattttatgtttttactgtaagatttggttaaaaattatccttaaccgtcaataaattatcaaatgtctaatttaaaaataaacaagataaacttgtgttaaatttgtataatagtaatatacaaatttgttagttggaattaattataaatttttgacagaatcttgtgttagacgttaaatatttataaaccagccaaatgaggtaatagcgaataattatatctaaggcatatatgagatatttagttgagtccattacaaagaatttaaggaacatagtgagaaaaagtaaaaacggtactatatatataatattgtgtttatatttgggacggagggagcaagtagctagcctcttaaataagtatcatcctagtgggggagtaccatctatctatcgatcttcttccacacgcgcgtacgtgtgtgttggtcgtctcaaggttagttattgaaacgtatgtcttatattactaatttgtttcatccccgttgtatatgctatatatgtttttcttatcttatgtagtatatgtaattaaaataaataggagaagaattaagctggttaattattttttctggctggtatatgcataatagtaatatatagaagagattgtgttgcagggtatatatagcaaattaataatagatagatcgatcgatcgagtggagacgatgttgccgagaagccgaacgctcccgccaaggattcatgatggcgtcgtggtggtaagcaagcacagatgttgcagtgttggtaatggagcatattgatagatgctagctgcatgcgcgcgcgcgcggggtgatcgatatatgatatgatggatgctgcaggtagaacgcgatgtgaggaggtaccagcagctgccgcagcaggtggagatggagatgacgacgaccaagaggcagcaggatcatcaggtggagacgatgacgacgaagaagattgatgaagaagatgaagaggtggacgacgacggtcgggcgaagcggagggggacggtgtggacggcggcgtcgcacatcatcacggcggtgatcgggtcaggtgtgctgtcgctggcgtgggcgatcgcgcagctgggctgggtggtgggccccaccgtcatgctcctctttgctgccgtcatctacttcacctccaacctcctcgccgactgctaccgcaccggcgaccccgccaccggcagaaggaactacacctacatggacgccgtcaaggccaacctcggtcggtcgatctagctccttggatcttgcatagtactagtatatacactacacagatcgagatatctgatccatcaatatatcgatgtgcaggcggtgccaaggtgaaggtttgcggatgcattcagtacctcaaccttttgggagtggccatcggttacaccatcgccgcctccattagcatgatgtatgtgcgtagttgttatattttgggagaaagagagagagagagagagagtaataataattaatggaagaaatgcatggtataaatatgcagggcgatccagcgttccaactgcttccacgcgagaggagagcaggatccatgccacgcctccagcaacgtgtacatgatcatgttcggcatcgtccaggtgttcttctcccagatccccgacttcgaccaagtctggtggctctccatcctcgccgccgtcatgtccttcacctactccgccgtcggcctcgccctcggcgccgcccaggtcgcccagaaccgcacgttcgccggcagcgccatgggcgtcgccgtgggcttcgtcaccaagaccggcgacgtcgtcacccccgcgcagaaggtgtggcgcaacctgcaggcgctgggggacatcgccttcgcctactcctactccatcatcctcatcgagatccaggacacgctgcggtcgccgccggcggaggcgaggacgatgcggaaggcgacggggatcagcgtggtggtgacgagcgtgttctacctgctgtgcggatgcatggggtacgcggcgttcggcgacgacgcgccggggaacctcctcaccggcttcggcttctacaagccctactggctgctggacgtggccaacatggcgatcgtggtacacctggtgggggcgtaccaggtgtactgccagccgctcttcgccttcgtggagaggagggcggagcggcggtggcccaacggcctccccggcggcgactacgacctggggtggataaaggtgagcgtgttcaggttggcgtggcggacgtgcttcgtggcggtgacgacggtggtggcgatgctgctgcccttcttcaacgacgtggtgggcatcctgggggcgctcggcttctggccgctcaccgtctacttccccgtcgagatgtacatcgcccaccgccgcatccggaggtggacaaccacctgggtcggcctgcaggcgctcagcctcgcctgccttctcgtctcgctcgccgccgccgtcggctccatcgccggcgtcctgctcgacctcaagtcctaccgtccattccgctccacctactaattaacgatcgatgattgtgctactagaaaggaaataggtatccgatgtatcatgagcttgggctggccataacgatgcaatattaataaggcctcaacccacaagatgcaacgatggtttcaattataaggttgggctagacacggttcatccacatatactagctttcaattactaagtattcttattttcttattgaaagtcgcttgctttttttacacgacaatgcatcacatcaacaaaacatactactagttgaaacctcatgttttactgcggaatttgaggtgaacactcgtcttatgggaagatttatagaacaaacctacaaagggattcacaataaggacatacgatttacatcacattaaaccactaaataagtagaaactaggataaaatgtagaattggacaacatgaaaagtcaaaaacagatcgatcaagtgtttgactcggaaagatcgatgggttcgtggggcgcggcatatattagtctatggcttcatgccagtagtttgcacacatcccgtacgttcgagatcaggccatggcccacgggagtgcgtgggacatggagtacataatgaaaggtacggtggcccaaactcgatcggagaaggcacgtacgcttccggctacacgatcgagcggcgggacgcgggatgatgcaatgcacgacgcgaaacatatatatatatatatatatatatatatatatatatatatatatatatatatgtatatatatatcggtggatgaaaaaaaggtcaacggcgtcatacattaaaatatggaggtaatagtagctagagatagaaattttgacataaataaataaatttgtcctattgccaattctaattgtcaacaatatgttgtcaaatatcttccgaaatgccatggatatgcaagaaaagtatgctgtacgtaatacaccaggactagatcaggttctttaattttacaattaattaaatgcgtggaattctccgttattagaaaataaaagacgatgaacttcctgcctgccatgatatgagataatgaagtcacatctctcaacagagatgatcgatcgatcgagtgctcctagcttgcccgcagccagcacagaaaatcagcgctagcttaattagctagctatacgtggatgatatcatccattgcatcatgcattcatcttcaatcacacttaattagtgccttcatctctttctttctagagacgcaattttaaattaaaaatcggtctccgtacgtacgtcgtccgtcgatcgatgcctaattgagcacgccttaaggtaagacaagcaccaataaggaaaatattatcccttgtgtgtcaactactaacagagaacaaaacgttctctgttgatgtgtcaatcgatccatgcatgttgcttaagccaattaagacaaattgccaaaaaagaaaattaagactttgcttgtccccctcatgacaacccttaattaaggtgcactttgatatagtttatacatgatactggaaggacagacaaaagtaatgttccttgcaatcaaaggttatttcctgatacatttacaacataaattatcctttcaactacataatccaggaaacaagtttgattaaattgtctaacattatacataatattttcgagcattgctccggtccagcatattgtacctcgaggtaccaatttaaatctggccgttcattcacggagggtaagatagaaaatatcacacgctaagcagctcgtgatgctccttctctctgactgagtgactgtgtcaacgaagactccaagagcaactgagcaagtccaaaccaagagcaagggcgtggtgggagcgggacgaggggtggtcggcgccggtggtgccggaggcgttggcggcggggtgttggacggcggcgcgttgggcgccggcggtgtctgcacggcggcgaggtaacgaggagcaggaggggtggtcggcgccggtggtgttggacagcggcgcctgcgtcggaggctgctacgcggcggcggaggcgacgaggacctgcgtcagttgtcgatgtgctcgaatccggtagcgataggggaagggccgcggtaggcgtatgtcaccggcgagcttgggggaagtgatgcacggaggctcgtcggccccctccacctccactccggttagcctgtccatccctggtgagagccatcgatcaatgcaggcatgcagcatcttttggagagagaaaagacaggaggaagatgaagaagatacatgcgaaattacttaactacccttgcttctttagtacctctctatgctctgtaaaatcacgtggacaatactactaggtacaactctttctcacccgttggatcaaacgaaatcgatggctcaaattgcatgtaccggtaggtaccaaggtacctgctggacagtaaaaattatcaatattttcatgtgttccaactcttaatgtatgatgctatcacataaacaacatgtcttttataccggtttgggtggcgtagtacctacgtaatttatgctaaaatctatgtgattttagaaatgacatttcaattcatctatttattagcgggagttggggatatgcccccatcaccttttttttatgtctttcttcttactttaagatttttttttactatgtacccattggtagaactagagatgtaatccatttctattaaactttaattaaattagagtgacttcttcaataaaggatctttatcaggaggggacgatctcaagtagctgccttttttttttctttttaagagaacgctataaaattgatcatatattgaaggacgaaacaaataatccacgataatataatcagataattaaaaggatcagatggacagagggagagagccaaacatagaggggcgggttaatcaggaggtaagaacaagtggagaagacaaggataagagatgagaagagcaatgagctatgtatcaataaaataattgatgacctggcagcttagcttaattagtgcagctggaactgataggcgcgcgattgatagcttataaatcgaaggagggggaaggcctcatctccgtgcatctcgctacctaacctagctaacctcctctcttcttcttcttcttcttcttcttcttcttcttcttcttcttcttcttcttcttcttcttctaggctagcactgcacgtgcccaactaacacatacattcatcatatatacacctcctcctccttcttcctctaagttgtgtgtgcatatataatctactagtagagagcagggctaggctagcaattgcaatggcgcctccctatgaaaccaggtcagtcagatcagaattatatatatttatgtactaattcatgacctgctagcaactagatagtaaaagagttataatctatatatatgaagaaattgaaatctcggtatatatgtatctgccttaatgcatgcagcgccgccggctctgaatcgccggtgccggtggtaacggtggatgtggcggcggcgagcgaccttatcacctcggccggccaccgttacgtcgacgtcaggtactactacctatctgtctgtctgtctttgcatcctcccctagctatatctatcgatatcatgtaggagtatatgaatatcaggatatatatgatccatccttaattaatttcttcatgcatgagcaacgagagcatatatatatacctcctaattaatttgttggagaaatgaaattacagcacatgcatgactatgtgtgctggtatcttcgtctgattgatagagcaattaaacatgattatgcaggacagaggaggaaatgaacaagggccatctacacaactccctcaacgtgcccttcatgttcgtcacgccgcaaggcaagtcagccagccgattaattcactttaatctgtccagatttttacaccatttttcatcgtcgtccaaataactagcgtaatcaatatatatactcttatgattcaatactagtactttaagaatttggaacaagaaattctgtctacacatatcgatctcgttctcgctcaaacatatccatccactcctatcattttcatgaatagtaatttcccactacaaaacgatatactactatatgcatgatgcttctggttgttgggttgtgtctgtacctgggcatgttgagcatctgatttatgaacgtggacgtgtgctcgtccaggtacatacggggggagtaattaacaagcatgattatatttatgagcgttattatcatccatgttgcagggagggaaaagaatcctctgtttgtggagcagttctcgtcgctggtgagcaaagaggagcatgtggttgtggtacgatacgaattaaaattaaaattccccaaaaaaatatttatttgacaagaaataatatatgtgctcgatctaattgacgaaccttgtaataaaaataaacaatccaactattaggggtgccaaagcgggaagaggtcggagctagcatgcgttgatctccttgaagcagtaagtttgatgtttttaatcaaacacgtactagttgcacttgtacttgatcgaccatcatctctctctacgtttctcattgccttgttgatggctctgtctcttgttccctgtttacttcccacacacaaaaaaaaaattacaccatatcacatagaacatttgaacacatacatacatgattaaatataggctaaaaaaacaactaattacgcagattgtgactaatttgcgagacaaatcttttaaacttaatttctccatgatttcacaatgtgggctacaataaacatttgctaatgatgggttaaataggctaaattcgtctcacggtttactgacgtattctataattagtttttttattagtgcccaaacacccatgcgataccttttataatacccgatgtgacacgccaaaactttacacatttgaatctaaacactcccttaatatacatacagtgaaacaaataaagtaaaggaagacgggacaggtcatgattcatactcctcgtctaaaaaaatgaatatataactggatgtaacatattgtagtataacgaatctgaacaacgatatattcagattcataatattaaaatgtttcacatccagttttagattgattttttatagaatagattggttttttatggaacggagggagagtacgagtgagttgtaacatgactgacatacagtatatatgtatctgcaacaggggttcaagaacgtgaagaacatgggaggaggctacgcagcgtggctcgacaatggattccccataaacactcctcctcatacaatgtattaacgctttgcagcaccgatgagatgagcgagtgataaacacggactctactgtatctactgtatctcattccaacccctcttctcatctgcctgctagccgctgcttcgtgtgccctgccatgtatatgtatgtgcgtcctgttttcctgtttgttactactggtattatggaggcagccaattgaataaaattgatcatcatgcatgcaatgcacgatgcgtctgcaaatctccgggatgacatcaatcaaccaagtagctacacatgttcaaggactttattatctctaaatcagcatattgtggccggtttgccaatccaccataacagtaggcgtgaggcagagcctctggttacaaatccaaacgaacgactcataccaaaggggcaggccaccttatgcaagaatcatcaatcaaacgtttgcttctcttgccatctgctatgtgctgcgccgttggcactaaagcattgattgatcgatcacctcaaaaattacagtctcacatctcagactgccggttgcagggcaaagtgtagagaaaccaacatccaaacaaatgaagaccacacatcacacggttagatgtgcaattagctctttctttggacgtccatcgccacagccagatggcgagctccacaggacaaacaaattgatgactacaataagtatgactcaaccacggtccgcccaaacttctgctcaacatcctttggcgtttcaatctgcaaacaaagcaacatgacaaatcatttctctacttgaaaaaaaaaaataaaggaagaaataaatattgcccaaatgttgcaatgagaagctaaatatatttcgagtaacgggcactcacggcgtttaatgctatgaagagagctttgataacattcagggggttccttgaaccaataatctgcaagtaaaagacagaaaattactactatctttcaagcacggatggagtgataactggttgcctatctagaagaagtgcacctttgacttgacgttgctgaaaccagctaaatacagtactgtttcaaccgtcctaccagcagcagacattccacttctcattggtccaggccagaggtatatcttaacatacacaagcagcaaccatgtccacataagttgcagcaaaaccacagataaataagaagagcgctaagatacacagatgtgtttttacctttgtcttctcatatttggcctgaattgcatgagcaattgtgtggtcctcatatcgctccatgtaatggaggtcctggaagcatttctcataagcctgcaaacgaaaaaaaaaatcaataaaggtattggatgccagcaagaggcataaattagctcaggtattagtctaatcagatgtccaaacccgcaattgaggatcctcgacgacaatatataagaggaagctactggtatagggccataagaaaaaaaaaactctactgcatctagtaataaatcctgcattaacaaggatataaatgaaaaaggttctgaaatgagaaaaaaggcatatgcagtgcacataggttagcaccacaatcactgcacaaacatcccaaaagaaaaggtgaacaagccaacaatgaaatggataacacatcagcgactattctttgcgcgctgaatgagaaggcaatcataaagtcgcaccgactacaagaaaaggctctaccaaacaagttgtagacgtggcactgaaacgtaagttgaataagaaagatccataccctttgaattgcaatcttggctgtcggacctctagcttttgcaaatcctacaacaccatggtagtttccagtcgctaacaatgctgtgaattttgctatttggcctccctgagacgtgaaatgcataattgggtaatgggtcagacaaaagggtattactagtaggcgtgatcatttgaattcgaactaagagaattcacctttgtgactttacacgtccgattaacatcaatgaccttgacgtcaaaaccctgtaaagtgcacaagatttgtaactaggtaataccaataacaacaagtgaaagcaatgtaaccacaggatagggtgctggccaatccaatgaaagctcggagatgaacatcacttactttcctgtacataggtctcctcttatgctccgtgagggagttgcgctcttcaacaagatccttaatttcctcctctagaactctgcccttcttaccaaacgtatgatctaactcagctaatttctcctcgatcttcttttcgatagaattcaacttctctatgagcagatcatccttctccttgtcttcattgaattcctcgtcgtcgtcgtcgtcaccagccccttggatcatctgcttctccctgtcaaagccagcattgagcacaagatcctccggagagccgacctgctggtgttggatgaccccgaaattggaggggttgctgggatcgtatgcttccctgcattccatgattctaacagctcggttaagcttctggaggagaagaaagcggtccttgccggtggcatctttgaggcggttcatcatgtcgccgatgactctgtactccagtggaagcttcaaatggcgctcctcgaatctgtcgatcttggtcatccatttgtgggcatcgtcaagggtttctggcaacagcgggaggtgtttgaagtgggcattggcgaaggaaggaaggaaggaaggaagaggggaatgggctttaccggcttcggcgaaggagcgtaggagttcggagtggcggttgcacttgcgctcgaactcgtcgacgcggcgcttgatggcgtcaggggtgtagcgctcgtcctcctcgtcactgtcggagtcggtgggctcccagaaggaatcgtccggcgcggcctcctccttggccctgcggcgctcgagcttctcgatgagcggcttgacgcccaggtagtcctcatcctcaccctcatcctcatcctcctcctggcggtcccgctggcgctctcgctggagctcggcgaagaggtcgtggatgacccgctcgctctggatctgcttgagcctagagctgccggaggaggcgttggcggagaaggcgaagtggcggcgaggggaggcgatccgcagggttagatggtgggtggaggatacgggagggctggggcgcagggagaggaggcgcgcccacgcggcggaggcggcggcgcgggaccgggcggcggcggaggaggccatgaacctcccggcggcggaggaggagaagggttttggtagccaagtgactactggaccttccggactatactgacttgtgtgtcggcctgcccccatctacatttcttagtggcccatctatctatctatctatctatctacgaataagttcatttaaggtcctttaacttgacagcgcgttcgattttatccttgaacaaaaaaaaaatcagatacaacgggtccctcaattatcaaaatcggtacaatataggtcccacgacagtatatcgggtggttttgtccgccgttgcaatctaagtcagcgtgcgcccaacatgtcagggctcccctcacccgttattctctctttctctctaccctttcccccttccttttcctagtctaatactccaataccatcaatgatgaagcagggttaaggatacctgttgggagggtgggggatgaacatcggcattggcacagcccctcttccctatctttcgtttccaacggctgtaggatagaggtagctagcggtggtagaggcgggacacgacgaggtggtagtagtgatagccgatgaggagcaaagggagaccaaggcccgcgacagtggtgtcgacatcttccttgcaactgacattgtcgtcgttggctcgtcttgtcaccatctccctccgacgcaatggtgcaaccccatattcgcatcgccgttacatcagccacacgaaggaggaggatgaagggagctcaccagcgatgaggagcagcgagaatgaggacgggcgaaggaggagctgctggaggcctggagcgaggtgacctagtaggcaagcagtggtggcagcgggcgtcgggacagggcgcaacggtccatggatgtcaattgtcgtcctcctcaccattggtcttctctagtgacgctttcaccacctccaccgatgctaaccctaacgctggtgctgccatccccacctctaccgatgaacatgccaccccctctgcccatcacatgtgagcctaccaccaccacccttgacgtcatagtcggcctcctccagctccaagtccccccaacaactggaccgtgctggccaatgagatgtgaacaaggggaggaagagagagagagaggtgaagagagccctgaatacgggtcccacactaactcacacgctgttgactcaggttaaattgtcacgtcggacaaaaccatcaattatactgtcgtgggatgtatatttgttaacagtgaaatttggtaagcccggagtaatcatcggcttagagtcagcatcgtcttcgaagtcctgagattagccgatgagagttgccaagtcgtcagttgtcgaattcttgctatattcagttaaggaaattgatctactaaaggaagcttatccagaagagaccgagttcaaagagaatacggcacgacaagttatctattaattaggaatagtttattagtttccttttatctttaggaaagtgtgtttagtgttctataaggactttatcttttccttttatctttaggaaagtttctttcttgtccgacaaggatttgtatcaatccatgggtataaatatgtacacccggggtctatgtaatttatcttcacgatcaatacaattcggcgcatcgccaccttttaccttttctactttattttatcgtccggcgggacttggcacctgacgcggggctgcatcggtgttcgatctccagagaaggggtaagtccaatgttccgtcggcccaggcaattgtctcatctacatcggcgtcgttcaaggctgcattagtacattcgacctcttggattgctctggtttggatgatatatttgcttacctatttatcatatgtctctgttaatctagtcttagcatatcaatttagctctatcggctgcttctcgttttagggtttctgccggtatcggctaaatcttcatgctagattagattagcttagacatctaccaccctgaaaattcagtcgacggcttgattgtctagatattgtgtttcttttcatacttagtgctgcatcagttaagtttgatctactaagtcgtgcttagaaccataatctctagcctgcctttgactgccaataagggtttcatcggggtttcagccgatgagttatctaggcgttgcatcgactcataaggattgcatatacatataagttggatttagccgatgacaacaaatgtttcactgtttaatctaatattgtggatttcatgacatcggacctccagccgatgtgtgctttaaccttcggatcaatgcctatttatcatatcattatttaccgattggtttatactagattatattgttattttattacatcatcatcagccgattgcctttatatcatcatctacattggacatatagccgattgcttaaaccctatctctatcggctggtataggcatcggctattatcgtctatcggctggaactactccatcggcttgtcatccgatcgactgttttgatctactatttgcatatcttgtcagttgcaggatcaaactgactggcacgcccgcatctcaccaatctttggacctgcacaagagctaagcagatctcctaggccggtgtgttcgattttttcgtcaacaatattacaccggttatgacggttgagtgatccgttatatctgtttttttttttctgttaaaggatgacatcagactcgttgtcaagttaagggacctataatgaacttatttcatctatgtatcacatatagaatatgattggggtccagcccaagagagtccgacagatagcgaggaggaggaggagattagtgtctacaaaagagaaggaaggaaggagaggcggagaggaaagagaaagaggatcgtctcggctcgtcgtcttctagctagggttcgtaagttctagggtttgcgatgatccccaactcctcctccctctagtatttcgagcgaattctccaacactttcacccaaccgcgcgcgagaggagaaggaagatagatagatagatcgctccgcacatactatggtgctcaccccatcgccgtctacaccgccgatgctccccaagaagctccgcgcgctcggtcaaggcttgaatccctttgctcccttcggcatgggtaactactattcctcctctcgctaatatatttctcctcgctcgatccatcttcccccacctccccccttctcaaacaattaatccccttcccgattcgattcgattcggttcggttcgctttcggactcggtttcaatttcgattctccctccgtcgtcgcggccctattctagccgccccctcccctccgctcgattgcctgcctccggatggtgcaattccgcagctctctcagcatgagccgggcacggacccgccacggcgatggcgacgaccgcggctggaaccagctccacgtcgcctcccgcaagggcgacctcaaccaggtaatcctcacgttgtcatctcttacgttttactaactgctctattataattatattatgcattggcttattttctccacgcagcaccaccaccatcgtaatgcttctttaaagataacgcatactcttctactacatagattataacagtactgaatgattatagaggagggttaacaacaactcataatttgaatcaaacaacaaggaatgtaaccatctctgcaaatagtaataaaggataaatactacgagtagtaaattatcattagtcgccaaataaattagccttcatgtcatcaccattgaaacaataaatttgatttttcttttttttcttcctaaggtgaggcgtctcctggatgatggcatggatgtcaatgcacctgcatgggggccaaaatcacctggcgctacccccctgcatttggctgctcagggtggacatgttaaaatcatggacgagctactggagcggggtgcaaatattgatgctcgcacaaaaggagcttgtggatgtaagctcaaatgtttcttcccagtcattgcatgcattttcatgcttctagagcttgcctattctcttttatttacgattggtctgagagcagtttctatttattattattacatataaagaaggtttcatgcccccccttgttttcagtcctctgttgagcagattacttctatattcactactgctgcttgattgcacaccccatctagtttagtggattgacttgtttttattcaatcattataggagaccatatccttgaatgaaagctactccatgtttcatatactcagaagtttctgatgtcttgctcattagatcgaaacgtacaagtaactttctcatgaatggtgtatgtcttcatttaatacctgcaatgttgtactatgcaaattgcaaataccgtaatgttctggatgaaattatttatttgctcagttttctgttcccaacttctccagtggttttaaatttattaaaacaccttgtacactcaaagaggaggtcactttacctccggaatcttacattttcctcgtttggtggaatcagggacccctctacatattgctgctaaggaaaggaacaaaagagctgtcaggtttctgattgagaatggtgcattcttgccacctgacatgaatgaccacaggttcaatcctcctctccattactgctctggattggaatgggcatatgagatgaagcgcatgcaagacgaaagtgattcgaccggtgaaacttctctgggctcggagagctagaggaaagcaatctcctcagtctggcaaagaggtcaatcttggatcaacagagtttgtaaacatcaagggtcacgtttactttgtgaaattggaacgaattaccatgtgaatcttacatgcgacatggtactagcatgcattgcgatgttgttgtggggttacttgtgttttcgataattgcattgtgttcttactacactggtagcatgtattctactacacattcttaatatcagaatcaatatccggtttgcgtcctatgacagtatgcaatgtgtttcttttttgatgttgttgctcttactaagaaataggatgtgttgacgcttatcaccggaggttctactactttggctgcaaggtcgatggagccacatacgatacgaatttacgctcatcgtcaattcatcatcattaaaaagaaaaaaaatcagcaatagcacagtagcagcaatattcattcatatcaacgggcagcagggtacagtggattaataacgaaacaagtcaagagtcactagtctacatacatgaaaacgctgccccacctatgaaaacttgagccgagctactaaagttcgctgcaatacatcatgcttacgagttaacaccaccggcatgcatccatccattctgcacacaggcaaactaaactggatggaggtacataagcttagctcacatgcactctggctgctgaaccaacgttttggatgatgaacacaaagactccctggacttcctccatatcataacagcatacaatgagctgcccgtaaatctaccgcctcacaggaggtgcaccaccccgtccaactggaccaccaccacgaccagcagcagcctgcatcaattggaggtcaaaagattaaatgttgcgacaaacagagcacacatcaaaaaacagccttgaaggccagttagtacatgtgcataaccttacgctaaatacttaaaggtttgtgtaatttaaatatagatgcttcaaggtgatagatgaagggaaagtattaacagagagaagattaactttgtacttgttaacagttgacataatatttgtcagcttaatttcagaatcacggcataacgcaatttatattgtctttagtaggtttgaaactcaatgcatgaaatcaatggatttgcaagcactgattatataatagtagtagttaagattcaccagcctatatcatttcagaatcactgcacgatgggatactgtccttgttccttaatggagttaaaacagagtgcataaagttaatggtccttgagttgatagcaatatgatggaccatcacatggttgtaaacacattcacaattaaatattctgcattatatgttgggcaaatgttactgaaagaatgaaaagcagagtatggttataggaaaaggtaaatggattcattcagtcatggagtcacccatctagtaggttatatggtctaactgggcactggacagccaaccacgtgagcaaacaggcaattcaccaaaatatagggacacccacttcatgtatatgaggcaagcatgatatagtagaaccattttttggaacactgagacatgagcaattttgaatatggcactagggaattgtggcaaaataagaaaagtaaccacataataccaagcatactaatgactggatagaaacttcctttccttaaaggtaacatgactcctgcctacaatggttatttcttagagcagctgcagattgtcatgcaaaaagatgaggcaaagactccattgatgaattgataggtgtggctcagtttcggtttgcattatggtgctagggcaagatttagttgcacaaacactagctcataactctcctatctgaagatttatctgtctatgtcatggttagccatcagccggcaacgtgattttgaaaaaaaaaagaaaaagaaaaaaaagagagagatgtttttcatcagaacaacaaacaaggaccataacagttttaaatgcaaaggcttaaaattatttgcatgtactacactgaccagcatgagctccctgaaaatagaaatccagtgctatttgctttctctaatcgaattttggccaagcaatactgatgaatcaagcagtaggaggttagatgtgaaatcttcatgttgaaagcaagcagttgattacccaatggttatttctaagaggacctgctgattgtcatgcaaaaagatgaggtaaagaccccattgacaaattgatatgcgtggctcagtttcaatttgccttatggtgctagtgcaagattagttgcacgaaaactaggtccaaactgtcctatctgaagatttatctgtctatgacatggtcagacggcaatatgatgattttgaaaaaggatgattttcatcagaacaaaggatcaggaccattatcaatttttgcatgaactccctgaaaatgccagtgctatttgttttctctaatcgaatttagagcaagcagtagtaatgaatcgaacgctagaaggttagaagtgaaactatcatggagaaagcaagcagagcagatgattacccgagcacgcatagcaacggcacggccacggccaacaccaatagctgagcctttaccctgcaggaggcgagaggcatgtcacaatccaattccaagaggaggaggagaaaagagagtgggtgaaaagaaataccctaatcctagcctcgaggcgcttgaacatgggggcgttcttgagcatgtcgggtatgatcatgaacctgaccctgcttcctctgatgaagacgtgctccagctgggagaccttgccgtcctatacatatatatatgtgcacagaaagaatcaagaatctaagaagaagaggcgcatgattcgaaggaaggaaggaagggtaccttggcggtgaaggtgatgttgtcgagctggcagttccagttgtcctcgcactcgaccatggagccgcggtacacctcgccggtcttgagctccacggtcaccacgtgccccgccgcctcgtgcagcagcttcactgggataccaaggctgcggctcatcttcctcctagggttgggtagagaagggaaaccctagctaggcagacgcgacgacgagttgttgttggtggtggtggtggtctggtggaggaggaagatggcggcggcggcggcggaggggagtcgagtcgagtcgaggagggcagatgagagagatggaggcgagggggcgacttcgatgggcccaagcccaataccatcaatatgaaaggcccaaacttgtctctgccaaaccttcagaatttgggcctaaacacaacagagcttctccacgtttcaataaaaaaaatcgtatttaacgttgtaatatggcttatttatgccttttgttaacaatgtagaatgtattaaataacatacaagattaaacccccttgttaaaaggaatagaaatgacaaatctccgagacttcgtatcttaaagtgtcatataagatatacaagcaaacaagcctagttaactccaaaagcatgtgaaagagtatcggtcaccatatttgttcctcatatatatatactgttgagattatgggcatataatgatttaatttattccataaataagtcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccgggtctacgagcgacggcgcagtacagagtaggaggcaaaccctagattgattttcgcatatattgcgtgaagacggcgggtcggtttatatagagaaaggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaagaggctgcatctgcgcaagggtgaggagccaatttttcggaccattcgacgcgtacgtcgtgcacgcgcgccgcctgccctgccctgccctgcccaggccaggccaggccaggcgaggcgaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaagacccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatggactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttagagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgctataactccggagtttcttaatttcctgacagacttcaatggtcttttcacatgtctagacgatttcatattatccttagaactattcactttgacaattaccgtttgattgtcacagttcataaggatagccggcaccggtttttcaacaacaggcagatccattaatagatcacgcaaccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaagaagatatcaggcctagttgcactagccaggtacatcaacgagccaatgatttgggagtattccagttgattcctagcaattctcttgttcttgcgaagcgacaagctaggatcataaggtgttggagaaggcttactatcaatgtagccaaagcgattcaaaatcttctccacataatgagactgcaagagtgtaatcccattctcacctctaattagcttaatgtttaaaataacatcagctactcccaaatctttcatatcaaaattttgagacaagaatgatttaacctcatttatcacctcaatgtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaattgcacactttgccttcttgaccttcaagtacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctctctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacctctgccttataaattttaaaatagtctagagcctcgtctttcgttttcaacaagtacacatagcaaaatctagtagcatcatcaatcaatgtcatgaaatatcgttttccacccttcgtcaacaccc

SEQ ID NO: 67900 - DNA, 24878 bp, Oryza sativa
ccgccgcgtcgagtcggccgtgacgcagctcactcagctcgtcagcaacctcctcgccatgcacaagaagctccgcgacatcacgccgcagcaccaacaccaacaccaccaccaccccggcaacaacaacaacaagaacggcacagccgacggcgccgccgccggaggggatgacaccggcccgtcgtcggatctaccgccatgggtgacggacgtcgtcaacgatgtcgaggaggaggtcacggcgacgcgcggacgagggaggtcgtcgtcgtcgggaaggaaggcgatgcgcgtggacgtggtggtggcgcaggacgggagcgggcggtggcggacggtgagcgaggcggtggcgcgggcgccgagccacagcaggaggaggtacgtgatctacgtgaagcgaggggtgtacgaggagaacgtggaggtgaggaagaagaagacgaacatcgtcatcgtcggcgaggggatgggggagacggtcatcaccggcagccggagcatggccgccggctggaccaccttccggagcgccacgtttggtaaattctagtgcaccgcagtgatttaatttgtctttttgctaattactcctacttttgctactcattttggttacacactcgttacttcgttagtattcatatacgaataccccgctgcgttgctgcaaaaaattaagatgcatatactatatacaaataaaatataatttaattaaaaactaaaacaatttgatataattgagcttaaaataattgagattgtagattttttttagagaagaaaaaagagacaatttagactatagatctatcatccaaatgctagaaataatttaagtgatgtggtttaatgagagaagagaaaaatatcattaactatacttagtgggatgaactatatgagtatataggattagaccaacatgatcgccaaatatatagttttgaaaggctacatatatccagttggatatagaggctgggtaaaaaaatatcattctctaaaaaataaaaaaaataaaaatatagttttgaaaatatttttgttatttaaacatgtttgcaaaacatatagcccaatacctatgaatgtatatcaaccaaaagtcattgattcgagagtattgtatagaaccatgatatttgtggtctcaaggttttactaaacccttcacttttagcaagaaaatacggagttctctaaaaaaattagtgataaggaacatcctttatactctagaacaatcataaaagcgatcatacgtgcatgtatagcagcttatacctttccagcctattatctactcctatagatcgaaccgaccgaccacaatcgtgaccgcatgcaaaagtgcgcggcggcacccagtaaattagccgcacacgaaccattatgacagcaagattcacgtgtgctttgcttgcatcaagccctcatctaggctggcagataaaccggctcgtgcatatgcatgcgcgctaagaaaagaatatccttagagcatcaccaaccgtctatctatataattccccaaaactaattttgagggattttaatccaaaaatcagctccaacagatcccctactctcctacctgagttttggagttcccttcccccgattcctcgctccgtttatatgcggacgcgaaagtcgcacccaatcacgcaatcccgcctctctcccttgttcccgcgtgtggaaaatagcgatctttctacgcgtgaaagaaaaaaaacagaattttctcttggtagtttaacaaaagggtccacttttaagttttggggattaaatttaggctatctgttggaggaaggagttttttcacttcctattttcagtttagaaaacccaaaaacaaatttttaggagaaaattatagataatctgttggtgatgctttaagatgtcctcttgcaaaaagttttccatcctccacatatctagggtttgtttgttcggtttattccggactattgactattacgatgtagtagaattaattattcccttttcaaaccccctctaattcatgctacttagggattaaccgagcaatgccttagagttgatgttgtacttaaatttaaaccgcggcacaatgaaatcaaaacataaatttgaatgagattttaagtggagttaaatttgtacttcatccgtttaagttatttgaccttttcttagtcaaacttttttttaagatttgatcaagtttgcataaaaatataataacacttttaatacaaaataaacatattatcagaatatatccaatgttaaatttaattaaactaatttggtattatatatgttattgttttttcttataaatttgatcgaacctaaattttgactaactcaaatgttttataatataaaacggagggagtaactgaatttggtttgtgtgtgcgtgcgtgcagcggtgtcgggggcggggttcatcgcacgggacatgacgattcggaacacggcggggccggcggcgcaccaggcggtggcgctgcgcgtcgactccgatcgctccgccttcttccgcatcgccgtcgagggccaccaggacacgctctacgcgcactccctccgccagttctaccgcgactgccgcgtctccggcaccgtcgacttcatcttcggcaacggcatcgccgtcatccagcgcaccaccatctctaccctcccgcccgccgccggccagaacgccggcagcgtcacggcgcagggccggagggaccccaaccagaacaccggcttcgccctccatgcttgcatcgtggaggccaagtacccgacctacctcggacgcccgtggaagcccttctcccgggtggtcgtcatggagtcctacctcggcgcaggtgtccagccgcgcggatggctggagtgggacggcgacggcggcgagctcgccacgctattctacggggagtaccgcaactatgggcctggcgccaacatcggcggccgggtgcggtggcccggataccacgtgatcatggacgccgccgtcgctgtgcgcttcaccgtgcggcggttcatcgacggcctcgcttggctaccctccaccggcgtcaccttcaccgctgacctcaacaggaaatgacgacgtatacacggatgcagatgctctgattgaacttccccctgatatgtgggcccgcgaacggtggggcccacatatcagtcactacgttcctctgactttacgtcagagaatcccaaataccacatacacacacaaaatcagttattcatttggtttggttaattataaattggatatataccagaaagaatatgtttttttttgaattaagtatatactaagctagttatacgcatagctcatatatatggattcatgtaattgatgaacaatagatatatatacaagtttcatgtgaacatcctccaaacaaaaatttctgggagtacttttttaggtctatattaaaaaacttccgtaaattttgttggtgaaaacgtttaaatgtaactacaatgtcatttatagtgtatattttgatccttgccctcgctcgatcctgtcaatttttattcacccaccctagcacaaatcttcaacatctgacggttagaaaatcgcaagtttttttaaaaaaaaatcaccattttttttaaacaaatcctttttttttctagagattttggaaatgtattagaacttgagaaaagtggttgcaaaatcatttggtcaaaggaggcaaggcccaagaaaagtctaaggcccaggaaaagtccaaggcccaaggactgccctgaccctgacacgcgccaagctgttcctccagtttccacgattcttcgtcgtcttctctacttctccctctccgccttcaaaagcgacgctctccacctgcgtcctcgtcatcctcccctagacagacaaactccagctcctcctcctcctccgcgctcgagatcccgcctccgcctccgcctcccccagtcgccggcgagcaactccggtgaagcgcgagctacggattaaggtgcgccctccccctcctcctcctctcgctaccgagcaagtggtcacggatcttggaattggattggattggattgttcacggatcgggggatctcatctcccccttgtccccggttggatccaactcctcctcctgttgttgttggtggtggtggtggtgatgtgagggggttcgctccaagcataggtagatctccccacctttgctgtttgtttgctcgctccccgggtcgtcgtcgcctcgcgcggacccgatctgatcccgcctagagcctcgaggggggatggtggatcatggggggggggggagtggtgagaggatctgtctctgtcttacggattgtggcgtggagcgctgttctcgtgggcgtattacgtatttacgtgttgccttgctttgatcccatggattgttttgggtttgggggggcttcgctgagatttggagctagaattttggtagtggaatacttgcttatgtgccaaacaggttgattatatactgtgccctccaaatttcgctatgaacagcattggggaataatgtctggtgatttgaggcgacatgctggtgtagattacactcgtgcggtggattacacctaaagagcaaatggtccatatgtttgttgctgctagcatgaactggagcaagatagagcttgctgttgtacttttactagcgaaaacgtttgctgtctgcaaacctgtttatcacataatcacattgttacatcctcccccaagttattcttaatgatttagatgttttttttttcacataacatttagatttatctttcctcgttttaatctgtcagaagcttagtatcgtaattggcaagatgaactttgtgtttaacccatgaatctcccttgaaattgtgagataccccctccgtttcatattataagccgctttgacttttttaaagtcgaacttcttgaaaatttgacaaagtttatagaaaaatgtagcaacatttatagcaccaaattagttttattcaatcccacattgaatatattttgatagtttctttgttttatgttgaaaatattgctatatttttctataaatttagtcaaagcgaaagaagtttaacttaggaaaaagtcaaagtgacttataatatgaaacggcggtagtagtatttaatatttggtcaaaggagtcgtggcttgtttggatttcttagtgttgctgtgctgttgtcagtttagagaacgaagctcaagtaaaggacaaatgaaccactacaattttggtccatctttacgagagtgactgctatgcaagtaatacaagtgaatcatgtttacctaaagagctcttttaggcttttgcagtgctccacactctgtgtttacatgtccacttttgcttgggttaaatgtcagcctgtccttttaccttgttcctttgcaatgtcctttgtttaccttgttcctttctaaaatggatatgttagacaataacaaaatgaaacgtcaaggttctctactgcaagctccatagcttatcacgatgattagtgtgccttattgtctgttgtatgacactgggtgcgattctggtacagatacttatatgtcaacatacttttcctaataattttgaccaaccgatctgaatatctagtgacatcctttatgaattaggcatttcatcaaactgttagaaaggtgagcagtatattcttgtcacaggaaggtactacgccgctgtttatttgtataacctgatgtgtcttaggaaatcagttgttaatataatctttatgcagttgattacaaatgaatcaaattctttcttttgtgtttatgatgttcagcgaaaatcatggtattctttctatgtaatcttgtaagaattctctattctgattatagtcttttttattggcattatcagaagtgcaccatggccaaggtcaagccaaaggcactgctggcacaaagcaagcagaagaagagccccactcaaattggcgcaactacaataatcacctacatcgtcctgggagcccttgtcgtctcttccgtttactatgctctcaaatattggcagaacagaggaccagcagcagcagaaggcattgtgggcaactaaggcagctgtgtaaaatgttgttgtatcatcttgttgggtaattttggttgttacagttcagtaaatgaaacatagacagaaggcctcatgttgaagctttagttttatctcctggtaaattgcattaatatttatttgatatgtcgttcttcgacatggatgactctgttgggccgatcttgttaagagtgacatacatgacagttgcagctgtgaaagttgcatgtgatgccatcaaaacgctgattaagaagctttggtaaaacgttttcccatctatgacatgccattatcttctacttcaatagaatgtcatatcagctattactttgctttctctcagatacgtattgtggtgttagaatatcatatcagctattactttgctttctcacattcgtattgtggtgttatagtttggtattaagtcaacctctctaatttgaccaaatttataaaagaatgcagtggcacctacatcatcaaattattttccttaaaatctaacatgaaatatgtcttgataatgtatttattggtagtgtaaaccatgattattttttatgagcaaatttgacaaaaccacaattaatatggatcaagttgcataacgataaagattttgacgcaggcagcctataggttttatggtcagaacatttcacaaaaacgtactgttgatctctctaaggctatgtttggcattccatgttaaaaaaaaatcctcccgacgtatcaaacataacggtttattaatacatgatcaattaagtattagctaaaataccttaaaaattggttattatgatttttaaaacaactttgctatagactttattttaaaaagtaccattcaaaaagcgtgcgtgcgacaaacgagagagtaaaaattgggaaaagggatatagaacttagcctaactcaatattgtagcaaaataataattaatgaacttagttgctactacaacttatgtatgatggattagaggacttataacattttggatataagtttaaaactcatacaattgaagaaaaatttattaacagcatgattttataaaactgtaggactccataatatcgtaggccgaaacctctctgattttatgcaacatgaaccataatgagttagggttgtgtttagattcaaagtttggatccaaacttcagtctttttccatcacttcaatctgtcatacacacacaacttttcagtcacatcatctccaatttcaactaaaatccaaactttggatccaactaaacacagcctaggttttataaatatcttttctgtaaacttgatccaagtttaagagcttcaacttagaaaaaaaaacaccttacaacttagaacggatgaagtattaatagtttacaagtgatagaaagacattcagatctcagtataccttattaacatctcatcaggataattgatagtctttgcttgttccaacagcacatcataattcaaggtgattttaaattttaaggtttgggtttttaaaaagctctttaatttatttgtcatcttaaaaaatcatgaaacaagagatataggcaaagaaataaaataaagggatgatgaaaacccataaatgttattcctaaaactttaaatcagcttccggctagtataatccaatgctgaagcatgaaccacctatgctaaagcatgggaatttagtactagtggctaccagtggtccagcgtgcccaaagccctgatttttttttcactttgttggtttagtgtaatcatttcagaacgaaccaaaatgcacgaacagggcagtgcagagtggcccctcatccaaaaggaggcaccccattcgggttttgccatttgtgtagtctccctagtctcgtgcgatcaatcattgacatatcctgtctcgtgatcttttaaactagccactctaacagtacagccaactattaactctatctattattgtatcgtccatatctgatctaataatctacttgtacaatagctaattatatattcaaactatacctttattgcttggccccgctccgctctatcgtatttttttagctcgcgtgctacaactgactataaatatatagctcgattttcttttctattttaactcagacacgaatttaagataatggcttctatagctcacctacgtcaccatatttatattgcacttactttaatcacaaacagacactacattgtagccgatctaaaaggtacagatctactagctagttattaatatatatatactctccgtctcaaaaataacttaacctatagaacatgatttatcctagtaaacgaatttggataaaggtttgcttagattcgtcacgtcctatcctaggttgggttatttcgggacaaaaagaatactatttcagcatatgtagaactcgacaaaactttaacaatatatatttttagacaaaactgaatatataattttgatgtattaagtatagttacatataatgttttagaaagatatgaaccgtatatactccctccgtttcatattataaaacgttttgatctccccattactcgtattcacttattcactgacacctgtaaaaaatacatagattaatacaaaattattcaaaatcgaaaatgacttataaagtgaaacatataaaatatgttcgggcttgtgtgaggttcagcttaagtataagccaggccacaaatattttgaatctctagaattaattttagggcattttcctttttttaaaaaaaaaaatagacttggcttttggaccgttgaaaacacaggcctaaaaggtactagtatatctgaaagttattattattattattactttggtcatatatctttggtttatacgccataactttagataatggttttcaagcataccttatccagaacaatgacatgtagtgtagtatcattctggccgagcgaacttcgtcatgtccgcacatttgcgtggaaatggcgtgcgttggtctccggtcaccggttagaagtacccgcgtgatcgctaccgcttggtagcctgcaatgtccctttgcctgattgcgaccgttctctcttctactcctttttttttttcttttgagaactctcttctactcctaactcctctctaccttccttgctatagctagcttccatgttgctgctagtgatgtttggtgcacccaaccactttcaggatacgtgtcccagctgtacttttcagctaactgtagtcttcgtgcatggtttcgcaggtcagacttttttatttggtaaggaagtttctctaattctactctctctgtcgaaaaattatgtgtctagattcatcgtgtatagagtttgactctttcctagatagatccgtctaaaaataaatcaacatttatacataaatctagattagcctaccttcagtatgaaacttggtttattttttagatagaaggaggagctaaaacccaattgcatggtcatgtaaatatctctctactctttttctttgactatgttatatgaagagatataattactccaaatttacaaataagaacaggttccctccatcttaaaatgtatctatttttagaattcaaatttgtttaaaaattttagatgtttctacctacctctgtctcaaattctcaaccaatcatacctatcttccatttaattcttcacctatttttttcttctcaactatttacaatattgcaccattcaatttttacacacttctttaattcccctaaaaacatctgaaaatgcttaacttttgaaacgggaaagtaccaataattacttcaaagttaattatgaataaatataaggaatccatactatgtaccagacaagtgtactatttgtccagatacatattctagatcccttatatatgtggttggaagtagtagatgcaatactacaatctagctaaaagttatttggattttagccttttctctttttctcccacttctctatttaatttgtatatgttgcagcgcgtctaaagctgatgaaaaagtgtggtaatgtgttataactcactattaattgtatatactctatggagtatgttctaagtctacttcttccgtccaaaaaaaactcattcctagcatttcaagataaaaatagtggagtgagaatgactaaaatgccattaatcattgaaaaaatagtaagagtgataggtaggtaaagggtattgaagggataaagcttctcgttttacgtgctgagggtaggtaggatgatagaaattagttttttttttataaaatttaaactctagaagttgctttttttttggacggagggagtacaatagattctatttttatggttaactataaaaacacattatttttgttgtgcaaaaaaaaagatttatgctactccctccgggctgataatacttgtcgttttagataagggtgaggtcaaactttagaatctttaattatgaatcatttttaaaatatttatctttcaaatatagtgactacatgtatagattagtcttaaaaagtactttaataagatcatatatttgttaacacttttttacatattataatagaaaataatggtcaaagttgtttttttaagaccgcgcccttgtccaaaacgacaagtattatcaacccggaaggagtatatatttatcgataaattttcacggtataattatagtgtaattatattgtaagtacaatgtaactttcaggcacatctggaagtaaaggaatggcttaatatttcagaacgttcaaccttcctttcaagtatggagatcttttttttgtcaaagaagttcttatgcatatgtgcagaatgaaagatcctttaaaacaaactgtttttagttggttacaaaccttatagtcttcttgtgtgacctttatgtaactctgtaaccttgtaaatattttctttttttataaaactacactgctgggcaaagccctggcagtatttccaataaaaaaaagtaactttcatattattttgaatcattataccaaacgaggaagaaaaatcatagcgcatcgtgttaccgtggatttttaaaagttacatataatttatattataattaaatgcaagtcataatatcatggtactaagattataaaatttatcaataaatatgtataaatatgagggaaaaaattccaagaaaacgggtgctatgtaatttgcacacgattagttaattagctggtcttgaggtcttttccgtggtcacctcagcgaaacaaaaaagaaatgacttttacgtgcctttgacactgtctcgtgcttatccgtacaaaccatgcgtcgtccgttgtcgacggaaacaaaattacgagctggctgtcggctgtcgccacttgccaaaataacaaggacttcgcatttgacagatggctacaacataaatgacgcaaattaaaggagacgttccagaattaaccaggacaacacacacacacgtaacaataatggtttgattgttcaataaaagaaaaacgctaattggattggctccttttaccgacggatagatggatcagccgtcgccatcgcctgtctctagcttcttgccgacgtcctgtagaactcctaagaaaaaaacatcaacatcaagaatatcaaaacatctaatccctccttctcattttaagcacagctatgagtttccttattcaactttaatcgtccgtcttattttaaaaacatttaaaaaaattaaaagcataagtcagcataaaataatattaatgttttattatctaataaaaacaaaatactaataatagagaaaatttcaaataagacggacgatcaaaattagacacggaaactcataggcgtgcttaaaatgggacgaagggagtatccttttaaaattaatcttgattggtcgcatatatatgcaggatatttcacaatgcacatttactctttatataaataagcaaatatatttttttgtagatggtgatatttttaaaaaaatatctcaaaaatcttagataataattaaattggtatagagggatcacggagaagagccgtaagagactagtgccaattcatctatagctaattcatataatagttgcttactatactattaatatataatcccacctgtcatacacacactgtgtcttgaagtccatgctgcagctggctacagatctgtagcccgctgctcttctctcccatcttttatctcattaaaatatatttatagctggctaataatctactattgtacctgctctaacgctgctgcctacggctaccaacatcgatcttgctcgtgtgtatcctggattcacggtgacataccctttttgccttttttatgttcacgctaacatcggtttatggccaccgtttgcttaccgaggctggataaagttggagcccatcgattggtctaataaatcaaactaaaaaataaaacttaaattttcgaacatagttttttaagatattttcaattttaacttctctatttagattcgtagtactatgatgtatcacatctctttaaaatcctttatatatattatgggacaaaggagtatataacataacgagtataaaagctaactcgatagtttctgggctgggagattgtcctcatgcacatcaataatcacttcatgcacatttcccaagccagctaggatgttggtttgcccaacccagatcttctcgccgtatagatttggccatcgagagtgacacaatagtaagggtgtaagtggctagctagcccataaaacccacttataaaacaaagcaaaccacttacctatttatttggatctatgagtgggttcatggattagccgcttacacccttacaaaataatgctcatgaattcgtttattgcagaaggccatcgctgctttcttttgatcgtcacatactcacattgagtcgataaacatcgttgcgatacaatggactggtatattcatctgaaccatggcattgaaaaaaatcagttgcaccatactagtgagtcaaaaaatggtacaagtttaataagtatatatagatggaagtgtcatttactcaatccaccctaatttatatctctacttctataaaagagagtaatggtagtgatgagtgatgaatatatcaccatctacagcagtaactctatacttttaaataaaaaggaaaatattataggccagaggactcatatgtcaaccacccctaccaccacattccaacttaaaatggaaaagaaaaacgacagtgtgggccaaaggtcctacaacttagtagcaaatatatgtagaaattaatagatgatatatgtcaaaaatgatgctaataatgggtcaacaatcattttatttgaattaaaatcttgttgcaacgctgacaatatgctactaataatgcttcgagggatgaagaaaacctatagatttgattgctttaaaagcaaaactttttttttctctttagtccactcccttgtgtagcggagcatgggccctgtttggagaactaaccaagagttattttaagagctattttttagcacaaagaaatagccctacaataaaatagccataacttgtttggatccaagggttattttgagagctatttgacctttaatgcacattcccatggagagagaagccgcttttcagtgagccccacccaaatagtctcaattagcacctcttgaggggatagtttttttggtgggttatttccaaatagccctgaaatagctcacctgtttagaacttttagattatttggggctatttgagagggctaaaaaatagcccagggatccaaacaggggcttggtgtcgccgtgtcatggaaaaacccgtccaaaaagcatccattatccatatcacggtaagagccttgagtaaaatgaaaacagggacaaaaaaaaaaaactggttggtccaaccgatccaaccgatcctacatggccccatgccacgctatagccaccaagtaaaaataataacaaaaaggaacatatgctatatctttctgcaacgcataggtatattgatttgtttagacctgtttagatcaatttactatggcaattttttttaaaagttttattggtaaaagatttggtattacaatttcataagttggtatttagatgcatggtaaagtttcgttattaattgctgctgcctctctcgtgcacggggcccgatgcttttttggccaaatttgctgctatggacttccaaataacaaatgctaacttgcctaatttttgctactagtgtttagatttattttgctaaaaagtggtcctaaacggtaaaacttttgtcatttcgaaggatctaaacaagctcttaatattctagtgtctataaacatcacctactcacaaacgacacttttaataagaatttacattttaatgatatgataaatttagtgatggtctccgtctctttaaatgtgtgttctggaccatattgatggggtgtatgatgtactcattttaagctaatccatacagttcaaaatccgtcttgatttttatctcattaactacatttaatccataagttgataagatttatcctccgttattccttatatatgcctacaccgatattatactttcttaatgagtagctattttagtttttcttaataaagttatcttttgaattaggagcatgcgtgtgtgtgggtaagaagaaagtgcagagtaaaaaggaatagagaaaaagggcaggggagtacggatccccgtgaagctgtgaagcgtccacttgcttgcacttgcccaaagaatccgatggccgtagaaaattttttaggttttgttgtcacattaaatatacgaagtattaaacgtattctactagcaaaataaattatatattccaccagaaagcctaattaatccgttattaacaaatattttactgtagcatcacattatcaaatcatggcacaattaagcttaaaagattcgtctcgcaatttacacgtaaactgtgtaattgattttttttcacatttaatacttaatacatatatccaaacattctgtgtgataggtgaaaagtttttgttctgggaactactctctccgtcctataatataagagattttaagtttttgtttgcgttgtttgaccaattgtcttattaaaaaaaatttgaaattattatttattttttgtgacatactttattattcaaagtattttaagcctaactttttattttttatatttgtataaattttttaaataagacgagtggttaaatagtgtaaaaaaactcaaaattataggacgcaccccgcctcctggctgtccttggttgcccacgcacgaccgtccaccccgcaaaaggataagaaaaaaattgatcgacgagacacatcacaagtgggaacattttactaccagtgacagtgagagactagcgtcgcgcacatgcacatcttgtgcgtctcaccctcaccggcaggttaccgcaccgctgctaggcagctaggctgctcttgtcggattttttccatgaaaacgaatctcttcgtggccgtgttccgttacttttaaaaaaaattaaaggatacggacacacatttaaagtattaaacgcagactaataataaaacaaataatagatatgtattaagcctaattaatctatcattagcatatgtttattgtagcaacatattatcaaatcatggtgtaattatgcttaaaagattcgtctaataatttatatgtaaactgtacaattagtttttttcgtccatatttaatgtcttatgtatgtgtttaaaaatttaatgtgatgaaaaaattagaagtttgaagggagacacagccgtagccgcatgcgtttgcgcgagtgcacagctactcgcacgcagcgagcagcgaccccgcgaaccctcctctaccagcacggacggcaaccacgttggagtagtagaagtagtactcgtacgtgctgggtctgtgacgcccgcgtcttgtcgtgtcgatcactcactccacacccgcgcgcgtccgtccaccaccacacccaaccccgcgaatcggcgccccgatcgaaaccgagagcgttttccttttctctttcccgttttttcgccgctcgcgcggcacgggcaggtagtagtacgtcgtcgcgcgtcgcggttgggggcttggctaccgcgcgtctcgcggtttcgcaccggcgcgagcgcgacgagaagagaggagcgatgcgacgagcgttgcgttgcggtttttttgcgttttggttgggtttggatcggggtggggggtggggggtgggggcagaggcgcagagcgtgtcggctagcgtacttgcccgttttcatatttcagctgttgctttctcggctggagtcgagacttttcccctccacatgcctgcctgcacgctttcctggctgccatctgcaccacaggccacactgcatccgctgcccggcacagacttccgggtgggtgcaccggataataaaggtatggttaagccaaagtagggagtttgaatccaaactagtacttctctatcacatcaacatatcatacacacaactttttagtcacattatcttcaatttcaaccaaaatccaaacttgcgctgaactaaacacagcctagggcgttatcattaagaacaattcttttaacatcgagtttagttccaaactttttcttagaacttctaatttttccatcacatcaaaacttttctacacacatactcgtaaactcccaacttttccgtcacatcatttcaatttcaaccaaatttctaatttttagcgtgaactaaacataccctaagatgtactctctccgttcaaaaatataagaatctaaaatcggatgaaatattttctagtctgttcatatttatagtattagaaaatatcccatccgatttaggttcttatatttgggacgaagaaagtatattttattttagcttccgttaatatattttttaagctactaaacggtgtattttgtgcgaatactttaagtatagaagttgctctaaaatattaaataaatttattttttaagtttgaaatattaaaattcaattaattatatgctaatggctttctcagtttgcatatccgtatataatctttatcttcgtcaaatttaaatgggtcttaacaaacatttcttttctctgcttcagcaaatctaaacgtcggccctgtttggatccatgggttattttttaccctccctcacgtagccccagatagcccaaaaattccaaacatgtgagctatttcagggcttttttggaaataacccatccaaaaaaactattcctctcaaggggtgctaagagcaagtttaatagtatagccaactactagctccaaatcatttatagccaatgaattcatagaatagttgcttactattaatacatggtcccacctgtcatatacatattacgtcttagagtccatactgtagctagcaacagatcgtagcccgctgctattatctctcttcttttatctctttaaaatatatttatagctggcttatagtatgctattgtacctgctctaattggggctatttcgggtgggcccactgaaaaaatgtcttttctctctctcttcgtgggaaagtgcattaaaagccaaatagctctcaaaataacccttggatccaaacaacttatggctatttcgttatgtaaaaaatagctcttaaaataactcttggctagttctccaaacagagccgtcagtacgtgatggggctaaagtcaatgttttcttgggtaagtcgaagacattatacttgtagttgtagttgaagggaattaaaggacggatggttcggaaaacagatgaagaatggtccaaagaaaagaaaattaaagtcatcattcggtgccaaggtcatgaatatcagttgaataaataaacaccgaggcatatggaaaaacgataaggtaaatttcaatctgtagaattatactctctccatctacttttgataatcatatttccaaatctaaaaattttatttttaataggcatatttttattggtatgcaatatttatttttcaatgaggggcaacaatagctgccaaatattgtaccggtatttataagtatttatttattgagaaagaatcaacgactcgcagatacattatggatgcaagatcatagcttgggtaaaactaggtcctagcagcttgattttcccaagagtttgaactactaccaattggagcaataaggttatcatgggctcatggccactaatctaccaaacggtccattggttggctgaaatgaattcaattttcaaattttgatttcaattcacagcctttcaaccgaactactccctttagttattgtccggttattaccagttggttactcaacaacttaggttggtagtggtttgtttagatgggaacaagacagaaggaaggaacatatgtagcgtaatgcgtatctttgtttactctgtttgtttttggtcatcaaggacacgagcgagttacaaatggccatacgagcaaaaatacaggcaaaacgccctctgcttacgtggtaaaatgcgcgtgaccagtttaaaatatgtacagagcacatcgtaatactctctccatcccgatttggcgatttgatcatctctaagcaaatgacatcaagaataagggcatccaaatactccctccattccaaattaatctatatatagttttttttattattcctaaatgatctacatatttattcatttattaagcctattcgttatttgtgcattggagtaaatggacattgatacatgcatccatgcaaacaagtatttataacccacatgcaatatcttgatttactattggctagaaaatagtggagatggtgcatacattgctagagtaaatatagtatgagaaaattattagcttttcttggtcttggtgtacctctaaaatatgtatatcaatttagaatggagggagtattcatcattactccccccgtcccataatacaagggattttgagttttagtttgcattgtttgaccactcatcttattcaaaaaatttgtgcaaatataaaaaacgaaaagttgtgcttaaagtactttagataataaagtaagtcaaaaaatcaaataattattctaacttttttgaataatacgagtggtcaaacagtgcaatcaaaactcaaaatcccttatattatgggacagagggagtatcaaattaatcctcattggttaaggtgcttcatcgcttcatgtcctgtgtattgctcatattttaaatattgcataccattacacgaatagaaattattttttattggtttcatacaacaccatttaatgatgcatatttactctttgaaaaaaaacactttgttaaatgatgatcattttgagaagacctcaaaaatcttagaggatgattaaaatggaatggagggagtaataagagcaggtacgataacagactataagccagctataaacacatattgagaagataaaagaggaaagagaagagcagcgggctataacagccagctgcaacatagactccaagacacaatgcatgtatgacaggtaagaccatgtattaatagtataatactctgtatatgcttatagataactattgtaaatcgaccatagatgatttagaactaataattggctatactattaaacctgctctaattaatgaatcaaactgtcaccaatgaatgaaattagggcctggtttagttacaactttttctttaaacttccaacttttccatcacatcaaaattttcctacacgcataaattttcaacttttttcttaaaacttctaattttggcgtggaactaaatacactctaaatataaaatcctgggcaataaatgctcgggctaaaacaaggatggaacacgtcagcgggtccatccctatctcactcggtcggtgctagtactgcttccacgagatccatccgagcagcagcagcagcagtagccgccgccgatccgagaaaaagaagaaaaagaaaaagaaaaccagcaaccgaagcgacaactcctctcccgcaacttcaccgtctcgtctcatctcatctcgtctcgccccgctgtaatctcgtaccgcgtcatctcgcggagacgcgagaaaaagtccgcgcgcttctctctctctctctctctctccctctcgtgggccgctgcccgcacgtcgcactcacgaccggacgccagctcacgaatatccacccgatttaatcccgcccccttcgattccgccgctccgcgcgtatcgcataggcgagttgtcgtatcgatacgcgcacccacttatacataagccgacctccttatcgtagataagcaagtgggggtggcgtggggagagagaaaagggcgagaggtctgcaacgcatcgaagaaagcgagactaaagtttctctctcctctcctctctctctctttctttctctcgcgacctcctcctccttccacatctccgtctctctctctctcatcacgaggggaggcggcggcggcgacggggaaaccctagaattcggcggggtgaagcggtgaaggcgcccgcggcagatcggagccgggaggggggtttcagcggcggcgggggggcggcgccatgtcgtcgctcagccgggagctcgtgttcctcatcctccagttcctcgacgaggagaagttcaaggagaccgtgcacaagtgcgtagcctttctccctcccctgcctctctcgctggtttcttcgttcgccggttgggttggaccgtgggctctgtttttttttgggtgattcggtgggaggttggttgggcgcaggcgactctgctttttttgggatttgtttcgcgagtgtttgtgcgtgttttttttatctatgatttttttttgcgtgatgcgtctccagattttttttttagttttgggctttgagttccatcggaaaaaaaaattcgctctgtttgatctgttaatatgcaaggaaattttttccgaagttttttttggctggtttggtcaaagtttttttcctcgtggttttctccaggatggttgttagtattttatcaatttggtcaatatcaatttttgggggaggggctctggtcatggtatttttattttattgggatagttgagggggagatttgaaatttcgagctcacatgcgcctctttttttttttcgctttgccttgttcgggaaaaaaaaacttgtctgttttttttatcccgaatcctattctctgtcggctgcttaaattcgtctgaacaattgaatctctagattcaatgtgattaagtcggtgattggttttgtcattataatcacttgtgctgtgtcgactgagccagtaattgtacatgtcatttctctggattgcatcaacaccgtcgaaataattgagaattatttacgaaaatataaccaaattttaagcaagcagtcgggcaattataacttacaaagctgttgttgaacttgtctgaacttatgttctgtactttctgtcgtttctgctcaaatttttacattgtagactttatagtggcatacggtaggttagtccgaattagagtgtccagcttgacacccgaaggtctccgtcattgcaattgagctctgctgtcactcgtttactgctcattctacgaaaagatggggaaaaaaaatccttcaactaatgttctatttccttgtcacgactattatgttggattcaatggtacatttggtctagcaaggtgtaatttcctaatatggtacattctgttttaggcttgagcaagagtcaggattcttcttcaacatgaagtactttgaagagaaggtccatgctggggagtgggatgaagtggagaaatatctttcaggtttcaccaaggtggatgacaataggtattctatgaagatattctttgagatcagaaagcagaagtatttggaagcacttgacaggtataatttcatatctgaagggaaagttcccatttcaaccaaaaaaaggacttgtgttccatccttttggcactgggtgagatataacttctactaattttcatattcatttatatattttttttgtaacaggcatgatagagcaaaggcagtagatattcttgttaaagatcttaaagtcttctcgacattcaacgaggagttatataaagagataacacagcttctaactcttgagaatttcaggttcttacttcatcttgccttgtattttctgttgactgttgtgcgagtgtgttgataggcttgctagttgaattttgcattattagggttctttagattattcctttatctgaacaatgacaccaaagaaatgtataatgtgttgacagagacaatgagctgttgatgtttcttgaattgatttttttagttaccacttaccaggtaatggtggtttagttgtgctcatggatcattcatatcttcacactgctgatcaggacatgaaagcatttccttagagcgatatacttcatgagcattttaagtttccacttggtgcagctgtgacttgcaataagtttgccatcacggagaactaaagtagggcatggattcttcttttttcttttttttgatagaacatgaaattgaatgtgtagttgagtgcgccctccagtacagaagctacacaaacctgctctgataatcgagttgtagttactttgagttaggcattttggagttttaagttatgagtgaatacattttccttttggaaagagcttctagtaagagtttactgccactactttgttaattgcctttgaattaacaaaaattgtggaattacttgttctgcttttaacagcacttcccatgccttttttaatcaacctactgtgcttcatactatcatgttcttagcttcctattgccataaaactgtcaaattatcaactatctgttgttttcttgcagggaaaatgaacagctgtctaagtacggggataccaaatctgctcgcagtataatgctgattgagctcaaaaaacttattgaagcgaacccccttttccgggaaaagcttgttttcccaactctcaaggcatcacgccttcggactttaatcaaccaaaggtttgggaagacaatatactattgctatttgttacattatatgacctgtttgagtgttcactgtgattttctgttatatgtgagttcataattctatgacgacatttgcagcttgaactggcagcatcagctttgtaagaatcctcggccaaatccagatatcaagactttgttcactgatcatacctgcactccgccaaatggagctcgtgcttcaccagtttctgtaccactggcagcggttccaaaggccggtggcacatacccaccacttacagctcatactgtatgtttgagatttaccatttcttctttgcatgattttatgaatgcctcttttcacttttactcactatatccattaatgcagccatttcaacctcctcctgctggtccatctttagcgggttggatggcaaatgctgctgctgctacatcatctgttccatctgctgttgtggcggcatcatcactacctgttccgccaaatcaaggtaagatgatacttttctgttgatatttgctaattgataatgtgagcgtttttactgttcttttattatattattctgacctaaatctgcaatatttcctactgtacaacttctttattcacactaggtattgctatttctctgatactaatattttctaattcattgcactaatgatcattgctttctgatttcacatgtctgacttaatggttattttccatatgaatttgacatgttttctcatttttttaataaagaaaataagtttaaaactgctaaataagaaaaggtgagttgggacatatactagataccccctcagtttcataatgtaagactttctagcatcacacacattcatatagatgtaaatgaatctagacatatatatgtgtctagattcattaacatctatatgaatgtgggtgatgctagaaagtcttacattatgaaacggaggaagtaattctgttggcccatagaatacggttacaggcatcaactattcagcaatgcggttctttggttctttgatgttttgcctaatccttctagcttgaagtacatctaacacctctaagacaaagcctaattctctttggcaacataaatgtacatgaacatttattatttctgctttgcatgtcctgatatgttgttttcttttgtcacgttctcatgacatacaacttatcgtactatttcctcagctgtcccaatcatgaaacgaccaactataacagactatcaaagtgcagaatctgagcaactaatgaagcgattgaggccaagtggacatggtgttgatgaggtaatgttgcatttgcatagaagatatatggctggtgcattttctatcaattattcaaagtcatctacgcttatgttcaggccacctatcctgcaccaattccccaacctttatggtcagtggaggatcttcccaggacagtagcttgtacattgtcacagggatctagtgtaaccagcatggattttcatccaactcggcatacactattact

SEQ ID NO: 67901 - DNA, 724 bp, Oryza sativa
attcctgcagcccattgatcttgcgtgtcacattgaatatacgaacacatgtttaaaatattaaacgtagtctaataacaaaataaattacatattccgtctgtaaactgtgagacgaatttatcaagtctaattaatctattagcaaatgtttactgtagcactgtattgttaaatcgtggcgtaattaggcttaaaagatttgtcttgtaatttacacaaaatctatgtaattgctttttttctatatttaatattacatatttaatatttaatatgatagcgtgaaaagtttttacgtgggaactgtcttattttcgcgttttcggcgttgcgctggcgggggaggtttgaaatggtttcgaattctcgtggggtttcgcttctactgcagacatggcagatggggcccccgttgttggtggtgaccatccaggcgtagagggtgtgtggcaccgcggggaggtgcatcgtgcacctggttggttcaggagacgtgtgtttctacttgggaaatccgatagatcgttttgatagtgagatgggctcgaggcctacgcgcgctacaccctcagcacgggttttcgaggacggcaatcctcctagaggatacggcgtcgtgtctagaagcatctagtcggacccaaaccattactataccaactgtatcggtcgaaaaaaaaattacgtcatcgttcttatcaggttacgctactttttttta

SEQ ID NO: 67902 - DNA, 11924 bp, Oryza sativa
gcatcaactattcagcaatgcggttctttggttctttgatgttttgcctaatccttctagcttgaagtacatctaacacctctaagacaaagcctaattctctttggcaacataaatgtacatgaacatttattatttctgctttgcatgtcctgatatgttgttttcttttgtcacgttctcatgacatacaacttatcgtactatttcctcagctgtcccaatcatgaaacgaccaactataacagactatcaaagtgcagaatctgagcaactaatgaagcgattgaggccaagtggacatggtgttgatgaggtaatgttgcatttgcatagaagatatatggctggtgcattttctatcaattattcaaagtcatctacgcttatgttcaggccacctatcctgcaccaattccccaacctttatggtcagtggaggatcttcccaggacagtagcttgtacattgtcacagggatctagtgtaaccagcatggattttcatccaactcggcatacactattactaggtacaatcaagctctttatgttattaaaatctatttaaaaaatatgtgcaatagtaagtacagaagtctgattctttaagcatgaatgattgaatacaacttagccaaacgatatatcattttcttatcacgcttattactttatcagttggatctaccaatggtgaaattacactttgggaggttggtatgcgtgagagactgttttcaaagcccttcaaaatttgggacattcaagcttgttcaccacaatttcaggtatttttttattgctttttatagttgatccagtacaaacatctatagttgtgatcttatatgcctctttattttacctcccgtgaaaagagtgtggctaaagagtcttccatatccattaaccgggttacctggagtcctgatggagacttgataggttggtatccattttataattctgtcagtaatattgtgtttcactttatttgttgcttaggtttcctttgtggtttcaggtgtcgcatttgcaaaacatttgattcatctgcatgcatatcagcaaccaaatgagacgcggcaagttctagaggtactgcaatacttccaactgtccttaatcatatggttatagaccaaatgtcagttttataaatatcacaatactttattagttcaagtctgtcactaaacccttttattcatcatgtcagattgacgctcattctggagcagttaatgacatagcattctcccggccaaataagcaactttgtgttgtcacttgtggagatgataggctgataaaggtattagatgcttcttggatggttatcttcaattttccccctagccttggtctccttcaacttcacttttcttttgtaggtctgggatatgcatggacagaaactgttttcatttgaagggcatgaggcaccagtgtattccatctgccctcaccacaaagagagtattcaggtgggttttctgaacagaatatgatatttccagttgtggtgcttattttataagatagacaatttcttctcaagattgaacagaggtagtatgcgtgattattaatgtgtccatcagtaaaaaaggggctgtctaatgttattaatgtcgatttcttgtgttgatgtgctattcttatgttccctgaagtttatcttctcaacctccctcgacgggaatattcaggcatggctttatgatcatatgggatccagggtagattatgatgctccaggaaaatggtgtactagtatgctttatagcgctgatggaactaggtaagcagaggtattactttcgtaccgaaagttgtctttagttattggtgctgtactaatttacttgtttttcatatgaaggttgttctcatgtggaacaagtaaagatggagattcatatttagttgagtggaatgaaagtgaaggatctatcaagaggacatattctgggtttcgtaaaaagtcagctggtgttggtgtggtgcagtttgacacagctcagaatcacattttggctgctggtgaagataatcagattaagttctgggatgttgataatacaaccatgcttagctctactgaagctgacggaggcttaccggttagtctatgttccctactgtgttaaacatttttttctcttttggtagtctaaaactgtgtacattctatcagggtcttccacggttgaggttcaataaagaaggcaatcttcttgctgttactacagtggacaatgggtttaagatacttgcaaatgctgatggactcagaactttacgagcatttggaaaccgacctttcgaagcatttagatcgcaatatgaagcttcttctatgaaggttcctgcacactctttgctgcttgttattgttgtgggtctagttttagaaaatccatgaccttgaatattgcatttacaggtctctggtgctcctgttgttgcgggcatttctcctaatattggtcggatggatcacatcgacaggaattctcctgcaaagccatctcctataatggtatggtaatccacagacgaaagatttcccaaagtttcatctgtttaatgcctctttgcttaccttactgttagcaattgaaacacaatctgacttaattatggatttaatagaatggtggtgatccagcatctagaagcatcgatataaagcctagaatttcagaagaaaggcccgataaagcaaaaccctgggagctgatggaagtcctaaatgctcagcaatgccgtgtagctacaatgccagaaactccagaccaagccagcagggtttgatccaacttgttcttgcgtagtttgcacttctcttcatgtaatcgttcagaaggctaacaacatttatagacaggttgtcagacttctgacacaaattctggtgttggcttgctagcacttggttccaatgccattcaaaggctgtggaaatgggctcggaatgatcaaaatcagtgggaaggtatattactctctctttgttctttggggtttaggctaatcaagggcagcgtgtaattctgtcaattctgctaagcaggccacagccaatgtagtgccacaacattggcaaccaaacagtggtcttgtcatgcaaaatgatacagcagataccaatcctgaggatgcagttccatgcattgctctctccaagaatgattcttatgtgatgtctgcatgtggtgggaaggtttcactgtttaacatgatgacatttaaggtaaatgctcaatatcttttttggataaatacttcaaaattcaggaaattttaattatgcttccttcatgcaggtgatgacaacattcatgccaccacctccagcatcaacctttttagcatttcaccctcaagacaataatatcatagcaattggaatggaagattcaaccatccatatatacaatgtcagggtagatgaggtactgcatacataaaatttgcacatactgtaatttattgagccattgctattcatttatattgagctttattttctttccaggtcaaaactagattgaaagggcatcaaaggaggataactggtttggccttctcaaacaacctacaaatacttgtgtcttcaggggctgatgcacaggttactatagccaaaacactttattttacactttacattcattgattctgttgatggatcagtatggctgctagtttatttatctttctcaaaagaaccactcaacccttggataataataatgtcactctgtttccactttgcagctttgtgtgtgggccaccgatacttgggaaaagaaaaaatctgttgctattcaaatgccagctgggaaaactccatcaggggatacttgggtccagtttaactctgactggagtcgtttgttagtagtacatgagactcagctagctatatatgatgcatcaaaaatggaaagaatctaccaggtagctatatatgctgtatcaaaaatggatagaattcctatgttcataattgatcaaataattttgttctggtttgctaaaatctcttttttatctctcttgtttcagtggatacctcaggacgctttgtcagctcccatttcacatgcatcatactcacgcaacagccagttggtttttgctgcctttaccgatggtaacataggaatttttgatgtggagaacttgagattaagatgccgaattgcacctccagcatacttatcttctgcagccataaacaggtactcactactttacgtatgatatacgcacgaaatttacctaaggccatatgagaactagatgtgctgatacagttttaaatttcagtatctgattgtccatgtatattgctacaatatataatgtagtacgagtgtcctagcactttgacctgtaatcatcgtgcattcgtgctcaacatgtcccacccctcctctgccatgccttgagccatgactcctttctgttaggaacagtgcgatatcctaatagctaatgccatataagtctactaatcgaagtttgagatatgaggattatgattttacatgatcctgttagtcaatttaagaaggattaactggcatttttgttctaccaagttttatggcaatcttagttgccctgaaatactctgaattggtagtcttatctagagtagctagatataatatgatcaaaaacacctaatttcaagtgggaaatacataaacattatatgccaaacttttgttgacaagttttgacatttgaaaccccgctcattagaaggttgcgtattattgctatttattcctccatcgagcttcatctaaaaacatatatgtttccctgcaccagcaatccatcggtctaccctcttgtcgtcgctgcacatccacaggagtcgaatcaatttgcggttgggctttcagatggatctgttaaagtgattgaacccttggagtccgaagggaagtggggaacgacgcctcccacggaaaacggggtgcccaatggcaggacgtcaacatcatcagcaactagcaacccagctgcagaccaaatccaaagatagacgtgcatgccggttggatcttcactgtaaagcttttctaatcttttacattgacttgtttgtatgttgatgtgactaggctattgttgcatttgttggaaaagcaaacagaaaaaaaatggaatcgtaagatcaggtgtgcttgtaacttgtcggatgtttgccctagttatgaaaaggttatcttgtaatagggatagtccataaaattaggttttctcagtataactgggacgtcggatgctgtagttatctttgcttagatgcttttcaagctatacatagtttttccttccttcatgttcattttttttccccaactgttgtggtggttcggacatgaaaaggaagacggtgattgacggatgccttgaatgccgtcggatttttggtagaaagagatactagcatctacctaattgttgcataagttcgttgaaagaaaataagtttgtgtgctaacaacgggaattttatgatttatgctattgaattgcctatatgggcacaatgagatgtcattaatgtaccatctgaagtcgttgtcagctaaaaaaccatatttgcttgtagattttgacggccagagtcacctaacgaggaactttcttgtgctcattttaaagagtaaattgagtcgacgttacatgaggaactttcttgtgctcattttaaagagttacatgaactgaacttgtaagaggtgtactatcttaatacacaattgggatacacaaatgcatgcatgctcagcatgactcttgctgatgtccacatactattactcctttcgttacaatgttagtaaataatagaacaacttatggatgtgacatatcttatttctttctataatataataacttatgattggatatgtcacatcatagtgttacgaatctaaacaagatatatcatattcaatattaggttattatattatactagcaaggaagagtactaccgtaaacttctcattctcatgagtggtcctatgtatatcggctgtgttcggagcagtagtcagtttttcagttgcacatttagtagggtattaattaatcaaatactccctctgttttatattataagacattttgactttggtcaaagtcaaactactctaagtttgactaattttttagaaaaaaatagtaaatttttaaccgaagacaaatatattatgaaaaattattcaattatagatttaataaaactatgctggtgttgtaaatattactattttttttctacagagttagtcaattttagagtagtttgactttggtcgaagttaaaacgtcttgtaacctggaacagaaatggagggagtattaactatcacaaactataaaaaaagtatttgttttcaaagaaatttctctatagaaagttgacttttataaaatatatatatttaacaatctaggaagcatgcttactaaatcaaaacttgaaaatctagagttgcaatgtttagtttatttagccaaaactaaaccgaataaaacgactatactctcgatctaaaataaaccaacttttagagtttgaattttattccaaaataaactaacttctatcttcttacctaccatcaacacatatcaagaagataaaagaagagagaagagtaacgggctatagatttgtagccagctgcagcacagactccaagtcacaatgtatgtatgacttatgtgactatgtattaatagtgtattatatgtttataggtaactattgtatgaattgattattaagttgactataattgatttggatagttggctataataaacctgctcttagagccggtgcaacagtagatataaaccagctataaacatatttaaaggagataaaacaagatagaaaagagaagcgagttacagatttgtagtcagctatagcacggactctaaaatgcatatgtgtatgacaggtgtgaccatatattaattatgtaatactccctccatattttaatgtatgacaccgttgactttttaaccaacgtttgaccattcgtcttattcaaattttttatgcaaatacaaaaatacttatatcatgcttaaagaacatttgatgataaatcaagtcacaataaaaataaatgataattacataaaattttttttaataaaacgaaaggtcaaacgtttattaaaaagtcaactgcgttatacattaaaatacgaaggaagtatatgtttgtaggtaactattatatgaattgaactattaagttgactgtaaataatttggagccagcagtttgtcctattaaacttgctcttaacgagtagtgccctgtgcacgcgtacggctgcctaatgcagagcctgacgtggcgagctgccgccccggaagcccatagaaccaactccaccatagattagtagtactagtactagtattagtattagtgttaaagcgatgcaagcaaagaggctgttctagaagcaagcagacgccacgccacggaagaatctagaaccccacccccatcccccagcccaacccccacacgaagcgaaacgcaatttctctccaaaccaaaacacccgaggcggagaggccgaggcggcgaggcggcggcggcgaccgatctgtgcggggagggggatcgccggagatgttcctggttgactggttctacggggtgctggcctcgctggggctgtggcagaaggaggccaagatcctcttcctcggcctcgacaacgccggcaagaccaccctcctccacatgctcaaggacgaggtaggtcgcccggatcgatcgatcgatcgagatttgtactgatttggttggttctgatttgtgttgggatttgggtgcagcggctcgtgcagcaccagccgacgcagtacccgacgtcggaggagctgagcatcggcaagatcaagttcaaggccttcgacctcggcggccaccagatcgcccgccgcgtctggaaggactactacgccaaggtttaccttcagttctaattctactgctcctatatctttgttacttgctgttagatttgttccttgtgcgatggatgggaagcagcgcttgtttgattggaacgaactagggttttaggcatgagggtatcggggattagacatgatgcatatgagtagatgaagaatcggtcgtcttgctcacttcatgggcagggatttggtggtttaattcagtaccgattgctctttttggatcttgcagaggaaaaaaaatcccctgattgagcaattggatgtgttgctggtgcttgtactcaatttagccatgagctccagcattcagattagttataataaggaaaaattggttctatgccatcgaaagttttcaatgggttgtcttgtgaacatacaagctggacaaaaggttgcacatagtacttttttcggtaaacttggcctgtttgtttcagcttagtcttattaccttctgcgtataagctggccttttgatttttgcagtttatgaagacctgcaaatttgagggtagtgtaataactctagtccataaaaaccaaaatgatgctaaaaaaatctagctttttgcttattagtgcttgtgttatgacttaaaaaaaggatgatgaactgttcgtttgctacacaaaatatgtattagcatcagttttttttttaattattgttctcttgttctttttcaaaacaaaaaaggcatgttcactataaaaaaaaagtgaattgctcatgttccgctgtgtttggagagcttttccaaatgtatgattgatgcttcctagttgaccaacataccaccaaagactatgaagcctggttaccactgctaataacgctggtacacaggctgaactgcagttttcggtggtatgttggcaatgtaggaagtctgagtgatatatctgcaaggttgtccagacatactggtcgatagtcaatttccactaaaaaagtcagagccttgccaaacaaagcatataagggtttaacaaacagaacaaatttacaccgactatgggttgtttattatccaattttaattgttcttgtgttcttcttttcccgaagaaagcactgacaacaaaagtttgaaattgtccatgtaccactatatttagagaactttccaaatgtatgcctcatacttcctcattgaccaatataccacaaaacactacaatgttggcctctttaccactatcaagacacttctcccagtccattttgtctgttgagcatcaggacattaataagtgtggagtgccttgctctacatcatcctctgtaaacagtctggggttgcagttttatgtggtatgttggcaatgtaggaagtctgaatcgtatatttgcaaggttgtccaaacatacttgtctgtaggcaatttctcagctaaaaaaattgaagtcttgaaattatctataattttgtcctctatatgtgcttaaaacttgctgagttcacatgccagttttttatgaaagctccctcgtgccaacaacaaggcaaatgaattagtttgcgtatattgctgcgatcaagggtactgtacattatgttgacctttacttaatctgcacaaattgtcatattttgtttcctttctgggagtatttcatggcttagctactattatagatggtaagtatgtttaaccaattttgaccaaccatatctgtcatatcaatcttgaactttagtgcttgaatagtttggagcatgatttccatcttcctctaagagtcctctttgaaaagataatgcgtcactttctcaggtttcaaacttcttcctctctagtccacaaaatgcctttcaaatttctgcagaaacacgttagaccaagcagttcacaagtttcaacaaatagaacaacttcataccgatcttgattattctcatgttcttttttccaaagaaagcatgtgaaccataataatttgggggattgtcggcatacctggagaactttccgaatatattactcatgcttcgcagttgatcaacataccaccaaaggacgggtgttggcctgtttaccgctgttgaggcaatttttcctcgtattttctggcaagaatcaggacatcgatgagtgccttattctacatgaatctcgggcaaacaggctttggctatagtttcagtggtatgttggaaatttaggaagtctgagtggtatatctgcaaggttgtccagacatgctggtctcttgcaatttccgctaaaaatgtagaaatgtaggagcctggccagatgaagcctaagggtggactggcttaaagaaaagaacataagtttcaacaacagtacaaatttgcaccggctatggattgttagcatcagtgatcagtctttgactatgttagcgttcttctccaaaaggaagtattcacaatgaaaatttggaattgtccatgtaccactatgtttggagaacttcccaaatgtatgactcatgcttccatgttgaccaacataccaccaaaatattatgatgttcgcatgttgccctgtttaccactattaatcaagacactccccctcctctcttttgttttcctggtgaacatcaatatattggtaaacaggctaaggttgtaattttctgtggtatgttggcaatgtaggaagtctgaatggtatatctgcaaggttgtccagatgtactgggctgtaggcaattctggcttgccagctgaaaatgtagaaggcttgatctaatatatgattttgtcctttgtactgtccttgcttgaaacttctaattcacatgccgattttctttacatgcaaactcaccctttcttaaaacttctaattcacatgctgattttctttacatgcaaactcatctttcttaaaactggactaattcacattctggttttacatgggcaatttgccttttttttttattccctgctgggaatttttccagcttagctattatcatgtattgcaagcatgtttaacaagtttgagaaaccatatctatatgtaacattgtcatatcaatcatgaacttgatgtgttgtatgatcacaatttatagtgtataattatcaaggtatatacgtgacgaacacttcatggactcttttggcactgagatctgtgcaaattgattcttaaagtcaagtatgattaactactggcgccactagtatgtgttatgatacctttagggtgcagggaaattatgcacgtgtcacgatattgatggcaacagtatcttccagagttcagttcttgctttaagtcctgtttgggtctcctggcgcagtttacaaatgaggaaactgtggttatggggtgccaacattttaactgtggtgttacgagatgctcttaatatgatttctataccattggcatcttgctgtcagagaaacaaagatatggggaaaatcgaatgttggcagtgcagtcatggactagtgagaatgggctggggaaccttcattttaagcctttatgtcccccatgaataatttactggaacacattttgtctacaattgctccaaatgtttggaatgcatcttttcaagccaatgtctgtatgactgacgtggtttcaaccattctgccctgcaataggccagaaggaagttgcaccatcaagctgaccaccaattctgtggggaaaaggaaatcctaattcgatgactacatgttctcaatcgcgagatgcaaaatgcttcttgttttgcgaaattcacatttggcctgtagtggagtagactcgattcttcatattttgtaactcgaggagtcattacttgttagactatccacctggaatttggtgacttaactttctgtattggctgtttttaattcctg

SEQ ID NO: 67903 - DNA, 594 bp, Oryza sativa
tactcctcctctctcaatcccctcggtcgcatgcaatacggagcagatgggggttaaaaaacgccattggcccaagtggtttcgctgcaacggttttgacttttatatgacagcggcggcgaaaacacgcgatggatggatgcgaccgagcccaaatgtgggagtggtagtcgtgaactacaagtggtgggcactagcttttattgacgagcaataatactttccataggttacaacaactgggagaaattcagtgtcgggggaaaactgaaaattcccagtgaaaaatacgggatcgatccgatgccggctgatggaatggatcgatatgtgatcatccgagaccatcgggcatgcacgcctcgatccgaggaaaaaaaaatggcgccaaaagattacaagaaacgaaaggaatctgctactgctgctactagtatagtgtactgtgacgtagtaatgtactagtatgtgctactactggtaatagtaatggacatggtgtggttttgttcttggcgattatctctcggccttccggtcggcgatggacggggtgaggcggagcgcccacttgatggcgagcgggcagctgac

SEQ ID NO: 67904 - DNA, 22847 bp, Oryza sativa
attcctgcagccccgcggcggcgggcggcgctgcggcgcgacggcgtggcctggcggcggcacggcggcgggcggaggcccaggcggcctcgcggcggcgcggcggggcggaggcctcacggtggtgggcggcacggcggcggaccgcggggcctcgcggcgggcggcgcggcagcggccgatagcatgtgttttttttctttttttttaaaaaatttgtgattcggatctgtgtatttgatttgtgtgtgatgtccgtgaatatgtgatgtatttgtgatgaattttgtagaagttgtgatgtaattttgttttaagattttgtgatctatttgaatatggccgatttggggatttgaggattggggataatttatttgggattttgggatggggatagagtaaaatcaatatattaaaaacacaatgaagaaaagaaaataataatagagcaaccagatctagctagctaggctagctctatctttagtcccggttggtgaaaggctctttttagtcccggttggtaacaccaaccgggactaaagatgtatttttactcccggttttttcacctgggactaaagatcgtcccggattggtagtcccggtttgaaaaccgggactacagggggttatgaaccgggagtaaagcccctttctccaccagtggaactaaacactgccaatatgtggagctcatgaatctttttaccctgttctgtaaaaggaagtgaatggtttccgaacccatccgttttgcggcatatttgcaaaagaaaagtaatttgtaaataaaacttttatatgtgtgtttttagtgatctaaaagcaaaggctggaaaataaacttcgatgaaaaaacccccaaatcaactctacatttaaggctaaaaatttaaattttggctgataagtataagtataagcgaaaagacgaggcttttcattagtttgggggcaggggtatatcaatttaataaatgtattttagatgaataagttaggaagctaacatgaacttgttttcttaacatacgtgtagtaagtttttacatgaatgtgatccatctgtcgacgattgaagtagacagacaaccatggtaaatgcccatggctagcaaaaaagagatttgggcatgcttatggcatgctaaaatgtggacaccctacgcaagatcttttaggattttctgtcgaccactttacaacgcgatgctctaaggagtggccttcttcaccatgtagacttgcatctagcgcagaggaaagccgttgccttttagggcaaggcttagataactaacgtggaggaaagttattgctttgtagggtaaggcctagatagccaacatagaatggagcgtttatctcgtatggtgttaaggtgccttctgcaagacacgaatgcagaactagatacttcatgtgcaccaacaccgatcaaaaaatagaatataatgcatatacctttgttgaccgaaaactctaaacaacttgacgacaccagatttgaggttcacaacgttgaattgaaggtgtgcaagaatcttgatgttgcctaggggtgaacgtgtttaaatttttcgcaatagataagtctcaaaactaggagcgcgtagatgcacttttaaggtcgtcgacaacctagagatagaggagccgacgggaggagagagagaaagagcatatggatggtgctagttgggtctaaggcaatgacactaagtccagtcagctttggagccaccgacagtgagatggatattagcgactcaggtgagaacaacgacgctatgactcttgatgaggaggagagatacatgagaaacaatgtgacgatagagtaacgtagggagaaaatgggttgttatgtaatttgttccttttctattggcctttatccgtaattttttggcctaaacaatatgaagaaaaatatattacattgatttatatcatttgaagccaccacgtattatgccgaagaaatttcttaagagcacgacttcgatacagtaggtagcacagtactgtatcacactttttctcccagatacaatataagagcatctccaacaacctccttatccccctctctaagttaaattttagcaattttggctcaatttcatcctccaacagactggctatcgagctggccaaagtcctccttccactagccaaatttggccagctaaaatagcctagccaattgtgggccccacgccgacagcatccctctcccctttctctctccgccaactgtcgtcgtcaagatgccatcgctggtgctgtcgaggttgtcgttgccggacgccgccgtcgcccgccgtcgtcgcgccggcgccagatccactattgccggacgccgccgtcgtcgtgccattgccagatccgagaggtcgtcgttgcgccgtcgccagccgtcgtcggcgctgttgtcaaccgtcgtctccgaggtcgtcgttgcccgacgccgcgccgtcgctagccgtcgtcgacgccgtcgccagattcgtcgccagccgaggtcatcgtcgcctgtcgtcgtcatcgccatgccccggcggattcggccggtgcggcatatggtagaggacgccgtcatctcgctcctgccgtcgtgttcgccgcccgtgccaattggccaccccgcgtccatgcgagctcggcccgagcggcggcggcggcggatggcgatggggcggcggcagcggcggcggatggctctcggtggcggcggcggatggcgatggggcggcggcggcggcacctgttgcgagctaagcagagtgcgtttgaggaaaaggggggagagatgaggaagaagaaagggttgtagagactgacacgtgggtcccactgtcataggcaaataatagagaggatgaatggataggctgttggagtaaataagagtttgactggctaaattagatggagagttggccaaatagacatttggagagttagatttggagagactgttggagatgctctaacaaaatcacaatccccattgtaattatccacggagtaccgctaggacctgtttgacatagctctaattgctaagtttaactctaagagctgggtctgtagtggagttgttgatcagactaaacccgctccacctatgtggtttattttgtgatagcacttcaacctgctccgtctcctattttaaaatggagttgaaattgtttggttggacttcgggcctgtttggatccagggactaagtccttgccacatcgaatgttgggatactaattagaagtattaaacgtaaactaatgacaatacccatttcataactttgaactaattcgcgagatgaatctattgagcctaattaatccatgattagtctatatgatgctacagtaaacatgtgctaattatggattaattaggtttaaaaaaattgtcttgcgaattagctttcatttataagattagttttgtaagtagtctatgtttaatactttaaattagtgtcaaatattaaaagagagtttagtcttccgattcaaacaccatcagcttcaatagctgtgaaaataattttcttggattcttacatggatgacgatcctgtaccgagcaccgtagcactagcacgttccaagggcgaccaaaaaggtactacacggttttgccctttccatcctgtacagcctccgagtttcatcagcattcgaaacgattttgaatcaagcgtgtactactactacccatggtcctggaattttcacccgcatctgccctgacccatcccacctccaccaccaccacctgcgccgcaagcatcagcccacccccgcagacgctggtcctccccttcctcctcccctgccgccggtgaccgttcctcctgtgcacacgcctcgagttcaaaactcaaaccccagatcagatctaaccccgacccaaccccaaccaggggcagattcgtcattctccccccacacctttattcgaatcttgcgtcctttgatgcggtaaaaaaaaaacaaacaagtcacgcacaccaacaccaacaataatgacccttctcccacacccccactgacgcgtgggccatcgcggagtatgggccccactcgacagcgacacggacgggggctgcaccgcgacgcagtccccggtccgggcgatttgaccggtcaaaaggcgtggccacgaaccaaaccccaaggcggcagcaggtgggccccacctgtctgtgggcgtgggccccgcgtcctgtggtggtggtgggtgctttgactgcacccctcccctccctcaggcggaaatcatttcggtttcggagagagagagagaggatttttttttccttcggcttatgtagtattgcgctgcgtcccgacaagcaaaagcaagaggaggaggccgcggctagcgagcgagcgagagagaggggagaagaagaggtgggacagccgggagatccatccctgtggagaggagggagggaggaaggaggcgttggaggaggagaggtgcgttgcggtttgttcgttcttgctgcttcgatttggtttgcttcttcttcttcttcttcttcttcttcttcttcttcttcttcttcttcttcttcttcttgtttgtggtttgaggcgattacaacgcgagttcgccgttctgcgagggcggtggctgatccgtctgctgggatctacgttttcttcgcggtttcggtggattttgcgggggtttcggggattcttgagacgtcggtgtgttgcggttgtgttcaaacctcccaagcgcgtggattctttttggggggtctctaatttgtgtcggcgattagtcaacgtggagcaattatacggatttccgagggattttctggtatttattgctgcaaatcgggcaagttcttggcttcggatggggcttggagtaaagatagatcatttacgccatagattcgtacccaaatgctcagttttttttattggtttgcactttccccttcgttagaggctcgtatgctcgcgcctgcctcatagcagatgcggatgagttcaaactcaagaatagatgcagaagagagcctgaatcaggaggagttcgtcaagaaacgtgaacagggtgcagggatccctattttggcttgattgaaggcggttttggagggggaaagttgcttagctgaacaacatttttgcgcatagcagcaaactgttgcttgtgttggagccgacggcaatgaaagaatgccttttttgtagctggttttggacataaagagtattttttatggttgctttcttgctaaaaatatggtgttttagtgcaagtcattcagtgtaaatctccaagcattcttatatacttgttccttttcctcctcctggatgagtcttggatgagtgcatttctctctgttcatctctttgctcttcacctgatgattgtttcatggtggatgcgtgttagatgcactgagttgcttagcatggtgaatcagtgctttgtgaactgcgtggttccactttttaactgatgtttgttattgacgatctcgcaggttgaccgatagatccattgcggagttgagtgttgatgcaaagctgattcgccatcgtttagctttttataagagatgggttcagtaggggttgcgccgtctgggttaaagaacagcagtagcaccagcatgggtgctgagaagttgcctgatcagatgcatgatctgaagataagggacgataaggtaagtctatcatgatgagaagtttaatttcttccatgtgccatgtaaatttgactttgttgtaacatgtcgaactgaatggtaaatccaggaagttgaagcgactattattaacggcaagggaacagaaaccggccacataattgtcacaactactggtggcagaaatggtcagccgaaacaggtgatttcctgataccatgttgtgatttcagaacaaatgccatctgactgtcgcgatctgaaattgttcatcgattataaagcaatcttcatttctaattgatattcttggataatcttgcagacagttagctacatggctgagcgtattgtagggcaaggttcatttgggattgtcttccaggttagttgcaacatctttgggttttcatatatttcaccaatcaccaggaagctaagtagctaacttaacatcattaactctactagcaccactttttttgtatgtagcaaattgttgatacacgataaccttctcttgttaagatgtcctaaatgttcttcatgtctgtaatagtgatatcattttgaccattttcaggcaaaatgtctggagacaggtgagacagttgctatcaagaaggttcttcaggataagcgctacaagaaccgtgagcttcagaccatgcgccttcttgaccacccaaatgttgtagctctgaagcactgtttcttctctacaactgagaaggatgaactgtatctaaacttggttcttgagtatgtgcctgaaactgttcatcgtgttgtgaagcattacaacaagatgaaccagcgtatgccacttatctatgtgaagctgtatatgtaccaggtaatattctgttatgtacctttttggatactttgttcttttgacttatgttgtgtagcaggctatattcagacaaactagccagtagcataccgagatgactttgaatttagtttgaaatttgttgacagatttgtagggcattagcttacatccataatagcatcggagtttgccacagagatatcaagccacagaatcttctggtatgcttgaatgttgttacccattcatctcaaataccaccctcttatttctgtaactttataattgatgtttgaacttctaatcaggtaaacccacatacccatcaactcaagctatgtgactttgggagtgcaaaagttctggtaagacaattaagaaatccacaacttgttatattataagcagttacagtctggtcttatcctccctatgtactaatttgtaggtcaagggagaaccgaacatatcgtacatttgctcccgatactatagggctccggagctcatatttggtgccaccgaatacactacagctattgacatctggtctgctggatgtgttcttgctgaacttatgttagggcaggtaagcggctggattttctttgcacattttggggaagtttgttgtttaccaccctggactctattgtcgaagtcggtatgccttacaattgttttctgttcgacagcctctgtttcctggtgaaagtggtgtagaccaacttgtggaaatcatcaaggttagtgccaattctggtgtttagttggccttgcgagttgttcggaggtgcagaagtttgtaacattaaaactgatcacacatcgcaggtccttggaacacctacaagggaggaaattaaatgcatgaatccaaactataccgagttcaagtttccacagattaaagcacacccatggcacaaggtgcaaagtctatctatttctgttgttatactttcagcaatcgtccagtatcaggtgattaaccatatatgtaaaatatttaggtattccataaaaggttgcctccagaagctgttgatcttgtctctaggctgctccagtactcacccaacctaagatgcactgctgtaagtatatatttaatggttgaagtacagataaattagtattatggcacttagttcctgagataattgtgcagacattcatttcataaatattttctgttacctttgaccaggtggaagcacttgttcacccattctttgatgagcttcgagaccctaatgctcgccttccgaatggccgctttttgcctcctctcttcaacttcaagcctcatggtaagttgtgaaacatgatcacatttatccttgttgatattaccagttaaagtttgttcaagcaggcacttcaattgttctggttatttccgttgtaaacttacaatttgggagctgcaagtcataactttctgatatgatcagctacttacgttgcccctttcttgtttcttgcagaactgaaaggaatcccatcagatattatggcgaaattgatcccagaacatgtgaagaagcaatgctcctatgcaggagtatgagacagcttccgcacgacccccctggaaatttccatgacaagtgcccatttcctcccccctggacgacgatggatcgtcagcatatgcgtgcatgatggttggtgaagatgtgaagttacgttgttgttgtatgaccaccttgttgaccagtgtagttgagtagcagtatgttgcgatggcgaaactttgacatgtaaccggtgcacccacaccatccctcccctactaaccctcacccacctgagaattgagaattcccatagctgatgatctgtaatatgttctagagcagtttaagaatgtatttattatggtgtagttgatccatatgttgggatcctcctcgtcgattttcttggttctttgtgccctagactgctacctggtttttagactgttctgaaaatgctgctagtaccttctatctactgtacttgtttgctccttggtgctattgctccagcctcagctatgaggatgctctggcatatgaacgtatggacaagttcgtcgatgacctgaccttggtagttttacctgtgttcgagttgtgctggtccaggtgtttggctgcgttgcaaggtgtgcaagtttggttcgtccgcagaggtcatctaaatgctgttaggagtctgctaacactacttgctcttggaaagttgtaggggctcattttggacgtagaaatttcacaagattttagcacgaatcagttcagttcagttacggaattcgtctaaaattaattgatttctacagatttcgcttgaaatttcgttcgttccaaaaggaggcgttccgtttcttgcagaaattaacttctctaaaatctagcgttcctttgctactccgtagtttccgtcgaataatgtaaaatataatcgaaatgtaaaattcaaatgtactgttgttcatgaacactttgtactcttcagtctcttttcgcccaacagcagaaactgctggagggagaagatcagaattcagaagagttgtcgagagagagaagagaagccgcggaagggggaaaaaagggaggcggcggaaggggatcggagatgccgctgggcaagtactactgcgactactgcgagaagcagttccaggacacccccgccgcccgcaagcgccacctcgacggcgcccagcaccaccgcgcccgcgccctctggtacgacgccgtccgccgccaaggttgcccccccactcctcctcctcctcctccccttcgctcttctcgctccgacaccttctgacccttctcccccctcccgcagagcttcacggcggcggcggcggcgctcctcccctcctccaccagcccggcgccgccgccatcggcgtctgccaacacttcgtccgtacggtgtgtacttgcgattctgccgatcttattacatctgttactactcaacgaggatgactaacatttctgcaattgaccccattttttggtgtttttttaggggacgtgcaagtttggggattcatgtagatacttccacccgaagccacctcctgctaatccaggaccagctccttctggtgactgtacttcttgtgctctgttttgtttttaaatttttgagtaaattttagaaaactgcaactatagtgacaaaactatcagtttgctgcaataatagcgttggaaataatcacaaaactacagcttttacgtgatatgctgctatagttgttacctatgtgtaccgtagcagtatatcatgtaaaagttggagttttgagataatttcctacgctattatttctgcaaactgaaatatatcagtaatgttgcagcaaactgatagttttgtcactatagttgcagttttctgaaatttactctaaagtttttggtatatttccgcaaaggtgatttttagtaagattcttcagtgaaagtctgcttgatgttgggatataattgttcgttatattctacaactcattggattgcctttgcccccattgggtgttgatctgaactatatagacttcattacgtactggcgcggtactgccattaggtcttcacagattcatatacagttgaattcatcttgatgttggcgcgcaaagcgaagacgctagcttgatgttaacttggtgcatcgaattgccgtgcaacttagttattttagaggatcatctgtattttgcccttgtttcggaattctaccaatacctttttcttcctccagttttatctaagatgaagtaattagctgcctgtaagcttgtaaccaagtctgttggattatatttttgcaccattgtagagcactgctcaattctctcagccccgtgtagtgtacacaaaacaaagcagggtagtatatttgtatgtgtgtgcaattgtgaattgcaaatacacaaatgcaactttcatgaaattagtagcctatagtactatccgcatatttgagtttccttatcagttgttactactattatgagtgcacgacaaatttacgacaatcactgttcctatttctataagataattcttagaacacgttgttctaaattagattaaaaactgtggataggacttaagttctgacttgcccttttattatccaggccctgtctctggaccaatggcgcagcagtctaatattcaaggaagtcaacccaattttgttggatatcaggcagcagatggaagttctttctcaggtgatctgattatggcacactcagcaaaaaataatattgttacagctagctggagtagtgcagaaaattgaatggctctcactgcttcctcccaactgatgattggattttattccaacacaacttctcgttttctgttctaattaatttaggatctggtttttagttcttacataactttctccattcagcttggattaaatcaatgaatggagacatttggtagttattatatgttagtcaagcacatcattattaaaatatgaacttaatgtcttgactctcgaccatagctgccgcaacgagtcgtaaaatggactctatatattacctttactctcgccttttttttgttgcaatatagtaaggtccaacgtgcattcatagcatattttaggtaggttgcttttgtagcatgccatgccacagctattggacctgtgaaacattattgtatagataatgtaaaatggggatagaagtgaatgaaaaaaatggttttctctatttattcagcatgttttccatccagtcacctgtcatgccatgaataggacactttgcacctgccaggttgccatgcaatcattggatgtactcctttatccatgtaggtccaatggttggtgctactaatgtggtgcgatgtttctaggcaatttgattgcatctctgtctgtcggttggtctcttttattgatgaatgaggggctagatactatgacatttaaatagtttggcttaccctagaatctgtggtcaaactactgaattcatgagaagcgtgctcaaaagccttgccctaagcaatgaattctgatgctctgggatgcaaaagctgcaagggtagcatatgttttagggtgtgtttagttcacaccaaaattggaagtttgattgaaattggaacgacgtgacagaaaagttagaagtttgtatgtgtaggaaagttttgatgtgatgaaaaagttggaagtttgaagaaaaaatttggaactaaactcggccttagtatattttgaagtatttataccagatctcactctagcgagtttcttgttgatagtaatatctaattgatttctttctctcttttttttctacagggaacattctagggggtcacacctcatggggcaacttgcctccatcactgcggccacctcctgaaggcggctatcctccatttccttttgtagactggggttgaattgcttgttaatctgaaggtgccatatgttgaaacttcatgccggctatgcaatagttcaaacacacaatgaattttactattgctctctacaaatgggtttatattagctgtgagaatgctctcatatgcagtggaacctgtacctctagtgaactgggagcctggttttcacttaaaatgctcctattaggaagtgatccctctttgtagttaaaattgtgttgtccgaagggagaagactaaaggatgtagctcccctgatctacgtggcctccaagaaaaagaacagcacgctacaacagacctcagccacagaccagtggctgctcgatctagaccttcctccagcctcaagctggacaacggagctggtcagccagctaatcaatgtctggagtgcagtgcacaacgtgcatttcacagagaatgaggaggacaagatagtgtggaagctcactagccacggtgaatataaggcgacgtcggcctacaaagcgcagctcctaggtactactgccaccaactttaacatcctaatatggaagccgtgggcaccgcgcaagtgcaagacctttgcctggttgatcatccaaaatagagtttggacctccgacagactggcaaccaggggttggcagaacaactctttctgccccttatgcagacacacccaagaaactgctctccacctcctcgcagaatgcagatacaccaggaaaatttgggcggcgttatctgattggactaggtgtggtcaactgaaccctggacaatggcaaccagctcaatcggtgttagagtggtgggaggccaccgccaacttgaaggaagtcccaaagaaagcactccgcacgttaacacttctggtcaactgggaaatctggaacgagagaaatcgtagaattttccagcacaaagagctatctacaggaagtctgttggccaaaattaaagaggaggccaaaacatggtctcgggcgggggcgaggcatcttggtagctggcttgctttttatttttagctcagtaggaccgaaggtcctgggcctggtttttcttactcgtaaagtttactccttctctattcaatgaaattggcagcttgccgattcgttcaaaaaaaaaattgtgttgtccagcctccttttggcactgtcaggtctgtaattgaatgggctggaaacctggatgggcagggattctagcccatcaacattatgcttccataagatatgttacacttaaacctagttactgaggtttcaattttggtctccatttaccaaccaacttttttaaatttgtagaaggcgtgttctataatctgggattttggccaattcacagtgccaattgtgcgtcagcaatcaggaagattgcatcactcatcagcctgacaaattttgcctacaataagggactaggctcatctgacgtaaagtcagagggacatggccactgacgtatgggcccatgaaggtgggccccacatgtcagggacccacgtccctctgattttacgtaagaggagctcggtcctacaataaggggcaatagccttatgctttctcttgatcttagaagcaacataccgagcttacaatttgcactgaccatacggaaaataatcaaagtttttttttcacacagaattacattaatagggaaggtccagcaaatctccattcgataggcaagcacacggctatatatattatcctgaaaaatatgcttgtctggataagtttgatcagatcgtttgcatccaagctgcctggcgatcgactccaggccaccgcaggcatgagaccagccaccgttcttcctccacatcgttgtcggagaagaagccgcatcgccggggcatcgccggatgcttcgaacaagacctctccgcctcctccgccgcctccctcgcgccgctgacgagctgcctctcctcgacgtcgacgccgatgacgattgctcgcagcagcagcaggagggaagccattggctactactggctcgtcagctcccaatggcggtttggaatgatgctcaaggaggagctacttatagtgagcttttaagttgtttgtttagaggtttcaggtaaatctggatttcttgcaaggaatttgcactgttcttgcaaggatatttttgctggtgggtcacagaaaggttgtgacaagggtttggttgttctggggctctgctagtgtggactctaggtgaacagaatcattaggcgaatgctgtaaatcgaaatatctgctagttcttcagtttgttcatccaacattctagttgtgcttttaggtgaaaaggatagccctttatgcatgcacaatgttctgtccttctctgtctgaatttttctctcggtttagcacatagttttgcactgcatgatttggtacagtgttacctaactgaataactgaattctattctcaattcgttcaattcgtgcactgcattagcaggtgaagtatacgccatgaccaagctctttgttggtcataccaactgctgatccaggcccagtacagctcgttttcttctacaaatggcacaaaaatgactgcaatgtttgctctctctgcatctcgttgatacatataacaattagcaagatatattatcagtcgtgtcaataccagttagtctgacaaactaaataaaacccttcagaatatgacacttgtgctcattctcatatgataatacgcctttctgtatttcttgtatgttctaaggcaaaatttgctacaggacaccgaaagattggaccctttattgtgagatacccgaagatcgtgtatttgctcgtggtcacttaaaaaatgtggtaattagctggcggacattggccgcattattttattattttcggtggaaacggagagagaaactttggttaaagacaagtttgcctatggtcaatctctctttctctattcttcttcttcctctctttctgtgtgtcgttggaccctcagctccccagccccggcggcgagcgacatgcatgcgtcgggcggagcgaacagccgctgaatccaggcaccacgatgggcagcggagagggcagcgacgggctggatcacgggctgcttgcttcttgcttgaagatgagaaaccaaaattctgctgcttgaggacgaaccaaacgacaaggagggcttgctgctgctaacaggtggcgtgagttggatggaattgccgcgccggcggcgggtagagcgatgacgacgagccgcggcgaggcctgacgggcagaccgcgatggacggcgtggacggccgactggatctgacgacctccgcacggatcgggccactctcgttgaacgcttgaactcgccgttgcggatccgacggggatggcgacggcggtgtcgaagtcagtggctaagccgcatcccaggttgcccaccaccgcgcagccgctgccatgaccgactgccgcctcccgccagccgatctcctcctccgttgctccccttcctattccctttcaccataggctttgcctcaccgaggagagtccgttttcccctttcccctctccctccacctctgagccagaccaccaccgccaccaccatagccagccggagctgagctctttgtgttgctgttccggctatctccttctcccctttgcttgacaccaccctccccggatgcgcgtcgctcaagaacatcatccgccaccaacgtagccgatccccggccaccggagcaccaacgccctactctctccctctcctctgttactcggctggaagcgggaagaagaacagtgtttaggggcattttgttacttacacaacgctttctctctctattttaaccggaaataataaaataataggagaaatgtgcagcagctaattaccactatttatagtacccatgaaaagatcacgatcttcaggtgtctcatagcaaagtctgcaatctttcggtgtcctgtagtaaattttgccatgttctatgagctcccaaataaacggattccaaaaaaaaatgagaaaattgactgttttgcttgctcagtagtcagtagcggagtcgaaataagaaacacaaaaaaatcactactgatggagaggctgaatatagttgcattatttctttttttttttaaaaaaaaaacttaaattcatactaactcaaggcttgttcagttcattgaaaaaaaaaaaaccttaccatttgttggtgtagacaaaatttagcaagattaagggcctgttcactttgatgccattttcaaccttaccaaattttgataaagttgctaaaaaagtggctacatttagtttgttgccaaattttggtaactatataagaaatcctgccaaaattttggcaagttgccaaaatggtaatgccaaaatttggtaaggttttttttatatcaatgtaaacaggccctaatatatgaaggtggtctttagtttgatacattacaaaattttggcatagttttgtgagtagaagtttctagaattaccaaatgttggtagcaatagtgaaagttgtgatggtaaaatcttgtttagtttgttgtcttatcaaaatttggcaatatcaatttttttagagaatggcaatataaaaatttggtatggttgattttggtaacaaactgaacgccctcaagtgcatttttcaaacggtgtcggggctagccctctggattgagatcaagcacattgccataactttggggtattttcagccctccgatctacagcgaacgaacgagagtaatcgctacagtatactacagtatatcgtgaatagtaccctggtacaatacatttgtctacagtaaacaactgcatatcactattgcatactgtaacatcagactcattttactgtgcgtctctaccatttgctcctaaggtcagaggagccggatcctagtcctccggcctccctccacaccttgctgtccaagctataaatgatatggcatcattgacgattgatcttaagaaaatgacactagattcagatattagaattatataatgaacacaatcagtactaatttctgaatatggaatatgtcatggtaacaatctgtgcaatcgcaaattaaccagcaagttatctcaaaggagagatatacagtttcaacaaaagaaacaaaatcagaaaattggcaattgagcagccacgttggttatctgcaagaatgacatttgaaaactaggtcagcatgccaataacacaacagcaaaacaaaagaaaggggaaaattatgagaaattggcaaaacaaagtttaatcaaaatcaagttccttttcctgatcattagtctcagcagctctcttttctaatgattctgtatcttcctagacagattttcatagctcatgaccctaggcctgcttttgccaagaaatattgagaagttgtagttgtacaaatttaattggcacacaagatgcctcaccttaagagattaaaaattatactcatttcatttcgtttcaggttataaaatgttttgactttggtcaaagtcaaactgtttcaaatttaactaagtttatagacaaatatagtaatatttacattaccaaattaattttattaaattaataattaaatataattttataataaatttatcttggataaaaaatattactattttttctataattttgatcaaacttgaagcggtttgacttcaaagggagggagtagcagtcatcgtccttgcaactgtattaggacacctggcccaagatcctacggacgaaagagtgaaagatcagagcccaaaaatagagaaaatctatcctacagtattccgtctcttcccttctttctgtgtctcttcccctccactcactctctctctctatcttcccctccactcgatccctctctctgtgactaccacccatgagcacggaggcggcgacgacggcggcggcaacgacggcaacggtgacgacggcggcggtgacgacggcggcggtgacgacagcggcgaagacggcggcggcggcaacgacggcgatgacaacgacgacggtgcaatcaccatcggcccccgcggacgacctggacgacagccggcggagctcctgaccatcacgggcgacgaccgccgttgagaagcctccccatcaagctcctcaaggcgctcctcctcttcgtcgttcttgtcggtagcttcctggccgatgccgccctcctcctcctcggcggcgctggcgcctcctacggtcggggagcggtggacgcggtcaccgggggcgagcgcttggcacaacatgagcgatgaggagctgctctaggcggcgtcgatggagccacgggttcggcggtttggagcgaggcacaacgacgagcgacggaatggcacaaggtaggcaccagatctatcgccttctcttcctcttcctccgccgccgccccgctgctcgacttccctgacccacgactcctcctcctcctcctcctctctcttgggatatcacgctgatacccaagtaccaaggcctgatacctagttatcagtcgatactcaggtaccaaggcctgatacctaggtatcagcttgacacccagggtaccaggtatcagtcgatacccaggtaccaaggcctgatacttagtattagctcgatacccagggtaccaggtatcagtcgatagtcgataccagggtaccagttgataccaatgtaccaggtaccacctcggtaccttacccaagatacgaggattggatatggtggaatcgcaggatagcgtgggcctccacacgaaattgatgaagcttattaaatctctcgggattttagttatcccgtgactgctaggagcaacggaataccgtggggtagcagccctccaaaaatatgcgcatgtgaagtagcaaaaccgaaaaaaaaaattggcaccatatttttttagcaaaactgtaccggagctgagcaccgttggatccaaatcaaccgtgggcagatgtactgctttacaacgggtggcactggtaaagccccacaggataacacacccgatgcgcgccaagctcgccgtgccggtcccctcgccggcgccgccgcggccgccctccgtcacgttccgctgcctccgccccagaacaccacccacccgtgcgcccgccacacccgcgcgcgcccttgggaacggcggcggcggcggcggtggcggtagccccctgggacgcgcatggccgggcgtcgccgccgcgctcttcggcgccgggttcgtcctcggcccgctcctcgacggcatccactcccgcgtcggcctccagctctaccacaacggcgccgtcgatgtcggccccctccacacgcacatcctggtgatgaccggcgacgcgttcacatcctccatccattaacgattctttgcatctttgctctgctcttcgccggagttgctgaaccgtggtcgccgtgccggcgcaggtgccgccgctgctcggagcgttctactccaccgtcgggatgctccagctgttcttggacgagagggtgtcgccgccggcggcggcggcgggcggatcgaaggccaccgggagcccgcagaagacggcggcgtcgctagtgttcgtccatgtccatgctgtgtgcacatcttcgccaccactgatgattcgtttctctggtgactaatgatctccgatcgccgccgccgccggtgcaggttcctggcggtgttcatcgaggcgagcgcggagatgtacagggcgggggtgcccagcaacgtggaggcgtacgtgctgttcgccggcgccgagctcgcgtggctgctcctcgacggcacctggctgggcttcgccgtcgcgtgcctcgtcggcaccgcctgccccctcgccgagatcccactgatcaagtacacatatatagctactagccacctcccacattcttgattctctcttccccccatcaatggcgtcgcgtcgagctcgcgcctagcttgattgattgatctcaccaacgattgcccgccgcatcgtgcgcaggttgttcgactgctggagctaccccaacgccgacgtccagcttcttggcgaggtaaagaacacccgcatcttctcactccctgaagcggccgccattggtgggagctgagctgagcatggttgcgtgcaggggatcgtgagctggacgacgacgtgctacttcgtgtacacgccgttcttggcgaacctggcgagatgggtcaaggcggagctggcggtggacgacgcagctcggtgacggtgaaagcgagcaagatcacaccaccagccatggtgtccaactgatgtgttcattctctgctcggatcagccgctgcccacactggacaacacgcacctgcaggactgagacaattgcagtggaaatcacgcagatcaatgtagagagagatagttgctgaatctcttggggatctgaacatttgacctgaagctaaggtgggattaagtttcatggcccagaattgatctctctcaagtctcaagtaatcgacgttccccatccgtacttctcgatttaactctgtcctaaatcaaatacttttaactttaccatcaatttataaaaagtgatatagtttgacagcatgtggattatatatcatggttactaaaaacataaatcttacctcctccgtttcaaaatatggcaacctaagagaggattagacgcaacctagtataatgtatctatatttgggacggaaggagtctagtgttaaactatataaatttttagaaccgacgataaagttaactatgtgacttactacaaagctgaaacaataagtgatttgaacatagcaagtataatttaaataagattggggggaggggggtaattagcaactgtaatcgatgaactatccatcatcggcacctctgttaatttggaccccatttgtcatttggcaaccacacacgctactactccctctattccaaaatgtttgacgtcgttgacttttttaaacatgtttgaccgttcgtcttatcaaaaaatttaagtaattattaattattttcctatcatttgattcattgttaaatatacttttatgtatacatatagttttacatatttcacaaaagtttttgaataagacgaacggtcaaacatgtttaaaaaagtcaacggcgtcaaacatttagggaaggagggagtataattgatccgctcagtcaaagcccgctgcctccgctcccaagtctggcggtggcagatccgatcctcctgaggccaccgccgccagatctgacaatggagaaggagaggcgaagggaggtcagccgttcccgagtctggcggtggcggatctcccaaggccgtcaccgccagatggacgacagagagggagagacaagggaggccggccgatctcaagtccagtggcggtgtatccacacaacccgtggtcgccgccgctggatcaacaatgaagaggaagaagtgagggaggttggctgctccgaggccgacgaaggcgaatccacccctcccatcgctggcagtggcagatccaccgccggtggccgtccccgttgccgacatcgatgtgtgccacactatcggacctgcctccgcacaccgaactatcatcgatgctgagcttctgccgagaaagagagagggaggaggacgaggatgaggtgatggagataaggtggagaggaagtggaggagaggtggagtggagaggatgaggggagagagagagagggggaactgaaatatttaaaggatgagctcaacctgatgatgggtttgtggcatgcaggcctctcaactgacccgtctgcgaaatatgtttattttcacaaacgattcttgaaccgtcaggatggttcttatctggagaaatcaattatgtagcagtgcgatacatacaaattttgaagtcctaaaaaaatcatctatttagaacggacgtagtactttttttctacgaacttctgtacgcaagatcattgaaatgccgtctcatgagtcatgatccaacgtcatgcatgtatgtaagtacaccacatactccctccttccctaaatatttaacaccattaatttttctaaacatgcttgaccattcgtcttattaaaatttttttgtgaatattattcaaaaacttaagtagtgtatatttaacaatgaatcaaatgaagaattaaaatttacttaaattttttgaataagacgaatgatcaaacatgtgtaaaaaagtcaatggcgtcaaatatttagtgacggatagattacacacaattaaaagatgccattactttacacgctgaaaatgatcggcgtctatataagaaggtaatctaacacggacagccaacgactacgagacgcgaggttgaagacaagtaagtactcctacatgcaacacccagacagagactagggcaacgcacgctagctctcgatcgagcaccatgccgaccaatctctcctcctcctactcctcactcttcgagccactcctcgccctctcctccctcctcctccgccgcctctccgccgccgtccgccaccaccgcggccggaacacgccgccggcaagcagcgacgtccctcctcctcctcctccgtcgtcgtcgccgctcgagctcgacaggctgtacggacggacggtggtggtggacgtggacgcgtggctgctgctgccggccgtggacgcgttcaccttcttcatggtcgtcgccgtcgaggccggcgggttcctccgcggcctcctgcttctgctcgtctacccgcttctgtgcctcctcctcggcgacggcgatggcggcgg

SEQ ID NO: 67905 - DNA, 1820 bp, Oryza sativa
gaaacgccgccaccgggcgtagcgccacgacggcaccgcgccgcacgccgccgcggcgccacgccgctgcgccacgcgccggcctgatgccgcgcgcggcgccacgctgccgccgcgccgccccaccaccgctccgctgccgccacaccgccgtccagctgccgccacaccgagaacgtgaacgagcgaacgaacgtgaacgagaacaaggtgaatgaacgtgaacgagaacgagcgaacgaacgtgaacgagccaacgaacgtgaatgagaacgagcgaacgaacgtgaacgagaacaaggtgaatgaacgtgaacgagaacgagcgaacgaacgtgaacgagccaacgaacgtgaacgtggaatgcaattataggctggttaatgaacgtgaacgaacaaatataggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcggagttgtccctcaagccggagtggtagagctagccctcgaaggaattcgcccaggtaagtgacgtaattatatatatatgattgttatatttgtaatgtaattaagattattagatttgtaattagacttaattagcatataagattgtgtagtgttctaatatacgacagttacacttagaatacatgactatttgagttttagtataagattattggagttttaatataagattattatatttgtaattagacttagtatataattattgactagctagggtcctataatatacgtcacctagacttagcatatatcactatttgagttttagtataagattattagatttgtaattagacttagcatgtaagattgtgtagggttctaatatacgacagttacacttagcatacatggctattttagtcttagcatataagattatttgagttttaatataagattattatatttgtaattagacttagtatataattattgactagctagggtcctataatatacgtcacctagacttagcatatatcatcactatttgagttttagtataagattattagatttgtaattagacttagcttctaagattgtgtagggttctaatatacgacagttacacttagcatatatgactgttcgtttagtcttagcatataagattattttagttttaatataagattgttaaaacataaatgtctcatgatttagcagatgtttcctgtatgaacagatggctgatcggatgagcgacagatattgtacgatacaatcgcggagggaagcagccagtactggaacgaagaagaggggaacgaggatccaaaccagtatttgaacgaggaagggaacgtggagagggatgcggaggagaaccaggaggggcacgtggaaagggatgtggaggggaaccaggaggaggaggctagtggaagtcaaccctccgttggacagaagagggcacgcgggcaacgaggtgccgcgaagaagctcgagggtcgacacatcataacggaagtggaagaagatggacctagtgccccggcagaagccgccaagaactatgtatgtcacagcggttggtttgtgcgggataacgtgtctgtcattacagtgtactggcgaagaacaagggcacgcggagatcataagagctttgtcccagactcggagaaagagatgttgtggaccacaatgctcgagacattcacccttcccgcgggtacagaggacaaagtgaaaaggtggact

SEQ ID NO: 67906 - DNA, 5924 bp, Oryza sativa
tcctgcagcccgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataagtcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaaaggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaagaggctgcatctgcgcaagggtgaggagccaatttttcggaccattcgacgcgtacgtcgtgcacgcgcgccgcctgccctgccctgcccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaagacccattcattaattccaacatatacaacaataaactgtgaacaagcctgtcacttgcactctaaagtaggtactgccgatatgataattgataacccgacaactgtaacttcacaattcttcgtcgagaacttctcgaaccaagaagccacccataacgaaatagaaaaagcaaaagactctagacaaatctaactccttaattgttatggaaagacaaaaccctatacaacaatctaaacttctaaagacttttttagaaaagccctttaaatacctaatgtaaaccaatgagaaacgggtcccctttctgctcacctctggtgaatacagtagagatagaggaggaggactgtacattgtaagggcttcgcgaaaagaacgagtggcttatttacactctagacttgtttggctaatgggatggtaaaatgatttcccacccaccaaaagacattttaaatcctaaccattcattctctctttcatttaatcataatccttcatctatttctcaatcccaatcccacccccattttccattatccaaacacacactctggagatgatgcataattttttttcttataatttaacatataaaatggactatgctcatttctttctaatatcaaatccaaataaaaaaaaatgtcttggttcatagttcatataagctgagcagcaaatatctatactttgggaatgttttctctaaagtttgacttttgtcatgtccagaagataaaactacaaagtcgaaatttccttaaaaaaatgccttctttctaatctccactccagataaaaaatatatattggtttgtagttcacatatgtaaaaacaatggagtattgtttatttggacaaataagttttgtacaatttgagaatttcacaaatgttgaaaataaggcgagatgaaaaatacaacctcaaaataaaaaaaaagacacaacaactagagaatagtactgtgttaacttttctgaaaaggctacgagtaaaaaaaatacttcttccatccacaaaagttagacatatttcacatttgagtttttccaaataagttgtttctatttgtagtctttatgcatttaagacttaaataaatagataaattaaatatttgattagaacccaaagagtcatctaataaatactcattggttgcatgcttatattcactccttaattttgtagcatctaagataatttaatttctccttagtcttggtgacaaaagtaatattggtaacttttatgtatagagtgagtgtttgcaaaactagatttataacttccatatagttagactgaatgaattagtgtcgtttctgtctttcatgtaagtataataataaaaaaggaatgtttttcctttcataattaattgcgtgggaaattatttatttagcaaatagagcaaaaggaacaatataatgaaggaaattaagaagagaaggggaaaaagaaattaagagttaaatatataatgaatagtttgtaggtgtggcaattaagcgtgagtttcggtccgccaaccgcgcgctcttggtcgaccacaacgcatgctactctcagcctcagccaaccaattctgcaaaatgcattgatcgatcgatgttctctcctccctagctgcggacggacttggatccatccatctcccattcattcattcattcattcatgtggccatccatccaccatcttgcatgctagctagctaccctgcaggcccataacgacattattcaattcgaattaattccatcatcatataataatatatatgatgctgagctcgtcggcgtcgaggcgggaggtcggcggcggcggcgccgcctccagcaccaagagcggcgagctgtccctgtccaaggtggccagcgtggccatacgggagtcgtcgggctcgggctcgggcgggatttccaagagcagcgaattgctgtcgagggcaggaaccatggcggcggcgagggaggcggcggcggcggcggtacaccacgaaggatggatggtgcgctacggccggaggaagatcggcaggtccttcttccacacccgctacttcgtcctcgacagcaggctcctcgcctactacaagaagaaacccaaagacaacatggtacccgccctaactccatcatcattcattaatcaatcaattattactactcgtactaatttcaaacactcttactatcactgccttgttttaattttccttcccctggcacacgcttgtctggccaattacattgtgtaacaaaaaaactcttttcattctaatatattgatgcgttcgcgaaaaaaaaacactcttactattacacatttgcactactactcatagtaaattcaaacacacacacacacactatatatatatatatatatatatatatatatatatatatatatatttggcaccaaaaattaaatatgcattaattcagtcacatcatctagaatatagtagcctttggatccttcttatgctttgatctcaaccatccatttacatatgcatttacaacccactaaatacatagttattagtataaaattcaatgtgcattaaaccataacatctacaaaactaatagtcattggatctctctctcatatttgatactccctccatccctaaatatttgacgccgttgacttttctttttatacatatctgaccgttcgtcttattcaaaatcttttgtgaaatatgtaaaactctatatatacataaaagtatatttaacaataaattaaatgataggaaaagaattaataattacttaatttttttaaataagacgaacgatcaaacatatttaaaaaagtcaacattgtcaaatatttagatatggagggagtatataactatcccagctgtcatgtaaaattgaaatttataatcaactactattgagcaaatattctctatttacatattataagtacttgatttacatattgctttcttttaattttctataaagtatttttaaatttcctgctgcaatgcgcgggatatgcactagttatatgtaataatgttgtacatgcatatatccatgcaggtgccactaaaatcgctgctgatagacgggaattgcagggtggaggatagaggactcaaaacacatcatggacaagtatccattatttcttctaatttatctcctttccgtaccatccttcttctcatgatatactgtatcaaccagctggcttttacacctgacattgcccccgtccttctcaattgacgatgtatcataatgatccttaattttcagatggtctatgtcctgtgcgtttataataagaaagaaaaggagcatcagatcacggtttgttctaactaaacctgactgcatgttctcgatctctttcattcagcgttatatcagtatatatatgactagatttaattcgcagatgggcgcgtatgatattgaggatgctctggcctggaaaaagaatatagaactcattatcgatcaggtgcagtaatttttcttcatcttacagttttgactttgcatatgtaaacacaacaagtaattttggagtactggataattctcaaatttcaatgaaaatccattttca

SEQ ID NO: 67907 - DNA, 7487 bp, Oryza sativa
aatggactttgatacggaactaggagggcagtttatattctcagaccatgacagcgcgtaagtgacatcccatcttctctcttagattatcttacaaacgacaaccaaacaagatctgaaataagctgaaatataatttcactacgaatatatgcagagctgaagatgaagaggaacgacctatgttgattcgcaggacaactatagggaatggtaacaagttatctgcaagttttgttcttaatttccgtttgtggatcgatatgctacagaaattcaccacctcatttctggtgtgctaggtccccctgaatcaatacatgactggaccaaagagcatgatatcggtccacccaatcagattgaccccattcaagttagctccaagaagaattggcgcctacttagatgccaaaatggcaagcacacaagactcctcctcctcctccttaggttatcagtcaatacttgtctacttgttgcttacttccttgtcattcgcaggactacgcatctttgaagaacttctggaattcgattatcttgtatgtccagtctactcactctcgactactgctagacagttaattgattagatactatgcatcttctgaaattcttgatgatttttcacttgtcctgtgtaggcaagaagctgtagcagagctatgcgagctgttggtgttgtggaagccacatgcgaagccatttttgggctggtgatgagcatggatgtaacaagatatgagtaagcatatttactactatcacctatatatattcctactacagttacatattaatcttgagattacgtactgatgtttaattattgatcatcacgtataggtgggactgcagctttcgctatggtagtttagttgaagaggttgacggccacaccgctatactgtatcataagttgcagttgcactggtgcccaatgtaactagtcttctttcttgtccgtagcattttcaaacatcctcctcctcttcttcttcttcttttttttggagaaatttcctcttatttttgagtgcacaactaaatggtagtactaatatttcggattatctatcagattgaaacttacacattcttccattctacatgaacatgcaggttagtatggcctcgagacctatgttatgttcgctattggcggcgtaatgacgatggaagttacggtaaaaatattcaaatcttttccatggaatttgctgttttgtagagcaattaatttctgattgtttgtttggacgcagttgtgctgtttcgatctacagagcatccaaactgtggacgtcaaaaaggatatgtgagggcttttattgaaagtaagcttctctctgagcatctgaaatcctgcattaatttacctgctgagatcgatcaggacaggaggaggagagacagtatactagttccatagaaaacagacagaaataaatgtcaaatgaagttccttttcttttctgaaattcctactagttcaggtggaggtttcaagatttctcctctcaagtgtcgcaacggaagaccccgcactcaagttcaacacctaatgcagattgatctcaggggatggctcctcaactactctccttcctttcagtatcattctttgctgcagatacaaaactgtgtagccggtactaactactgccactgctcgaaacttagtttgctcaaatgaattagtgccatcatcttactacttcactgttatcctaattaactctacttacttcaaggcctacgagaatacttctcccaaacagacgaaacacatataactccaaggattcctgtgatggaaaacatggttgacacatctgcagtacagaaagatgacaagaagagtaccgaagaagtagactccaagactaaaacaccagatcgaggacaagcggacagtaaaaacatgggaatcattgatgaagaaacagacgaggatgaggactatcaggttcctgaagctaacatagaggtgcttcatggccaatatataacattacatatgaacagtgaatgagttttttgtgtttcctcattctaactaaactgtgatcaaaattaattaatgtgcaggaagatcctaacaaagatgctaagcgtgcaggtatgattcctttttttttctgcaatttattttggtattaatctggtaagttccataggcaatcatatattcttcccctgtaacaatgacacggtttgccttgtgattatggcagacgaaccaccagaaaagattgatctatcatgcttttcgggcattcttcgttgcgatgcggatgagaaaagccgaaactgttggacagtacctgacagcaagctgtttaaagtccgtagcaagaacttcccgcatgataaatcaaaggtccaagcttttattgcttaatttgtttctttggaattgaatccagtgagtgagattatatgaagaagctgagcacactgctcacattgaaattacagatacctgcagcgagttacctgatggagcttgcggccattgactggtttaaggacagcaagcgtatggataacgtaggcaggcagaaaggctgtgtagcccaggtaaacataataaatcttgtgatcgatgatggcttatcctatctgaagttatcaagtagtatcatcacagaacttggcggcttggtcgatgtttgttttgtaggtagctgctgagaaagggatgcatacatttgttgccaacatacaggtaagtatgtttgcagattcagagctagctagctagctaggaggaaacattggcaatcaaagttatagttatgggtgtgtatatatatattgtgttgtagatccctggatcaactcattacagcttggtgatgtacttcgtgacaaagtcgctgaagaagggatcactgctgcagcgattcttcgatggggatgatgagttccgcaatagcaggctgaagctgataccctctgtacccaaggtaggtagtccagctgttggtctcaggtagtgaactgaactgaactgttggtctcaggtggtggggtggggtgtgcccgcagggatcatggatagtgcggcagagtgtagggagcacgccgtgcttgctggggaaggcggtggattgcagctacgtgcgtggagccggatacctggaggtggacgtcgacattgggtcgtcggcggtggccaacggggtgctgggtttggtgtttggtgtggtgacgacgctggtggtggacatggcgttcctaatacaggccaacacctacgaggagctccccgagcaggtcatcggcgccgcccgtctcgctcacgtcgaacccgccgccgctatcgtcccccaggaccttactccccctcctcctgcccttgccgacgacgacaacgccgctgcttcttcctccgaggatgatcatttgtccaagaaaaccaactaagctagcacctctctcaacgcacgcactgcaacttatcaatcatttatcttcttgtaatttctaattatttccgaggctcatagcaagctttgttttttttcttttcatctttttttttatctcgttaagttgtttgcaaagtacagctggttttcttctacgtaggaacaaagataaatctagctagtgacagtatttcgttggaacctaatattatagactgagatattttgtttaggcttagatttgctgtctttggctttaagtcagacttttaattaacttacactccctccatttttttaattgacgacgccattgacttttgaacacatgtttgaccattcgctttatttaaaaattttatacaaactatagaaaagcccgtgcgttgcaatgggtgataactattttaatcttattattgttatatggtttagttacgatgaaattcactgtgagaattcgcttggatttatatctctactgttttaaaattctgtagtggtgacggtgactccaaccctgacagacacgcgacttattaaccgtgggattggcagatcggacggtgctgaggatcccatcgcacgcgctcgctatccaaccgtcgacgccgctcccctcatccttcgccgcgcccccaccacgccttcaccgaccgccactcctgctcgcccgaatcgacgccgccgccgtcgcgggtcgacatcgccgctcctcctatcgcgctcctccccgccggcactgcctccatccatccgccgcgtctcgccgccggtcgcaccaccgatccattcctcctccgccgcctgctctcccggtccctcccgccccatcgccccaacacccccccccccccccggcaccgcctccatccatccgccgcgtctcgccgccggccgcacccccgcttccatccatccactgcagatcgccatcgcacgcctccgcctctcaaggtcgcacgctcatcgccgccgctcgtcgcccgacaccccgccgattggggaccggacgctgaccctgcatcgacgccacaacagccgacagatgggagatgttgaagacctcactccaacgacggctgcgcgcggtgacactaccaggcgttgagggagagaatgcagtgcgaggtgcgacggggttgttcgtccttgcccagatcaacgccgccgccgatccctcactcgcccctcgcccaggtcggtgccaagggcgaggttcgccaatctgcttcccagccgcctcgcccgctccatgggagaggtgacacctgtgcccgcctccagcgctccatgcccccggataccatccgagcacgatccctccggcagaacttctgccggagaagggacgcatggttaattggttcgttctctttacgttgcaatccattcatttgtcaagaatcatcattgtgagtgccgagggttattacagattacaggatcactaatgctcttttttgcccaaaaggtgttcaacgaaatgctgcttagccaatgtattaccagaaattgatttctctgtaagtgagaatgtcatattgccatgtcccctatgttgttatttatactaatgattgcaggattctctctgttgttatttatgctaatgtaatgaaatatccaattactatgtatagactctagagctatgaactgctgggaagttgagagtgttgctaccaagcagaaagattcaaattatatgttggagcaaactaatttggatcttgcagtctcaaaactaatctggtccttgattgtttcagagcggacgaaaataaaaaatggaacgatgcagtgaagattatgtaagcaatgttcgtgatatatcgatcctgaaattctcatagatggccattgcacaaatacaaaaatttgcaggttattaatagtgaactacatctctgtaaatctgcataacatatgttaaagctagcccaagaattaatatgttgtaaatctgctctacagttgacactgcttacattttctactattaataaccctcagttgtgatagatctgataccttcttaaaaatttgaactgagttttcatacctagcagtaggactaacattttatggttgtattgttcagctcaagatgaacaaccacaccaaccccaagatcaccaactaagcctatcctgcttcatgattgttgttgcaaactccaacatgcttgctgctggtgcaatctgagccggctggtggcagatgggagcctgccctatgttgttagcagcttttttcactccaagtcatgcttgctgcctgtggtcttggtagtttcttttttgtgttgtcaatttaattattaggatttcccatgtgctcggctattggtgttcttgtatctgttttgtttcagggtgtcattactatggagtagatcataatttttttcttatttttttccaatgccttgtaaaataaccaactagcagggatgttcataaatttcccccttttgtttggtttttttcagacatatatataatgaaggcatatatacacaaaaggaggagctgtttgagggtctaaaggacaatagctcaattgactgggaagttgttgtcatatgtcgagagcaatctgctaaatgttaaagaggtgcatctaacttttgtacccagtgaactgcaaatctgcaccttctcttttgattaatagtttctttggattcagatcaaaatagctcaacatgggaatttttctagcagaggatgggcaattcttggaaaatactatatatttcttgtcgttgaatgtgatcatgtcccattattctggcacttgctgccttgattttgttgcctgtgccagccctttagctagctctctatcacacacgaatgcgtgacccttgatggttgtatgcagttgggatattttggtgagttcatcccccttccccaccccaccctctctctctctctctctaaaccatcatttatcttcactattgacttacaatttcacttctagctgatgatgatcaatcaaagctagctcatacgtattagtgagtttatgaaaaaaaaaaggatcagatattcaataacagagttagctccttcagaacgatggcaaaatggtacctttataattttacttctcaacacgcacacatttttttatgacgagtttgaacttttgttctccttgtcagattttatctgaagcaagtatcatatacttctgtattagaatatggacgcaatcatatatctcctaaggtttagtacatactctcatatttggaagtgaataccaaacgtgtctgaaatagtgcatgcgatttaatctattctctcttaggcatttattcgcaaatgcaaagatttctgtaatttggtcgtagcttagattatggcaaccttggctttgtggtttgccatgtcatgtactgatatatgaatgtgatgctttaattaacgttgaaaagccatgaattatgtattcgaacaaattgattggatgtgtcctgaaatcggttcagactttcgttctttggttactggcgtgagacgtgggagaaagacgctgaagacatcaagcataacatggagttgataaaacatcgtcgactgaatcatggaccttgtcctggatgtagtttctttggctgctggtttattacactatagtaaaactaaggaccttgtaataggctctttgtgctggtctgacgtgaagtgaaaaccttcttaatgtaacttcgctaaaattagcgttttgtctgtttaagcagtatttatggtataaagaattgcatattgcattatattgtgacaaagagtattttctgaaattttgacaatttgaccattttgaaatttttatttgaagaatagatcgtgctaaaatcttattgcaaaaatggaccgaaacttattgcaataagtttagcgtggtctattctttaaaagaattgcgtattatattatattttgacaaagagcttctgtactcagctcattaaacctgcctgcttgaactatctgatacttaagttttaattaatgtcttgaatctata

SEQ ID NO: 67908 - DNA, 1092 bp, Oryza sativa
agagagagaataacttattgatgagcactgatgaggactcaaatttgacactctcaccctttcatacaaaactaatttcacatttgacgaaaactaaccctcacctcattaccaggatccttcgtcccaaaacaaactaatgtaatacgggatgtgacacattctagattcgtaatattagaatatgtcacgtcacgtactaagtagatttatttattttaggatgaaggaaatgcgtgtttataagtttttgatgggcctatatctaacaaaaagaatatcaagagattcagcgactctgccagatttgtgttcgagccctcgtcccctttcttcttcattcgtttttttatctcctgggaggaggatacacagcactacgttcactttcttatgttttaggcctattaattaaaatattaagattaaattgcaccttggacgagctattattatcaagttttatcctaaaccaatctacacttaatgtttccttttttttaccatgattctattgcttactgggctacccttctcttcacccatctgttgaccaaaactcaccacacacacgaaggcctgagatgtctgcttagatttagtgcaagtcctatcaaatcgggtttaggacatgctagttaatttgatcctataactaataagatagaaaaaaaaaagattagatcgtggggccaattgaccatagggccaatatattatcgtaagcccaaccgatgccgatggaatttcggatcgatcgctataacaacattgaccgaaacttagatataatatatttgtaaatcatctaactttattatagccaatcttaatagaccggaccaaaccgacacaatataagattgaaagtaacaaaattgaatctaaaaaatatatatatcttcgagatgcatgccgatgtgccaataatcaattaagacttatcattgctctatctgaagaaaataaactaacatcggatatgacaacttaaaatataatcaccaacaatttagggttattaaccaaaatctagatagatcgtacccaactgtgacaatataagattgaagataataaaacatcagctag

SEQ ID NO: 67909 - DNA, 13018 bp, Oryza sativa
gtaaaacctcatggaaactttcctttaaatctttctctcttctgtaattcttgtatttttttatacggtcgaaacaaacggtcgttcctatgtttcgtaatcctacgatttaaagaggtcctaaaaagaaagttatctaaaaaaaaggttaaaaagcaagtcatgttggtgtgtgtgagagagagagagaagccaaccaaatgtaagcccaccatccagatagagggaagaccaaccaaagagaataataataaataaataaatagtctcggtccaccgtcgtcgtcgtctagggtttcctcctccttcccagcggagatcaagaatcagaagcaacagctatggcggcggcggcggagggtgaaaagaagatgataacgctgaagagctcggatggagaggaattcgaggtggaggcggtgggcatggagtctcagaccatccggcacatgatcgaggataaatgcgccgacaatgggatccccctccccaacgtgaattccaagatcctctccaaggttatcgagtactgcaacaagcacgttcacgcctccgccgacgactcaacctcctccgctgacctcaagaactggacgccgacttcgtcaaggtcgaccaggccaccctcttcgacctcatcttggtaacccattccctctccactccccgctctcctctcctctcctctccgattattttttttatttacatacagcgcagagttcgtccagatctatctaggttgcactcttctccctaccctaggtcttggctttaccaatatactccagtagtagtatatttctatattggtactactccactacgtcttaaataagtaactactccctccgtcccaaaataagtgcagccatggttttccgcgccgaactttgactgttcgtcttatttgatttttttttaaaaaaattaaaaacataagtcacgagtaaagtactattcatgttttatcatctcatagcaataaaaatgctaattataaaaaaaatttaaataaaacggacgaccaaagttgggcgtggaaactcatgactgtgcttattttgggacggaggtagtagatgatttattatgcctatgtgaatctggttgcgtgttgttagcacagcttatctgatgattattgcgtgtccttgttttatctcccaaatcaaacccattgtgtacaactctaggggctgccatgctttttatttccatttatttcaactagtgctcttcttttcttgtgcttggggacaatgttgatgggtggtgggtttattactcttctaccagtaacgctgtcagtttgtgtcaattgatactgtcttcacttttaacatccataaatgcattggcttgctaagccttaggttgtgtttagttccttccaaagttggaagtttaggttaaaattggtacgatgtgactgaaaagttgtgtgtatgacaggttgatgtgatgaaaaaagttggaagttcggatctactgtctttgtggctcaaatctattgtatgcttccttgtctccccccctcccaaaatggacccttctaggttttcctaatgcattatatgtttttgttactgttgcaacatacttggcagtacaattgatgctcggacttatatttattgtgctagcctttaaatttataatcatggtaccctttttaaacatgtggatatattgatgttcaattcatttaggcaatgtggttaagtgatccttctgtcattaattgtctacttgtctgttgtgacagcttagtgcttttttagaaaccaacaattaactgtgactagtgggctaacgttacctaataattggttccatacttgttactttcctcttacctcctaattacctgtattttctctagggatagtgcacatgtatccatgtttaattggaggatttgctgctctttaaaaggacaatagatgtttgatagtatttaactaccaagtcccttgacatgttagtggcttcctgtattagtctgtctcaatggattttccacatatatacataataaatagtggaaaaatatgttgcccttgaagaagcaaagagctgtttggtatgtaattgtgaagcatgtgttgataaaatgtttagttttattgttgttaacctgagatatatagatctgacttgtgaagtacttgcctaacacacggatgaattggtccacctgatttgctctttggaaacataatgtatgcctgcttacctgcctttgttattctgttccagttttaactcaagtgtgcctagatgtgttgattattttctgtatgtagaaaggaagaaagaaattgattgtccacctcttgcaggctgcaaactatctcaacatcaagggatgggattgctggatctgagttgcgcagaccgttgcagacatgatcaagggcaagactccggaggaaatccgcaagaccttcaacatcaagaaggacttggcccctgaggaggaagaggagatccgcagggagaaccagtgggcgtttgagtagagatgcagcagctgctacatgtggccggtcggttgcaatggttgtaattattttggagtgagaatgaatggtggggtggggggggggggtgtggttagtgaaggaaggatgaaatgaaatgggggttaggttaactagctggtttatgaagtatgggtatggaagggaaaacaaaaactgaagattgttactataaggatgttatgtgcggctgcctagactgcagttgatatcgtctggtggatggatgatttattactgggattataaagtcatctgattgtcgtccattgtctcagtgtctgtctgtctatctatctaatctgtgccgcagtagtgttggaggaagtgccaggtggtgaggcagcagcgagtccaggccaagccttggcctggaggaaagaaagaaagaaagatgataaggcggctgggtgtgtctggtctctcctggtgttggttgccacacgtatatttgggccccttatccatccatgattttgttttgttttgcgaataattttggcgcctcaagttagccgataaagttgggagtagtacactagtagtatactagtagtagagtgagctcaagacaagaagcagtagcgagtccaaggcaaggcaaggcaggcgaaagcaaaacaagaaatggcgaagccgatatcgatcgaggtgtggaatccgagcggaaagtatcgcgtggtgagcaccaagtccatgcccggcacccgctggatccgcctcctcgccgacaacgactgccgcctcgaggtaatcctttcctttccttcttaggcagcgattacttattgcattacaattacactagtagtggagagtcaattcattccttgcttcagatctgcacggagacgaagaccatcctctctgtcgacgacatcctcgccctcattggcgatcgctgcgatggtgtcatcggccaggcaagcaaagcaattgcaatccaataattttgattgatttcttcttgttgataacaaattaagtgcagctgacggaggagtggggagaggtgctgttctcggcgctgaagcgcgccggcggaacagccttcagcaacatggccgtcgggtacaacaacgtcgacgtggaggccgccaataggaacggcatcgccgtcggcaacacgcctgtcagttctgccgccctctgcttcttgatttctagactatcttactggatggtaatttacttacatacgtacacatgtacagggcgttctgacggagacgacggcggagctggccgcgtctctgtcgctggcggcggcgcggaggatcgtggaggcagatcagttcatgagggctggcctctacgacggatggctcccgcacctgtctctctctctctctctctctctttacttttactactgctgctagttgatagatactcatatatgtatatatgtatatatgtgcatgcaggttcgtggggaacttgctcaagggtcagactgtgggagtcatcggagctggtcgaatcggctcagcttacgcaagaatgatggttagttcagttggtaccttactagctaggactattattattatagtaggagtaattatttgttcaatttcgcaattgcaccacaaaattactcatgtaaacatttccttttaccacagatcgagggcttcaagatgaacttgatctactacgacctgtatcagtccacgcgccttgagaaattcgtcacaggtatgcatccaattttatagtactggctagttaatttgtactccctccgttctaaattgatctacatatttcataggtacaccaagatcaataaaaactaataactctctcatactatatttactctagcaacaaattcaatgcatgcaccatccctaatattttctagccaatagcaaatcaaaatattgcatgtgggttataaatacttgtgtgcatggatgcatgcatcaatgtccatttactccaatgcacaaataacgaatagactctaataaatgaacacaaatgtgtagatcatttagaaataatctaaaaaactatatgtagatcaatttggaatggagggagtacgacattaagatagatagattagattagattaattaatgacctgcacattgatttgaatgcatatgcatgtagcttacgggcagttcctgaaagcaaacggagagcagcctgtgacatggaagagagccgccaccatggaggatgtcctcagggaggccgacgtggtcagccatctctctcatcgtctcttctttctttcttcattctaattattaagatgttgattaattatgcaaataaatgcttgtgcatatatatatatatgtatgtggcagattagtctgcaccctgtgttggacaagaccacttaccatctgataaacccggaaaggctggccatcatgaagaaggtgcctgcctctctgcctctgttaatttcttctctcggtcctcttgatactgtagtactatgcagtgggtaattaacagagcatgtatacaaataatctaaatataaaaatacaggaagcggttcttgtgaatgcaagtcgaggaccggtgattgatgaggtagcactggtggagcacctcaaggccaaccccatgttccgcgtcggtcttgatgtgtttgaggatgagccttacatgaagcccggcctcgctgacatgaagaatgccgtcgtcgtacctcacatcgcatctgcctccaaggtccactacctgcctgctgcatctgcttatatatatatatatgcctagctagcttgttttattttctttctttctttctttcttcccataaaaatatccatccatctttacgtactactactcctacaactactagtaatatgaatcaaaaaggtactgactaatatagtatataatttgcatcattctccaattctccagtggacgcgcgaaggaatggcaacacttgctgctctaaacgttcttgtaagtactccttccatatgcatgcttaattagcctcagcccaaatattatactattgatgatgaatggaacacacactgtgtgagtgggtctgtctgtctgtgcatgtttgtatttgcactagatcgattatataaacctgctgatacggtaataataataataatgcagggcaagatcaagggttatccggtttgggggaacccgaatctagtggagccatttctcaaggaggatgcaacgccgccagctgcttgccccagcattgttaatgccaaacaactcggtcggtactactacgtaccgttagttaattcctattcattgcctagttaaaattaactttaactgcatgcgaatatatatgcgatgcaggcctgccatcgtcaaagctctaagaactggagctcggtccatcatattatatctgtcggttcaagatcatactccactacatgaagtctagatcgaggtgcatatgcttgctgttctagcggagcgggcaacaagctgtcagccagacttttgatatctaatttcacacacacacacacacacacacacacacatatatatatatatatataatatactagctagcttcaattccttgttattataccactagtacgactgtaattttgtgagtcttaaaacatgcgagctacatgtatgttattacacccgtactagctactactgtagattaattactgttacgaaatgaagataccctagctgcctgtttgggaaacgtacgattaatcatcaatgacaaagatttacagggctctagctagctagcactagcagcctgcggagagagagaggaattaattgatattagtaataactagcacatacatatgcatccttgcgtatagtaagtggagtaagtttataagggaagaaataattaagggaaaacctggcttagctgaagaagagcaagcaatactattatattatataatccaataaaagttgaaacaaaaaagagggagcaaattaaagcaaaagctagatatatataatataataatgatggacagagatatatagttagtcgaggaggagtttcttgacgtaattatcgtagacgaagtcggtgaggatgctgtaagctttctcggtggggtggtagctgtcccagaagagatagtcggagacgggggtgcagacggaggaggtgagggcgttgcagaggacggaaacctccaggaggccagtgccgcagcaacccatggtggagtcgctgaagccgtacgcccgtggacgcatcatcatgtccatcaggaagccgtagatgtccatgaaaacaagcttggtcttggtgctcttcttcttggcctgcatctcctccatcctcctcttcatcccggcgttgtacgccaccgcgatctggttgtgcccctccgagcagcgcctctccatgccccccgacatggtcctctgcgacggcacgcacccgatgggcggcatcccgatgatggccaccttcctcgccccggccttcaccagctcgtccacgaacgccgccgcgtggtgcaccagcagcgccgcgtacgaggcgtggtcgtagccgggcctcgcccgcatggtgaagtaggtgttggccacgtcgtcgctgccggcgcagatggcgaagatgcccctggtcatcatgtccgccacccgcgcgtccccggcggcgccgcgcacccgctccttgtactgctggaacagcagcagctggtcgggcatggagatgacggaggccaggcgaggcgtcagcgggtcgaagccggtgccccccgacgcgaagctgacgccggtgaggagctcctcagtcgacagctccggcgacaggtacggcgggagaagctccttcagaccaagacgggaagctgcatatgcattccgatcgatccgttgttagttgttgttgtgcatgcatgtactcctatgagaaatgagaattgacaagagaaagaaaagcatgttgctagttaccgatgaagtcggttggtatgcgtccgttgcagaatctgccggtgggggtgtggttgtggaagtcatggccgtagggagggaagttggccttgatgatggtgttgatgccgttgttgttccccgggtccacgatcgagtccccaaacacgatcagcgccggcgatgacgctgcctgcaccaccaccaccggcaccgccgcccacaacaccatcaccaccaatgccgccgccgcgctactgcctcctcccattctcattctatctctacacgctctacgtactgccagcgaattgaatctaagcacagcaccgcgcactctcagtaaaattaaagtagcaccaggcagctagctatgtttgtctagtatttatagacgaccaaattcaagcatgatttatcgttggcgtgcactgcacttaacaccgccgctcgcaacatatattttcaatttgcatcaacctagctactattattacgtaccccgtactagatagagttggcaacctacgtacgtactgtaccagtacaacccatactagatactccatccgtttcaaaatatttgacaccgttaactttttagcacatgtttgaccgttcgtcttattcaaaaaatttgtgaaatatgtaaaactatatatgtacatgaaagtatattttacaatgaatcaaatgatataaaaagaataaataattacttaaatttttttaataagacgaatggtcaaatacgtactaaaaagttaacggcgtcaaacattttgaaacgaagagagtatatagtactatgatcactaggagttgttttcttgcacatcatctaaatagttattattttttatatacacgacttcagatataattgtaaacgtgcgttgactagtttcagttgaccattcgttggcaccgcaacattacgcactgactttctagccttggaatcgaacacggcttgcatatatagataccggccggtgattagctcaaaccaaccaggcaacagaaagtcaatatttaggaaaacatataatataacactatacgagattatgtttaaaacgtcaataattttaaactggagggaggattactgacagaatatcacaaattgctactacgattaacgagctaattagtggatacttagtacccctggtatctagattcgacaacacatagtagcggatagggaatgaattctaatgagaatgttctgttatgtatttttttaaaaaaaactcaataataatacaaatagttgttaaaagttccaaaaaaataatgtagagtacggtgacatctatcagtaaaaaaaaaattagtccaatctacacatctctactattataaaaattgaagatgtttttttgccgatactttggtacgtcacctatgtatgagtcggttttttacgttcgttcacttttggaaatacaaatctgtatgtgagtcggtttttaaattcgttcgcttttggaaatatagaagaaatcgtataagaaataatgatcgggctcctaattgcagcttataattttctaacaatatatatattcaagtgaatttcaccttaactaacccatataacaataataaataaaatagctttcaccagttgcaactcacgggtatttataaaaattgaagatgtttttgccggtagtttggtacgtcatccatgtatgagtcagtttttaagttcgttcgcttttggaaatacaaaatgaattgtatatgaaatctgtttaaaaaaattggcatgctcacttgagacgatcggactcctaattatagctcatgattttctaataaaatatatatccgagcaaatttaacagtgaatttcatcttaaataaaccatataacaataataagattaaaatagccttcacccgttgcaacacacgggcattttttctagttgaaataaaaattcagatacgaacaatacgctattattcatacatttcgatgtgtgagttgactttggatctaagattttataatgtggtatacgtgtgtatgtcatggagtgttatcaagtgttatgagattttttttccataactatttaaataaattttaaacaaacaaggagacatcctctcctggataaaaatagttgccctagtacatactacttgatggatagaaacctgcaaataaacagtgcacatgggcgagtaaatggctgcctgtctgcctttgatccagtaccgcattcaattcaatcgtctgctctcctcttctcccattggcattcaattcatcttcactagtgggtgggtatgtgtgtgttgggggcagtacaatttcttttggaccaggccagcatgagcatgcagcatcgaagagcaagtttaaatagtatagctaactatgcgctccaattcttctatagccaatttaatagctcatttatacaataagaatactatactactaatatatggtcctacctttcatacacacacaatgtattagagtctgtgctacagctgactataaatctgtagctcgctttacttctctcttcttttctctcctccacatgtgtatacagctgacttgtagcctgctactgtactcgctctaaagtaaactgtgactgagccagtatgccattgatagatctgccatagatttgcatgcatatttgagcaaatactcgtagaaatcactgggtctgggtgactgggcctgtgggctcccacaccagctatccaagcattccaagtactagtgttactgtactactcctacatactacgccagcgtccggacggacagtatagctgtgtttagatggaggaaaaggtgaaaaattaggagaaagttaatagtttagagaaaaagttgttagtttatatgtgtagaaaagttttcgatgtgatgtgatatgataaaaagttgagaatacgtaccaactcgatcgatcaatcgatagacgtgtattaagtactacgaacaatacgtacctccaacacagggtgggtctgcataaagtactacgtacctctccatcacattttagtgtaactttggatttctgtgttcaatatttgaccatttatcttatttaaaaattaataatttttttaaaataataatcacacataaaatagtattcatgtttttatcatctaataataaaaaaatagtaatcatagaacttttttaaataagacgaacgattaaatatttgacataaacaatgtaaaaccatgatgtttctgctacggagatagtagtactacggtatgcattgacacacagaccccatcgaccaccacgaatggtattgatagtagatgcaccaatgtagcaaacacggcagctaattcaccttgggatactgtcctggtgattggagtagtcgttggtttgacccatcgttgctgcatatgcctgcgtaattgggtccacaacaactgctcgcttctacgtacttctacgtactccctctgtcaaaaaaaaaaaatttaaagggttttagatagatgtgatatatcatatactcccttcgtctcataaaaagtcaacctaatatttgatgagatgttttttagtccaatgaatattctgaatatgagtctgtctagattcgttagactagaaaacatcacatccaatactaggttggctttttatgggatggagggagtacgtttatcgaaatttattgtactaagatatgtcacatccacctaaaatctcttatatcataggacggagggagtagtagggcctgctgctgtgatattcagcttagtggccgagggatctagttggtagagaagatgaacaggagagacagaaaaaaaggaagaaggataatttggtgtaaaaattctagaaattatattgaagaggtaagtagtggcatatttcaaataacagtaaaattgtaatggtattacttcagataaatgaatagtaatgatatattttaaaaccgtaaaagttacactgacatactccctccgtaaaaaaaaagccaatcctaacatcccaagacaaaaataatggagatgaagaatgactaaaatgtcaggtaaatggtattgaagtgataaaatttaaactctagaagttaaagtttttggatggagggaggagatctaattaagcctataatatactggtcattgttgttaatcttccgaccataataacaatataaaaggtcgttccagctagctagccagccagcgatcagtcagatcgactccagagcagagccattggacgatatcgatggacctgacctgcaggctgcagcatctgcgtgcatgtgttgcatctatctacatctgcacgcatcacataaattgatcataaattccatctatggaccttaattgctttcaccctcaccaagcttctgtatgatatgactactgagctatactccctccgtaagggcatctccaactggatggccaaatagctattcaagtcaaaatttagctaacttagaaaaaaaaaatgctccaacagacttactaattggatggctaagttatttggctggctaaattcctcaccacacttgccaaagttggccagccagagggcttgccatcggtgtgggtcccacaccctctctcctttctctctccctctttccccatcccgtctgctgctccctccctgctcgcggcgccatccgcccggtgccgccgtcgccgtccacccggcgccgcagtcgtcgtcctcccggcgccgccgccgtcatcctccggcgctgccgtcgtccatggagccgagtgagaggcggcgcagggagaagatgcccgtggggtcgagctgcacggtttggtggaccatgatgtagcgcagctcctcatcgagaagcaccatggcgagctgcacggcgaccccggtggaggaggaggactccgcgccgccgccgccgccgccgccgccgctgccgcgcgcgaggagctcgacggccggtgctttctctgagctaagccatggcaagaaaggcacgagaggaagaggaagaagaagaagaagaggaaggagaagagcagtcagggcacggggatcagtggcaagccaatgggggcagcttcttcttcgatgcagcatctgttcttgctctgccgcctcctcggcttctgctttgcgttcacggcgagccagcagcagcagtcggactcgtgtagcagcgccggcgtcgcggtcgcgcatctcgccttctgctgcctgaccgtctggaagcaggaggacttcgtcctgcgggtgtgtatgctactgaattttgcagtcctaccagttattggaattttactgcgtaccaatttcatctcggtgatttttttttattttggatgtcattgccaatgcacgcctgcagagtgcaaattaacaggcttggtagttaaattgattagagttgagtaattaacaggctcgcgcgaggtaccgcgccgtcgactcgcgcgggagaaagaggaagtaggggagaggaggaagaagaagaagcaattgacgtgtggggaccagcgccatagaatta

SEQ ID NO: 67910 - DNA, 5856 bp, Oryza sativa
ccgcctctggatcagcgcggggggtggccgcgcgccgcgcgccgcggatccgccgtggggtggccgccgctggatctgccgcagccatcacgcgccacctcgtcgtcgacgccgctgtcgtgccccaccacattttcgtcgccactgtcgccgtagaggaaggccggggagagcgccagccagatcggcccggggcctcctcgtcatcggcccgccgctcccgctcgtggtgaaagaaagagagggggagaggaagagagaaatgacagagagaggggagaaatcaaggagggggatgagaaagggaggagtgggcgcggctggattaaatggtagacgcgtattttcgtgtgcgaaccacttaacacgctattttcgcgtgcggacgtgttaagtggcccgcatagaaaaaattaatttttctgtgtgggtaactgcctgacaccggtcctatgattattctgtgcggttttccatatgatccgcggggaaacaaaagtgttccgcgtccaggaaaatgagttgcgtagtagtgttgtacctgctattagcagcgggcggaggagctcgtttaggatatctacttgacctaaatatggtactgggtatatcatgtcttgtacctcataggaactagctgatatctacgtggtatcatacgtggtatcacataaatatcgaacctggtatttgataattatatcgttccggaatcggattccgtgcattagctccctcttaataaaatcaatggtcaaggtcttttaaagtcctattaaaactaaaaggcaacttgaaaaggtgaataattaaattttcgaacattaaaaaagataaaatatatggagacaaacacgtgccgaatttgagttaactatattaggggatttcagttaaatctcacaaccacctaatttgttcgaagattcgtgtcttagcccaccttcaactctagcgaacatgtctctcctctaatccaacatatcaaggtctggagttgaaatccaacaactttactactacctccgtcatagaaaaggagtcattctacatctccaacaatatctcacaaaacgtgtcgttacagtggcgaacttgattagaaaagtgggctatctgtccatttctgtcaagtcatttgttaacgagtgttcaaagaattcattaattaattatatgtagggattcttagtaacatgttgagtgtatgataaattattgaaatgacaactcaattaaataaataggggtaatttagttattttaatacaaagataatttggttgacaaatcttagaacgtcaagaatttcttgacggaagaagtactttacttacatatcaaggtctgtagttgaaagccaacttatcaatgagtaatgattcttagctttgattataggaagccagggaggcagtgatatgacggcttgacaaaagggggtggcgcgggtttggtaccaccggagccacatgaggaggctgctaatacagagtgacagagctagaaaatcttcacgcatagagagaagctaatgggaccttaaatatttttagtaaatcatatatccaacatttttaagataataataaagattatggagctagtctagggctgaagccttagttgctcatgcgtattttcgcctatgctaatatagtgagagtgacaacaagccacggctgtttaggaggcaaaaggctattacactactatagaaatgtcaaaataggactatactatatgtgccagttcataaaaaaacagcacttatgatcttttctcacccctcagacgcgtctaaaataaaaaccgacacctttgatcccttgcaagtgccggtttattaaaaaaactaacagggttataggtactaattgtttttttagaaaaaaacgacacttacgaggagctgagccgacccggcctttcacgggcgttggtttttcacatacgccgagggacacatcctctcccttgtcctcttgtctctccacctctctcgaaccctctccacctctctccaactcctttctctcctgtgcaacaacgcaatgacctccctttactcgatgtgcattatttgatttgtttttggaataaacttgttgataaatggttggtttctatgacgaaaacttatcgatatctatgaacttgtttaatatttgatatgaacatttctctcttttttttagattttattatttatttttggtggctttgtggcatccgatataattgagctgagtcagaccgtgttttttttttcaaaccatatatatacctctcaaatgtgtcggttcttgattcatcctcatcaataccgcctgaggggtgttggttgggaaatatgttacctatgggagttcccaactgacaccaatgatatttttctatagtagtatcataatactccctttgtcccaaaaatataacaaactataaccgaattagatatattttagtactacaaatcttaacagagtgcatatctagattagtagttatgatatgttcaatccaattctacattactatgttttaaaatattttaaaaaagatgaagtagtaaacttggactcactaagaacatgcatgacgacccaaggcccggtgatcctaagtaggcgtagtctcaccgatgggttaacattttttagactacatgttagagacccggcttttaatcgaaagccatccgataggttaacataactatgtactaacatagtacactatcttatgattttcaccactacttacgcatactaggtagctcccatgtctagagtatagaaatatgtagccacacgacagccgacagaggatcagcctaggacggattaagaagatgacgtgaccgatcacacgttgaaagttaggtggccgcagtacgcggcggacggagggagatgaagcggtgtggaaaatcaacgtcgggggtttacctgaagcgcgctagctcgctcgtaccatgtgtgagatcgatcggtgacatgtgtgtgcgtggcgcgcggcgtctcataacgtcaaactggttctcggggtggttacgatcaagcatactctgttctcaaaaaaaaaaaaaagcatactacatcagttataaaataaactaatctcatatggtacatcctaatacaataaatctgtacataagtatatttattgtattaaaatgtatcacattcggtatgatgttgatttattttgtgacagagaaaataacatatattacttgcactggtggaaaaaccatctttcgtcggtcggccgaattccacgatagtcccggatgcaataaaaaccggggctaaagatgatctttagtcttggttaaaaagggtaacgggcatatttgatctttagtcccggttggtaacaccaaccaggactaaagatgatctttagtcccggttcaaatgctgtcagggcctgtcaggccccccggatctttaattccggttggtaaagatcgtaacttcagtcccggttggtaataccaaccgggactatagatctcggggatctttagccccggttggtaacaccaaccgagactaaagtcccacccctatatatatgtcttcttcctcctccagctgcccaagcaagcttcaaaatttcttcaaaaaagaggggaggtcatgccaaaatttctagtgaatttattttgatgattacgtacaaatcggaggtgcctaaaaggtttccaacttcatcctctaatgtttttttgtcatattacatttgcagctatgttttgcacacttttttgtctctaaaatttagttgtaagttgatgaaggagaaaatttgtatggggaagaaagaatatatagaaatttagttgatttgctaaagaagtttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgattgtcattattgtaagaataattatttttgtacgattttttttcgactcatgtagatggatcggcaatggatgtacgctgaccggcagtccaaagagtttattgacggcgtgcactattttttgagagtggccgaagctaacaggcaaaggggttttatttgttgtccatgcaataagtgtaagaatcagaaggagtattctgcatccagaactattcatttccacttgtttgagtcggggttcatgccaagctataactgttggacatcccacggagagtaaggtgttgaaatggaagaaaatgaagtggaagacgacaatattccggactttgctcagtacgttggatttgaaggaaatcaaacaggcgaggaggaaagggatgctgatggtaacgacgttgcggatgattttggtcagatgttgcaggacgccaaggaggactacgaaagtgaaaagggggaccataaattggacaagatgttagaggaccacagaacttcgttgtacccaggttgcgagcaggggcacaaaaagttggataccactctggagttcttgcaatggaagacaaaaatggggttagtgacaaggcatttggcgatttattaaaactcgtcaagaacattcttccggagggaaacaaattgcccgagacaacgtacgaggctaagaagatagtctgcccgctaggactggaagttcagaagattcacgcatgtccgaatgattgtatcctatatcgcggtgaggagtatgagaacctagaagcatgccctgtttgcaaagcactacgatacaagattagacgagacgatccaggagaagttgacgggcagctaacaaagaagataattcctgctaaggtgatgtggtatttccctataataccacagctaagtcgtttgttcaggaacaaggggaatgctagaatgatgcgatggcacgctgaagagtgtcaacaggattggatgctgagacaccccgccgatggttcgcagtggcgaaacatcgacataaaatttaaagaatttggaaaggacgcacgaaacatacggtttggtttgagtacggatggcatgaatccttttggagagatgagcagcggccatagcacttggcccgttacgatgtgtatctacaacctcccccctggctatgtatgaagaggaagtacataatgatgccgattattattcaaggccccaagcaacctggtaacgacatcgatgtgtacctaagaccactggtcgaagatcttaagctgttgtggaagaaggaaggtgtccccgtgtgggacgaggacaaacaggaggagtttaacatacgagcgctgctgttcgtaaccatcaacgattggcctgcacttagcaacctatccggacagtccaacaagggtacaaggcttgcactcactatatggatgaaacagaaagtacgtatcttaagcactgtaggaaggttgtatacatgggtcattgtcgattccttgcagcaaaccacccggtacggaagaaaggcaagcactttgaacataaggctgaccaccgtacgaagcctaaacatcgcaacgggaaaacagtgtttgctatggttaaagatcttaaagtagtgttcggaaaggggcctggaagccaacctatagagagcgaagatggtcacgcggcgatgtggaaaaagaactctatattttgggagttaccctattgggaattcttggacgtacgccacgcaatcgacgtgatgcacct

SEQ ID NO: 67911 - DNA, 56238 bp, Oryza sativa
  unsure (1)..(56238): unsure at all n locations
aagtcctgtttgggtctcctggcgcagtttacaaatgaggaaactgtggttatggggtgccaacattttaactgtggtgttacgagatgctcttaatatgatttctataccattggcatcttgctgtcagagaaacaaagatatggggaaaatcgaatgttggcagtgcagtcatggactagtgagaatgggctggggaaccttcattttaagcctttatgtcccccatgaataatttactggaacacattttgtctacaattgctccaaatgtttggaatgcatcttttcaagccaatgtctgtatgactgacgtggtttcaaccattctgccctgcaataggccagaaggaagttgcaccatcaagctgaccaccaattctgtggggaaaaggaaatcctaattcgatgactacatgttctcaatcgcgagatgcaaaatgcttcttgttttgcgaaattcacatttggcctgtagtggagtagactcgattcttcatattttgtaactcgaggagtcattacttgttagactatccacctggaatttggtgacttaactttctgtattggctgtttttaattcctgttttgtttggtaggtcgatgctgttgtttacttggtggatgccgctgacaaggaacggtttgcggagtcgaagaaggaactcgatgccctccttgcagacgattccctagcaaccgtgcctttcctgatactgggaaacaagatcgacatcccatacgccgcgtcggaggaggaactccgctactaccttggtctgagcaacttcaccaccggtaagggcaacgtgaacctagccgactccaacgtgcggcctctggagatcttcatgtgcagcgtcgtccgcaagatgggctacggcgaaggcttcaaatggatgtcccagtacatcaaatgagaggggcttctgctcctcaattgtcaatagcagctgctgctcctgctgtccacagtgggagtgggtaattcaggcctctggttctgtttatcaactctcctgatgctttggagaaacctactgcacctgtaaggaaaaaagtttgtcgtagtggtggatagtgaatgcctgtaagttggtgttaatactagaaatatgacggggtttatttgtttgattgtttatgggtggtgtgaccttattagctagaaaatgtgggttgctggaatcgtttcttgacaacaggaaatgtttcagccaatgtattcacgctatctatctagccagtgatatgtgtatgagcaacttcggtctcttggctgctaacgtctcccctgtgatacttgatcaaaactctttttttttttaagataatggattaaaacacgacctctatattcaaattcttgatactaaccatcaacaaaagagaagaatttcgattcgctaattctatcatataccaagttcttctacctattgtagacgttggtgttatactgaattacaactaatagaaaactatgaaatgaatatagcactatgaaatgaacatagtttaattgattgaattcatttggatttcttacaatggaaacttagctgattgaattccttttgatttcttatgatggaaacttggcatggatgctcccaaatattactaattaattattttgttagtggtagctgttatactcgtagatagtgagacgttcacgatgattttctcaatcttaagttatactaactcaatttcttgaagatgctagggtaggtgagggtaggtgtgcatgtgtatttaggggtgataactgtgtttacctaattttttagaagtgttagggtagtatacgtaatttataagggtgagtgtaagtattatgagtgcttatgtttgtacgtgttttaaaaaaaaaagtaggatagaaaaaaaaaagacatgcactttgcatgcggagaaaaggaaaggcacaaaaacggataacaagcaatgatcttgttatttggcgaccaagatttgatctggagttcctatccgcatctctgggctgtcgacactccaaacagagagcgactcttgtggccagagaacaacgctcagttcatccgttgccttgcctctaccaattgccgaacaaagcaaatcttcattcatctgtggcctgaagaccataaacagataatggaaatgtgcatacctttgtgtgcctcatctacagaacttgttattgcaaaccaaaataaaatagacgtggaaacgttatggattcaatattaactagatgggtaccctgcgcattggtgcgtgagaattacgtgataatttttttgcggggagaattgtgtgataaattaggtgttatttgctctgtgttcccaactcctctccttcgtattccatgcgcacgcttttcaaactactaaacggtgtgttttttacaaaatatttatatacgaaagttacttaaaaaatcatattgatctaattttgaaaaaaaataaccaatacttaatcacgtgctaatggaccactccgttttccgtgcggaggagatgggttcctaacccgaacgaacgcatccttagtatatattagttgtaattttttcttactatatgattttctttcatgtgcttatactttgataaattattcaaacgttataaatacttaagttgtatggtgtgtctttcagggagaagagatacaatttgcactcttgatgaatcatctaaagactagaaataattgagacgatgtgacttaagggagaattagtattaactacaattagtggtaatgacgtttttctttaaaatgtggacttttttcatatggacttgggtgggtatgctagctgtgatgtccattatgaaattgtgttgaacagtagaattttatgatattatgggagtacgactttgaaagagcgtagaagcattactaagggcctgtttagttcgagaaaagaaaaatttagagtgtcacattggatgtttgaccggatgtcggaagggcttttcggacacgaatgaaaaaaaaatattttcataactcgtctggaaaccgcgagacggatcttttgagcctaattaatccgtcattagcacatgtgggttactatagcactttatggctaatcatggactaattatgctcaaaagatttgtctcgcgatttcatccctaactgtgcaattagttttttcatttatctatatttaatgttttgtgcatgtgtccaaagattcgatgtgatgtttttgagaaaaaattttggggaactaaacggggcctaacaaacatcgacgtaactttctggtggaacacagtgctttagtacatatatattgtactttcttacccaacaacactattacctattgtcattttctttttcttgacttttacaaaacatttgattgcacatgttacaacacgtttgattgcacatgggaagaactgttctatcatgctggttggaagattgttctatcatgctagtataaaccgtgctacagtttaaacttaagatgcatcgagtttatgacttcattcttcccaccgatgctagcccgatcgaagccaaacagtaggctcgaagttacaagtacattaccctctccatcccaacaaaaatactaacctaagactcctactattatgaatctggatagattagaaggggtcctactagattggcttttttggaaggagggagtacaccttcaattccaaatacaaggatcttttttttccttctttgtttgaaaagaacctgacatcaaatgcacaccaaaaaccaaatcttgggattttgactccacacacgtagggtttgaaagcttgaagtgccaaaaaggaggagcagatcgatcgattgatctatctacaggccagttgtggccacccattcctcgtcgatcgatcggtcgccggccggcatcctccggtcgccaccgccggctgtgcgccacacgtttcgccccctcctctctctctctctctctctctctctctctctctctctctgatcgccgcggcggcagccggccagcagcgagagagaaaacacgacgccgcttggattggatcggatcggattgccgtgtatatctgccgtcgcgtcgagtcgcgtcagccccagggtggccggattggcgcgacgccgacgcggcgcttgtcgccactcgcgggcgagctcgtggtcgtgggttgccgacgaccgcaagctggaggaggaggaggaaaagaagactttggaattttatgccggcacgaatgatctttcgctcctgtttccgacctggcagggtgctgcgtgtcgccgtgtcggatttctgccgtttgatgccagctggatttcggtgaaaagtctgaagaaaacctaactcaccgtcgattttcttttttttttccctattacgaagggcttgtttagtttggaagaaattttaaccaataaaaatagaaacgcatgcacatatcgattcgtggaaacttttcaagaggtttgggtttgttttgatagtgaaataaataaaagaagcgggattgggatagagaaatgagtgaagattaaatctgccatgttctaaactgattaagatatagattttttttctcggtttccattagcacgcttttcaaactgctaaacggtgtatttcgtacgaaaactttctacataaaagttgctataaaaactctaataaatccatttttttaagattttcacaattaaaactcaattaatcatgtgctaatgacttatctcgttttacgtgcgcacttaatcttcatccttgcagtagattcgaacgggagagggataatggatggttaggattggtgggtgggaaattatttcactaacccattagccaagcaaatcccatgagtggatggaaaattttctatgttttctctccacaacttgtaggaacgagaaattccttttattttgaatatggataagatttgcatattttatattacgcttggggagttactttaccagagcaaaacaatcggaacaatgaaagggaaaaaaaacaaaatagcttagtgctaattctcacgatctagcttggcgacttgtcgaccatagcactcattgcccctacagctgcatgctcgttaagtgccatagcgcatcttcgtctacctcggtagcttcgcgcatggttattgaatactcgttgttccgttccttttaaattgtccaaactatgaggcattttttttagaaaatggattaaaatccggtctctacagccacaatggatgtacacagtccaaactatgaggctaaagatcgtgtcgtaaccatgtcgttgtgctttggtgatctgcttcgctaccacaccaccaccaaaggaaggaagtggagtttgcagggaagcaatgcgcctgtcgatcgcgcttaggatcgcccaccatagctaacgtgactctggacgctggatcaagatatgatcaatggattcatcagcttgatcgtagaagacatagttgtcgggatgtagcagctctcatcggatcaagcggttagccatccagcacctccaatatatacgctccctatattactacaaaccaaatggtgtttatagaaattaatcttttggaatccaaatctcttgttttttcctctaaactgaacaagctctaaaaatcggtaattatagagctttccattcgtagaactacagaagaacatgttgacttttttgtcacatcaccaacacattttgtggtattgattggagtcaccaaccacctcaaccttgaaaaactcctaaggctatgttcggttaatccctgtcagcgattgtggtgtggaattattccccctcaatcccctccaattcctttcaacccccttcaaaccgaacaagacctaattgagatgagttcatagattaaaaccagctagcaaaaccaatttagaaaaattgggataaacatgtctcatggattagatggaagtttttttagacaaatctacaaacaagatttacactcggggcgaagagtgaaggcttacaacgcaaaccgatgaagatgaatgaaccaagataaaaactagacaagaaagtagatgtaatatcgaaagaacgatttaattgagtaattgtgttggttatagattgtttccccaattaacctgtcctaagacggtaaatctaattggagaggcccgaaggggtctccacaagatcctctccacaaatttcttcggtgctctaaatggtagtatatttgatttgggtaacgaagactacccccatgtataaccggagaaactttttttttggaccaaaaccggagaaactttagcgagaaactttagttagaaggtttggcgagttttgaacgtctgatcaaacggcaatctgtctattagacggctcgcatgtggagaaggctactttcagtttcagaacggtgcaagtgtgcaagatgcagacggaaacgggatgggcaacggcaattgaggatgcattacttccaattccatttccagctctggcaatgctccagtccagccagccaacaaaagaaaagaggcgatgtgtaccgtacgcgtataaacgtctccacgtaatacgtacaaaatacggtatggtttctcggcaagcaacgcgtacttgatacgtacagtacaatgcatcggatgcctgtcacttgcttgttacacaggagactgacgaggagtcgacgacgcaagctatgtacagtacgtttgaatgttcattacgtgttccgatacggttgcctaccctgccaaccagttgacatatatgtcttgcttcatgacgcagcttagagacacaaatgggcaatatagacagacaccagtgccaagtcctgagtccaattaataaatttctaatatagtttagagtctaattaattgacatttgatcttcatctatctgaggtccttctttttttagtgtcaaaacagaaaatcagcatctgggtgtgacacttgtatggcattccactctgggaagaaagaatcattgctgcagtagcatacagcagcactgcagcagtgtggtgtgtaaaccaacaaaatgaatgaacggatggatgggatctaaccacgtccgcgaatcacatcaatctgacgaccaggaaggctccgatcacgagcagcttcgccggcaccagcaggacgacgagcagccgggcgtgcgcccgcgcctgcctcgccgtctccctcccgccctccacggcggcgtccaggagcacgccggcgccggccagcgcgccgtgcgcgccgagcggccaccacaggaggagccgccgccaccgcccccgccgcgtctcccggtgccgccgcacctccttgcgcaccacggcccggacggagcggaggtaggagttcacgtcgtggtcgcggtacacggcgcccttggggccgtaggcgctcttgtccttgaggatctcgagcgggtgcggcgagttgaagaaggtggacatggcggaccggagccgccgcagggaggtgcccgacgacgacgacgagtcgctcaggtggtagatgccgctgtccggcgggaggaggtcgtggtgcggggatagcctcttgtcaggttgcaggatgaacatctcgcccattggggcgtacaagagcttctgcagtgaaatccacagagagggttacaaccattgttggtcaattttggtaacatgcaaacaaagtgaacattttacaaacaagaaaactaagtggtgatgggtgatgactataagagctgcatattgcagtactcagtaaagatccaagtgttctttgccaatattttttttaactacttttacttttgttttaaaaagaagtgttgtttttcagtccctgaaaatgtgacagccaggacatcatgctagatcttcaacctgcagggcacagttcgctgtataattcaaccaactgatgggtttattatttgttctccatgtcaaagcatcagataaattttctttgtagtcttaagtcattaaattcaggaacatatactgttattaccacataaatgagctaatttatcaactgaagtggattcatgaatctacctgatttgtgaggcatgggtgactgcggaaattcccattggctagtttcagaatattagcaacatggtcagggtagttgcacgaaaagactcgaggaacaatatctcgatgcatcgtgactgactgaacatgattccttggcaatccaagtttacgaagcaagtggtcaccgccacacatgatgcatggtgcaccaaatgttattacaggcaacaacgacgaagcaggtgctgctcctctcatcagtagcattagattcacaagcaaagccagactaccaccaagagaatgaccagtgaagcgtaacgttgcagatttaccagaacttctcaagtgagatttgacatatggcaacatttggtgatacattcccttggctgcttcatatattcccctatgaacgagcacatcgagtccctgcaaaacatcacaaatgtcttagcttacataaatttgtcaagcccttcctacgtctaatatgtcaaattaaatgtttgtgtgtcaatttaatacacttgatcaatccatgatgcacatctaaataatgaagctgctggtgcacaatgaatgaatattggcaagattgattctatccatcattcatgagaaactgagaaatgtaggatggcagactagtaggatacctcaaatttaactggttcaaataggaggttggcctgccaagaagcgattgactccgagccctgccaattaacaataaaaaattgatgaagatgaaccagggaaagtgaaaattacacgaatcatgatatattgggcagaagacatacctgaaccacaaagtatcttgtgctgccttgatcatcatcacaaatgaaccattcgcaaggacaagatcttgaagagttcagatcatctgcaacagcttgtcttgtttcttccttggcagcaaccatggaggtaactgaatttgtagtggccacaaatgaagcttcatccatggttaaaccttcaccactctcaccgtttacaatggccatgatggttggatcgttcttgccatcattcctggaaccaaagggaacgacgcccatagcccgtgaatgtaaataagaggcagcagacgacatgacatggtatgcgccgaaggggtttacccccaacccactttctttcttcttattgctccctggctcagggttctctacaacttcagattcttgatctgaagattcaccttcctcagtcttcagctcctgcttctgatcaacaccagttttggctttctcttgtactgatgaagtcacaaaccgcaaattgtacctccgcagcaattttggctgagaaagcaaacagttgctaagtcaggcaatgaaatactaatatcacacagaatgtcagaaaggaaacttgcaaattgcaatcataatctagttatgaggtactagaaaggtaattgtgtaattaacaacatcacgattaccacaccaaataagtatccatatgccagaagcagcagctcaagtgaagcaaccaattgaaagacaacaatagacaaatacaactcaggcacagatagctccaagagtataattgcattaagcagacctggcactaatccatcaaatccttcaggaagaccccactataaggtccaaaagcacataggggaccaggacgaataatcgataatggcataatgcataattttgcagaacagtaaaggaaattcttcactatctctgtaaaggaaatgcatagacaatacgtagtagaagccaaaacagactaaataagaattcttagtaacaccacaacctgcatttctcttgaatttacagcatggacaaggactcaaccatgaacagttcatcaccagcaatcgaattggcgtgtagacaatccaccaattattggctgtgattaccgcatcggtgaattgtagaatagcagtcactcgcattgatgctttcgatcttaccgtgatcttggggatcatgtaggcgatgttgcagaggtaggacatcttggagaactccttggcctccccgagcgacactttcctgaggagcctcgagaaggtcgcgcggtcgaacaccttgccgtcgctctcgtcgtcctcctcgacgccgcagcatccttcgtcgtcacctccaccgcacgaggcgcagcactcgtcgccgtcgcggcccgccgtgagcgcttcctggccgccttctcgagcggctccggtgactcccgcggcttcggcgtccgccgcctccgcccactgtggctgcacccgcagcatctgcagcacccagttcccctgcttccgctcgtccgcctctgcctccgccgcgcgctggctcctcgcctcctcgccgcgaaccgcaccaccgaccgcaccgaccctctcccctcctcctcctcctcctcctcctcctccgccgccgccgccgccaccgagcggccatagccggagcagcggcgcgtgcagaacgccccgcgacggctgctgctggtggtgccgctgcgccaccggaggcggtggcggctgcggagccgcggaggcggcggggctgatgccgcggacgaacctcagggcctccatggccgcctcctcctcctcctcctctcgcgaccgcgaggttgccgttaacaatagcggggttaagtttagccaaatcggcgatgatccccgtgtgctccaccactcgagatcaaccaaccaaccaaccaagttcactctcgactccggcgatcgacggcggcgggtggtggtgcgaggagaggagcagcaatggaggagagaaagaggatgggagggaggaggaggcctcctatatatgcggagacggcaacgccatgggagggaggtaggagagaggaaagagaggggtgggattgtttgtgggggaggagagagaaaccgtgaagaaaaatccgtccgtccccgggttgcttgctccgctctaatatctttggtaggctcgttttggcatcttgttgggttcctttcaccctctgatttgacgcattcacagtagttttactgtctgaatttggaattattgtaattttaggagtactctgtattctcacgcctatttcaaaagtcaatatatatactatgttaaggtgagtgaaattttattacgtataacaatcattattaacactacacgtaagcataaggtgtggtgatactgtactatttttaaacaaatactttcatacttttatatgtttttcttgccgtgttataattagtattttattttttaagaaaaactatgtggagtgtagaacgaacattttggtcagaggaaggtatgccatgttagtacgtttaccacgtgccaggacaacgttgtatgcgtacgagcgtatcggatacgagcgacacggcggaggctccatccgttttttgccacctaggccgagccgcagaagatcaggaggaggagtcacttccgtggacgcgtcgtccagcgacacatgccccgggacacgtcagcggatgagaacttctccgaggtatacgtggaggccttgcgtgccccatgcaggcgtgggcctcggttttatccacccacagccaccacaaatccacattgcgagatccggcccatcactggagtatgggccgagttaacttttgctgctgcgtaccatgtgcaagtgcgaatgggcttgagatccatctaccgttggatggtcggacacacacatttgaggaccttgaatagcccatctcccaccatcagcttaaatttttagattaagctgatcgatacatgtaacttaacatggtatcaaagctataggccttgagttcgtatgctgcctggcgagcctcgtgtaaggggagtgttggaatataaaatgaattgctcatcttttcccatcaatttaggtttttggattgaacttttcgatacatggttgaataactaattttgtgataactattcgaggctacaaacgaaagaattaaccattctaagctattcgagagtacaaacaaacgaattaattattacaaagttaaaaatacattaagatatttttctaagaaattcgtaataaatagttttctaaaaaaatattaccatttaggacacagggaagcgtaatagctgaataaaatggttccatctgaagaacacgacctgtgtgctcaactgtcaatagagacacaataacttcttgcaattatcctctgtgctgtttgacattttcttggttagtgaagaacagatgggtaaccgtgtacttagattggtgattacttgcacgaatcagtaaaaaagaaacattttctcggggaataaataccgtagttttcatcacgtcaggtacgtggtaggtttctcaacccaccagatttttcaaaacttgcccataaattcagtagcaagtaatcaacatgtcatttctgaaaatgataacataaataaaaatgattaattttgtgtagcaaacaggggtgaacgacgtacggaaacacggagcattagatcatcgccatgaaaattgagatcaggagatcggtagattatggtcaagattagttggccagcttttgggaaaaaatagatttatgctcaaatcagagcagaattaaggagattgatgcttagtggctactgtgttctgtactaccacccagtcacacacgttacacatgaaaaacagagaagcgtgcagcatgttttctgaatgcgaaatcgatccccgctattatatattcagagtttcagacaatcaggctggtgctatctatctacgcttgcatttcttcctcctgtcctatggcacataagaacgagcatgagaagttgtgaaaagtaattgacaagaacgataatggcttgggtctccatgacctggtgttggcacaggagcttcttgctcatgatggcgtgcgtctgcagctggtcgatcacttgctgcaaatcaggtttacactatgctgttgctgctcttttggtgtcatatctgaaactgaaatcgatttttgtttgcgtttttctgaattctgatgcatgcagacgaagcagcagcaggagccttccatggtcagaagaggagcactgaagacatcgtcgccagagctatcatctgcttcagcgatcgatatgtaagcacatcctcttagcaaacattgactgctcgtaatcaagcttgaacagtaattaacacagtttcagaccaaaagaaaaggagagaaagaattcgagaagaaaattaatgcacgctgtttctgattatgtgctgcgagaaatgtgttttcttgcagatcttcagcgggtgccaggggcagtacaggctggggccggagggcgcgctgcgcgtgccggcggcggcggcggaggcgttctgcggcgggccgtgcctggcggagacgaggctggtgctcggctgcgtcgacggcatcatggacagcttccgcttctacaacggcgcctccgtccgcgacgtccgcctcgcgctcgaccgcggctgcggcctccggggcgacttcgacgtgctgcggcgcctcgggggcgacggctacgactacggcggcgggccacgcggcctcgtgaccacgccggcgcctctgctgctgggcgccgtcgtcgcggtgcttctgtggggatgatcaatggtgattaaggaaattagaactagtttctggtgattatacatgtatgtagacagtacagtatagtatgtactctaccagagttaattaactgcagcactacggtaccagggcgtgtacgtacttcgagttagtcaaccgtatgtgagccttttttgtccattttgtagaatgtccaaggaccactgtgaatttgtttaagtgaaaaataaacaaatatttgctctttgattcaaaggatttaagtttttcaaatcttgtgaaattttaattgaatgacttattacatgtagattttagagaaaacttagcaaaagatccaacctcttagaaaaattcctttaagtttatatctctcattcgattcatatgtttttcctgcgatccaatagaacgatgtgtgtttctccgtgttttcaattcactattttacacttttcatttctatcataattttatgtatttttatttctctgtttttccattcctacgattgaaagagtagtgtccaatgtccttttaacaaaagaagttatttattttgtttattttattatctaagagttaaagtatttaaattagtacttcaacgttgagttgagccattggtacataattaattaaatataaattagtttaaatttaaaattttgattaatactatcttcatccaaaatataacaatttttagttataaatctggacacatactttcatagctaaaaatgtttatatttggaacgtagtgagtataattatcaggcgacaactatgagcgatatgcttgtcactccataccagctaacacgcgcggctatctatcttgctcgccgccacctgcgaagctgcggtgcatggttggtcgatttctgattgatgtcaggagtggcgtactagtgctgctcgttgtcgtcgttgcttgaacgcatcttcgtcgttctccccagcggcggcgacggcggcaccgcctcgtccaagggcggatgcagaaaatagcatgagcgggtgctaaggatctaccacttagatagactaaggatctaccgcttaggtagactgaggaaacaaaaaagtgtcaaaggggcatttggccccactcgctccagttatgtatgcacggagtgagaataaaccttagactattagccacgcgcaaaacaaaaaacatgattagtatgattaattgagaaattaatttgatttaatcttgcaattttaaaaatctaaaaataaatttatttgatttttcaatcaattattatatataaagtttagtactttaaaaagcataaatgaaaacccgatccctacgtttgaacaatccctaagtttttcgtggttacgtggaattactatgaaaatgagtctaaagataacattcctgtagttattcgaaaattcattaagcgcataagaaactgacagtttcgatatgttacgttatccacgcacattttttttaattaactatataataattctctctattattcctttttttcatgaattttagatctatctataccatgcttgattaccaaaaatatataaagcttttgttgtttgatttatattataaaatatatctgtagcgttagcacatgcatattactagtaatacaaaatgaaattgttgaaaagctttcatcactttcttaggtacattacagtaccatatattatcccaggctttacacattcgatcaggcgacaactactagcgatatgcttgtcactccacaccagctaacaaacgcagctatccgtctttctcgccgccgccgtcggtggcggcgaagctgcggtgcgtagttagccaacttctgattgatgtcaggagtggcgtaccagtgttgcccgtcatcgtcgtcgctcgaacgcatcttcgtcgttctcccccgcggcggtgacggcggtggccaccgccgtcggtggcggcgaagatgcggtgcatagttggtcgacttctgattgatgtcaggagtggcgtaccagtgctgttcgtcgtcgtcgtcgcttgaacgcatctttgtcgttctcccccacggtggtgacagcggccgccgctgtcggtggcggcgaagctgcggttcgtagttggtcgacttctgattgatgtcaggagtggcgtgcgtaccagtgctgttcgtcgtcgtcatcgctcgaacgcatcttcgtcgttctcccccacggtggtgacggcggccgccgctgtcggtggcggcgaagctgcggttcgtagttggtcgacttctgattgatgtcagtaatggtgtaccagtgctgcacattgtcgtcgctcgaacacatctccatcgttctcccctgcgccggtgacggcgccgccgcctcgtctaggtaacatttaaatataatttttttttgaaaaaacgcgtgcattcggaaaaaagggaaacaaattgaaaatataccgtttattttttttctctcaaaatattcggatgtaattttagtcgcacaaacataccgttgatactgtcgtctcgcacggtgagagcgggacctaattagcgagaccgacagcctcgccgttaatcactgattaattagtgattaattatcttgattagcaattaattaattattaattggataattaatcactaattattattaattaatcgctgatcagtctatttccaaaacgctgtcgcaccctcacgatgcgagaccgctcccacatcagtttgccaaaaaaaaaatacatcaataatattactgaggaaaaaaatatatgaacggtatattttcaaatttaattcaaaacgagagtccgctgctctcaaacgcaggaggttggttagtggcaggaaagagtattggtgttttggcgcgaaaagagtcgagagggcgcggagccttggcgccactaattcagggagtgggtggcagtttcgtaataaaacttgtttattttccgcgagctcccagaattccgtagaccctctcctgctgcgtgcgtccccaaatcaggagtcctcccaaccctcgccaccggcgccgtccgccccatctccgacgccgcctccccccgaagcgaagcaggtacacgccacctccaactcttccctcttcctcctgtttattcgatggcctcacgcttaggtccatctctgcagtagatctgatcgctaggtcctcctgtttaggactagggtatcagtatcaggtatggctggagagaacggcaaatttccttggctggattttcttaggaggggaactagtggtgatcaaggagggaaccacatcgattttcctgtcgcaaactgaaaacccgagtccgagtggttgtgcccttcttggattaaatgaatcaaggagttaaatgaacttgtgggctggatttaccatgtgcttgctaggcatgatcccgtgatagaactaccaggagtaggagatttgtgggatcccaatttgattgcttgcctgtgtcatcagattggtaattctgaattgtgttgatgaatatgaaaagccatgcgttttgcagagatggatacatcaggacctgcagcattcgtcaatggagagattctgaagatgttcgtcggccgaagagtgcgcacggtggtccaagcccagcgcgaggaaggcgggttgcttatcgggcagtccaccgatggtcatcagctaaccatcaaaggggcctccggtgcccctatgtcgcactatgtggagattattgggatcgctgaacccaatcaggccatccgggctgaagtttgcacagattttggtgaaaacttcggtgagaattgttgcgcctcgcattcttttcctccagtaaatagtactatgaattgttagtctgtacagtttgttatcttttacataaatccagacagtgcctgtatcttgcctattctgatgctcccccaccaatggttttttaacatgttacatagtgattggggttcgttattcttgtgttctatattttcttgagcaaaaaaatgtacagttcgcataaaaatcatactttcataagtacgttttgttacatttttcatcgtattcatgcttacaagagcaaatttctgcctttgtaaatgtgtagctgtttgtgttctatacgaattcccaaatccagaagcattcaaaaactaatattgattgtttaattgttggactttttttacctacagccaaatttgactttagttgtatgggaacttcaatctcacccctatttgtgtcaaatttgtgtctgattgatcatagagtagattttaggatgacatgcactcttgtctggttggtaaaatgtagcttttgaagctcatgggcttaacttctgggaatgagcgatttgcgattgatcatctagagtagatttcaggtggaaaaacattcttcaactaagttgaaaatgtagctcttgaagttcatgagtatacttctgggaatgaaaagctattttagcttatatgcccaatgttacagcgtttctttgtatcaattaataaaataatctcaatcaacgtttcttttgttctcgtctgacacaggacaactagtatgtggtgctaaatctttacatttgctgcaagaattttatcttagacaccctcattacaccattgatctctctatcatgtttgtctgcagatcctgcaccattcaatggactgtgcaagcttgcgaatggccagatgaaggatttgttcctgtagaggtcggcatcacatacaagacattctgccaacaaagcatgtctcatgttcatgatttctctagctttaagatccgtccaactgtttttgtcagtcatctcagtataatcaagctacttagggtcagtattggtgcttattaagacatattaaccttaagctatgtgaggacaagcgtgtgcttttgttgctgaagagcttgtggtgtttgctccttctaagcaaagcaaaccaaagcgttgtgctgcattgttactgtcgcttgcatttggatccttgaaagctgtgtttcttgttatgctctccggtgcatcttgatgaagtgagctagtatgatgctttctgatgaatttcaacatatcaacatagtaacccaaagtttcaaattaactgcatgctcattgtcctgatgcaagcatattactttgattcatttgttttctgtttataaggcgctttggtggttgtttccgactaattttgcacgcatccacccaaacttgggtcgtttgcagcatatatatgctcacttctaaaaaaacaattaaaatgaaggtcgtgactgataagtctgaacattaatcattcatcctcttcttggaacaaaaatcttttcaagcattcaagatcaaaatgcttcttccttgataggagtggattggtattgtgtcactctcgtacctatcacagcgattacgaggcctcatctttttttcacttaaccatagaaacatggtatcttggttatgctatgaacaaatcaaagagacaaaaggaaaaggtttcgtttgggctcctcattcgtgtctcactgcgtttgttaactactaccgacttcagtgtcttcgccgacagactacttgcatcaacaactacttgaaaacacaatggtgatgatgatgatgatgacaattgtcaggctaatctgtttttgaaagcaaaaggcatgacaatttcactgtattaattgaggaggaatatcacctataagagttttttttaatgaatgatatatttcaccacacgcacactaaaaataagcactttattagatcatgcagaaaataacaagaattagtggtattaagttcccatcaaagtaccaaaccaaaggccaaaagatcaatgtagccagtcaaatgcatcacagtgatttgtacagttgtactaatgcacatctgaagtgatggatcaatgtagcattgccacaaaaagatagaaacaaacagagcaaaattttaatttacatcctttgttttccttttcttttttcatgcaagccctcgcaagattacgtaaagtgctatttgaacttcaaaatgtggcgatttggtagttttccctttgaaggcgggttttcgcgtttacgcttttacccagaggaaagcggatgcattgacttggcaagcccgtagctccgggccccgaacccgaggcatccgaggacgaggccctgccggtacggcagcgacgtcgcgcgccgccgcggcggcggcgccgacgacctctccgacgaggtggaccgccgcgccggctgcagcgacggcgggcacgggcacgggcagggcaacgctagcgttgctgtcttcttggaccgcgacgacggccagatggacgggggccaaaagcccgatgacctctcggcggcggcggcggcggtggcggagatcgctgttcgccgtgctgccgaggaggaggtcacgcagcgatatccgccggcgagtgctcttggcggaggacgaggaggaggaggaggaggaggtggaggtggaggaagacgacgacgacgcgaaggagtccgagggctcggcgatctaggctagatcgaggtccgcggcggcgacgccgatctggccgcgggagcagcagcgcggtggcggccgctctccccctcgtcgacgcaaccttcctcctgctccccgaagcccgcctcctcctggcgtatgggcgagaggcacccgacgcggatgcgccccgcgacgaacagctcctcggccgagctcatcgccgcggcgccattccctgcaccatgctggcgcgcggcgaactcgaagtccccgccgccgccgccgccgcatccgtggtcaccgtccacgcccggagcatagtgcgccgccgccgccgtcgtcgtcgtcgtggaggacggcggcgagcggaggatgtagtgcacggggctggccggggcgctgaagaagaagaactgctcgctgccgccgccgtcatcgtcagcgtcgtcgacgtcgtccttcccggcgcagcggcggcgcgtggggcttgacggcgccgtggcggcggggctcccggcggcggcgtgggcgtggctcagcatcggcggcggcggcggagtgaagggaagggaaggcgaggcgagattttgaaggagacgtgggtaagcggagtggttagcggccgggggggaggtatttgtaactgtgcgcgcgcgagtctcgatcgtgggcccagactcgcgctactacgtggggcccgtggcatttaggtaaataaatgatcatttctatttcgtatttatttcgaaatttctaaagtatagaccgaaagaaatttctaaagtttagaccgaaagaaaaaacaaatcataatttaggccgaacgaaagaaaggtgaagatatagggtgtgattggttactggccacaatttactataactaacattagataaattgtgacagtcacaaaagtgtggtgaataaattgctaaccacaaagtgtagcaaagttgacaagaaaatctagtttacgacatgtgggatatgctattgaaaaaatatggcaagtcacaatcaaatggctggctaacaaactgtggtagctaaaactgtggtatggcaaagtgtattccttagtatcaagattgttcttgaattgttgtgagaggagttgcgagaaatgatgagatcgagtgtgaatagttatatttggattaattggtaaatttaggttgtatcatcgaaaccttcgtatgccttttgtacactaaatgagctaatactaaagcacacgtcgccatgcatcatacttgatctattccaaaatgttaagcaacaaactaatgtttgatcagttccaatatttcaaaacgagtgcaatctagcattcgagctgtgtagtgacagtgtgacacacacataagagcttagtgctgagcctttctcaacggcttaattgcgcgtgtagtttataactaattaattactactaatcaatctttatatactaccttaaattcggcggggtcaacaattctttatatgcaggcttcgatgaacgtggcgagcacctgcatgcacatatgcaggctggcacgcacaaacgagaattttttttttttgagggaaacacaaacgagaataattatttacttaattagtgcgaaaaatacaaacacgaacacggtcgagacagtggagaaaagtgagaggaattaaacaaccaacgtcaacagcaacaacacgtagcgcccatgtatagatgtatagtacaggtggtgacgagcaatataatacggagtatatctagctctctcacagagaaaaaaagaaaaggagaagtgtatttgcgagtaatctacgggcacatttaattttatgggagaagcggctataatatatctagatcgagtgtatatcagtactatataggagtgaatcgtagattaatttgtagtggtggaacgtacgtgggtgccaaagttttggcaaaccgctccttcgcaaaagctacatgttagttattaaaataaaaagcacaaaatacaccagtgatatgatggtaaaatcgtagattcatgacttcaactatcacggtttaaattaatcccaatactcacaaatattacacgtacatgtaaattgattttcaatgaggatgtgtcactgatgtccgtctatttgaacgtgtgtacatgcatgtagtggtagtttcaaattactttttattttatttttttcctaagtaaaatttattggctttcaccatcaattaataaattaatgtaaataatatttatggttttagattcatcataagaaatattttcatatcatattatttacatgttaaattatatattttttaggaattaatggataaagttagaaatatttgacttaattatattaggatacatgataagtaatcagaaatgaagggagtatataaatttatgttgtagtttacgtgaaccagcgtgtacattacgaatattaggtacggtgtgcagtgccgttttgatcttgatttcacacataacacaagttcattttgatacatcaacaactttattaaagcatgtgtaagtatagttgtgtgtgtcttttatgtaaatgagaaaaaaaaaactagaagcaaattgagatggaactgttaggatttcttctagccctgatccacatgtatgtcctggaacgatgacagacgcgcgtggcgtgagttcaggtcacatttttctctacaagcataaataaagttgtaggcctcctttcgctttttctccgagagatatcgagacaccctaactaaactatcaaagtaatccttggattgcaagtccaaaaaaggccacatatttggattgagcgagacgatcggtcgatgatttcgaagcctgtcggcttaatggcaattaggacagcatgtttagtggtcggctgttgaacatcagatacaattatctgctaatctgcaagcgacaagggaacaaatgtaaacccctttagatgatcggtttgtcctcaatcgatatataaatcactcagcttaacatttttccctctgcaatatttcttctcaaatataagagatagtactatctactactactagttgttgttggcttcttcttgctgcatttttttttctgcgagattaattcgttttattttgcaatgttgtttatgtgtattaattttgggaggtttaataaattgtgaatgagatgctggttgttggtgatgatgaggattagaaatggttgcgacctactgctgaagcagatgtgcacgtcctctccaagctaatcaaacatcaatcgacttggaacgagtagtagcatgggtctgggtcagaggcaggatgatcacttgcagctagcaactcgccttcacgtagcaaattgcaaaaggaatggaagaaagtgatgggcgataaggatttttcgacttgttcaaagtctttctcgaacgatgtgttaattatagttcagtcctcgtcgatctgggtactctcttgtttaaggtaatacgttttatttatgtttttttgcaaaaaaaaaatccctttttttttatcgggaacatgagcttgtgtagcaagatgatgttgtacgtgagtattggaacaaaatggcccaatcatctcctctcagcccaagtagttgttttgggtttggattagggccgttagcctgacgaggccttttcagtttgtacggtctaggtaaccattgaataagccaaatgacatatttgcaaacgagaagtaacttttaaataaaataagccaaatgatatatttgcaaatgataagtaatttttaaataaaacttttatatgtgtgtccttagcgacctaaaagtaaatggtgaaaaataaacttcgatgataaaaacttagaaatcagcttcaaatttaagtttgaaaatttaaattttggccgataagtataagtataaccgaaaaagtggggcctgtaaattatctgcgagatttatgctggcagtccactcgtcagcgaaaaccgccgacagctgttgctgctggattttgaagcgtgattcctatagcggtccattttgaatggacaccattgatacgaacagatcatttcgattttgtatgggatacaaccgtatccgacgaatcgccgatctcatttttgtttcttttttcttttactctaggcggcggttttagtaggcgttggatgaaagagcaacattacaaagggtacaaccagagttcataaaaaccgtgcggttatcaaaacttttcaacttttgaaaccatggtaaatctcacgaaaatcacatagttaccacgataactgatccacggttacctcaaccaaaatagtttggtgaaccctgagtacaactacaccaatatcgttatgtttcttgtttgatgcaaaggccattctctctggtactataaaagcagagtcgccattctctctagtactataaaagcagagtcgccatctgccattccgttcgtgcgcatgtttgcacactccacgtgagtaacaatacaatgctttatcatcaatcatcatcctagactatccctaattatatgagcatggtccattacattgtataagtacttctactacatatacttaaaaaatatctttataggattcttacgaataataaacataattgttttgatttaactagatgaaaattacggaaaatctaaaatttagacatacttacaagttagcacgataattggtgctagtgagagtttagtaaaaagaaaaaagaaagtactacatatacaacagaactcacactaccaaggcttctgcagctaaattgttgctaagcgcttgctcacatatattctccttaatggatataaatcctcttcgaagacagatctaaaccctcgtatcctctctccgttgccttgccgccgcccgagtaggtcactggccagtcgagcggctgctaggaaggcggtggcggggttgttactcggcaaggaccttgcatcctatgttgcgacgaagtggggctgtcgagtctggggttcccgtccacagatttggcagtagcacaggagacggcagggaggtgggcagcggaggcatagcgacgatgggcgggcccacgcctagccacgtgggttggtgtcgggaacggaagtggtcaggagggcggcgggtagcggtgaggctacagtagcggcgtccctttgggcaacggcgggtgtggcgaaggatggtggcagcctaagcgttgatggtcagtcctcggcagggaaaaggtggatccggtggacgtggtccctaggcagtggtggcgggctgggagtccaggaggcggaggaggattccgtcaacggttacggccctatggatgacagaggcataggaatccagcaaagtggaagcgaatcctatcaacttgcgtttggtcggctaattctaactagatgatgatgaatgaaggtgggctaagcggtggtgtatggcgtcagctcacttcaagcggatgaagatggcatcagcgaaggttcgcaactatggcacaattgggcagcggcgactagtcgactaccacttgccaaatctagccgtttcaagagaggatgtcgagaggcagggttgtaccgaggtcgtaggtttttcttgcttcttcttcttcttctttttcttcttctttgttgttgttgttgttgtgtgttcttctctttgttgaggtgtgagctatacttttggttatatatatccttcgtggatgtaaagattggattaatgaaaatccattaacttaaaaaaaatctgcaaatgactactggggaaaagtaattcagcattatcaaagcaagataaaagaaaaaagaacaactttgtataacatggctacatcacatgtccacactcttctgttgaagaattgaggtgcaggatcagttgggagtgtgagctgattcatcagcaactcgtagccaaacccaacctttacaagccctctcgattcgctgcctcgttggcaccggaaggcgctctcgcctctccaaagcgaatcaaatcgatcgatcgctttccccgccaaaaagcaaggcatgcacagcctcgctgaaagcaaaccgaatccgaatgtcgccctccacctccaccgcacggaaaccctcgcccggcgtggattccttcccttcccaccgctgcaacccaccattattctcctccgggcaccacgtcgaacaccttatatacgccggcaaaagcgaagcgatccgcaggcgaaatccttttgattatattcgttggtgtggttgagctcgtcggggtgagtaactagcatcgatgcaggcggcgatgccggcggcggtgacgcacgacgacctgtcgctgcggaaggcgcaggagaggcgggcggcgcggtcgagcgggcgggcggcggtggcgctggtgtcgctctcggtgctctgcggcatcgtcggcttcatcctctgcctcgccgccgaggggtcgcgctccgaggcgtcgcactacctcatgaccgtcggcggcggcggcgccaacgcggcggcgaacaacgggcaggtggacgtctgcttctacaactccagcggccgggcgccgctggcgttcgccatcggggcgttcctgatgctcgccgtcgccatgttcgccgagcacgcctacatgctgctcgccgtcgccgcgccggactcgtccgcggcggggctcgccgtcgccgagggacacccgcgcgtcccctccgaccccgccaggctcacctggcagacctgctgcctcttcttcgtcacctggtacgtcaatgactagtctaccgccattgatgacgccatgattggggtttcgaactaacgctcgatcgtcgctgctgcggcgcaggatctgcttcgggctcgcggaggtgatgctcatggtcggcatcgcggtggagtccggccacgtcagcgactggaggaagccgcgggcggtgtgccaccgggtgcgcccgggggtgttcgcggcggcgggaatcctgggactcatcaccgtcgtcgtcggcttcgtcgtctacgtcacggccctgcagacgaacaagctgcgggcgcagcaccccgtcggcggctactacgtcggccacggcgccccacacccgggcatgccgccgccgccgatgccgtacggcccgcacccgcacccacaccagccgccgccgccggcagcggcggcgacagcgccaagcgcgccggagatcacgccggccgcttgccaggtccagccaagccgagcggcgtgcgtcaccaagcagtgcgctgatgcagtttgaaacgagtagaagaatttggagattaagcagagacggtgatgtttaaaaggcatctactcttttccgcgtaacatgttctttcgtgatttgctatattagagcatttgatttgagttatttgcttgtatgtcacaccatttgtttttagcacaaacatgatttgaattgtaaagcacttgattcgtgattacatctcaacaagtttcaatttaatttacttggtctattagcctccgctgtatcatctattcggaaatacgtgcagcatccatcacaaacaggtagaccggagttacagctccttggtggtaagcacggttatcacgcagtaaccgcagtaaaccgtacgaccatgtaaaatttatcaaaatttcaaattatttttaaattttatttgaatttaaggaggttaccgtgaaatttatcaaaatttcaaattatttttaaaatttatttgaatttaaggagattaccatggttttcctttcaccgtacccctgcagtaagagtggttcggttttgcaaaccctactcagtggtattaactaaaaacgcagatgcaaagagatcactagaatagtagaaccgaacaaaccctagcaatatataatttaaaaggcataatggtttacatgtccggacaaactgcaactcagcacactcctgacgaaactcaaaaccagacgggttcaggaatgtgttgtgacggctttgcagaagcttcgactcaggctatacaagtagcaaaatgttgcacaccatactaaaagatgcaaacactacatagtagtagcctgatgaaaaacgcagacttcaaagctttaatccctgttacagacgtagtgatatgatatccgtgaccagtagggaaataatgtaacactggcccccttgaaacctttagcttattgaaccaccagaacaattcagtaccccgcacagtggccacaatttaccacctctggtcaaatctgtcgaggaaatttgaaatcattacttgttgcctcaagtgaatgataccagaacagaaaggatttatggtaagagtggaaacaacccacaataaacacaaaccatgttgaggattgagagtacctgtatttatttgaattgagcagcaccaccgccttggccaaagtcaaaagtagcaccttggggagcagctaccgtggtagctcccattgtatcatcctcctcatccatccagtaggcctcaagaatcttcacagctttttcatagatctcattgttatcatggctctgcaagttctcaatcttttccaaaccttccgcttcatcaatcatctgggaaaagacattcacatcacctgcagccaaggtcttgtcggtttctcctactttaagaatgttctcgagaccctccaaacaaactgtaacgattcttatatctgggcaaataagaagatcacacaatggcttgatgcagccctcgctcaccagatacctattttaacaaaccatacaatatcaaatccaaatgaagcttaacatgaaactatgaaagcggttatatttgcatttcataaagctgaatagaactggtgcaaggtgagtaaacatacttgatttgatcatggctaccgcctgaagtagcatttgagatggcccatgcagcttccttcttgatatcgaactctgccgtttggagcagattcaccagaggaccaataatgccagcatttatgacagcctatggtagtcaatgcagcaaattgttgaacatttcagaacatgcacaatcaacaagatctatagctataggctattataggttaaggacgaaagattgcagctaagtgcacaagttcccaaccgtgtaaatgaatcaatcatccatatgctcccatcccctccccttctaggaccccaggtcccagcagcaacatttggactagtgattaggctgccattgatactttgcgagcaaatcatacataagggtttctttaagttactaccatgttctcagtctttgtacaacaaggatgagtctgctaacaagtgtaatcatcatgaaaggaaaagttgacctgaaagcttgcatggaatatgaacattgtgtggtgtttatggtttggagagggaacacaattaaaactactaagtatgcactacacaaatccttcatgacttagtagaatgatgagcatgtcagtattttttaagtctgtacacatacctgtatctgatctttgttaccagcagtaatatttgaaatagtccagcaagcctctttcttgatgcttttcttgagattttgtgtcaacagacttaggaggcaagggagggcttgatgatcaatgatgcactgtacaaaaaaagggggtggggggagatgatgagatggcaatatggatgtcaaaaaagcaattaactttcatgctgtgatctacagtagatatttcatattatatgaacaccagctttagcatagcagaaaaattctcagctctcctaaaactcaaacaataataagaatacaataagaaaagccaagtttggctgaaacaagtacagcagctatgacttgctgcaaagcaggcaatgaatttttaggcaaactagcaaattgcctatgcgttgcaatgaaaaaaaaatcatgctgtgcacactgcatgctcatcatttgaagaatatgtagactggctcttttcaacccctttatggattccttccctgtagatcttaccaaacaatatggacattatcttttggaggacgtttaaatttattgagcatgtgggtttcacccaacatggagggcccatacattagtgatagaggtagtgctggcagattcactgccaccaccactactaccttttaaagtagtatagagtatagatctaagtgatactgtgagaggacaaatctcaagtatttaagtgacacaaactagacaaatctttaattgatgggcgtaaagagtaggtcaaattgccaaacatgtgcatctacatatgacaaatatgtgcatttatttttcaatagtttttacaaaacattttccacattagatgcaacctctagatttaatatcaactatgatattaaacattttccacaagcctaaaatttaatatcaactgtgatgaacacaacctctaaatattaagctcaagattcatgagtcttagtagttgatatcaattgatacaaaatctgtcagatatagagatgcaaaaaatcaacacaatacctgagtttgcgcgtcatctccagttacaatatttccaacagttcgtagtgcgggtataagcactgaaggtgatggatggcttcatgttgtaaacagtataaaatattaaaaagggtataatgagagtagcaaataagaatctaaaggaaaatggcagaaaattgtaatgcaatgttgtcacttacaggagaagctccacaagacgggggcaaacaccagcttcaatcacggcttggatcttgtcattagtgccatcagataaatatgaaagagcccagcacgcatcagtgagaacttcctcatcattggagtgaataagccgtgccagtgctggaagagcaggcctagtctattgacacccaataaacatcatgttaaggaactgtctttccctactaactacagtagagtacaaagaaactttgtccaaacctgttcaaatgatggctgtggttttcctctgcagaagttcgataaagtccaagttgcattccttagcatagagagtttagtgtgctcattcaactgtgctagcagaggcagcaatgcaccattggcaagaacaaggtcacggcacttaggggaatcaccagcaacattgcccaatgcccatacagccttcaattttttttcaagaggtaaaaacattaataactccaacaatgcactcaatcaaaataatatcaaggaagtacagaaagcacaaagacaagtcaggagatgatcggatacctgctcacgaacatcatcactagaagaaccaagaagcttcacaaatattggtacagccccatgatcaatgacaacctttgtattctccgaagtgccagatgcaatgtttgtaagtgcccacgcagcttcgaactacaaaatttaattcaaaagcaccacagtaataaatccatttttatttgaacctaccagataatgaaaataatattgtgttggcacacacctgtagctgggggaaatcctctctggtaagaaactgcacgaatctaggaacaacgcctgattgaataacctcttcaattggagggctcctctctaattaaaaattgtaatgggtgtaattagtaattaacttttgttcaactattattttcacaaggtaacagcccaaaacatttaagaggtttgtacctatagaaagcaacttgcggaactgtgttgtggcctcaagctgaaggttgttatcgtccgaataaactccaccaatcatagcaggaaggctttcgagctacaacattcaacagagatatcaaatactcaacttcccgtattaaaccccaaaaagggtttaaaagcagtttccttctcttttaggggtggtgcaaagaacagaaaccagaggtagtttaacagtaacataaatgtatgcgttatcaatgtaggacgtctctagaaacatgaccagaaacactactatatgatttatgtgcttccatgtactaaagacaaggttcagtcataaggaaagttgcactggaccctcaatttcaagatagcacaaaaaatagctataaagatataatatggcatcagctcatttgtatgcttctatcaaaacataagatgaaacaacagcaagatgtacactaaaaattatcaggaagatcaatcattattacagttcctggtcacctaactaattatccgcagtgaatccgtggaagatttgatcctaagaccacaatctacatgtcctaaaactaaaactagatcactggagctagcaggcatgtacctggaaacatttcaaacgctaggagttcgcaaccgtgccaactaacagtacttgtaatattgtcaacagaaggagaatcagaaatcaagtgactaatcgaggcatcgaaacgtggtgctaagtgttgcctacatctagcaggaacctaccctcacccgcacgctagtagacatgcgggtataataacaaacttaaacaaatatgccgcagacgaatcaaaaaccctctcaaaaagtgcaatccaatccaacacctacctaaaatatgggatccaggacacgatgggatagcgtcatcggaggcaggggaggggaggggaggggagcgggggggaatcgaggagtatactactcaccttcttatcgacgccggttgcggcggaggcggggacgggggcctgggcctggagcccctcgcggcgcttcttgaggaggctctcctcgcggcggctcttgcggatctccaccatgttgtcctcgcgccgccgcctcccctcctcggcgtccaccgccaccttgtagcggttccgccgcacctccacccgctcgctcgggcgcagcgacatggctggctcgccggctgggtgctctccccccctcctctcctcgcggcagcggcggcggcggagggagaggcaaaaaccctagcgaggcgtcggggcggaggaggagaggaaagaggaggagaaaccctagtggccgcggggaaagggggggagttaaagctcacacaccacgatccaaatattctctgcgatttattttctttttctttttttttaatctgcagagtctgccacaatgacctcttccgcgggccgcggcttcgtcgtgttgagtttcgagaaggaaacgcgtgttgggcccaccgatgattgagcccggcccatctgtacatagtctcggtcaattttcattttttaaaaaaaaaaactcgtttcttacatccttcaaatttagctgtacagatctgttgaagtattagagcaggtacaatagcaggctataagctagctgcaaatatattttaaagagataaataaggagagataagggtagcgggctaaagatttgtagccagctgtagcacggactctaagacgcagtttatatatgacaggtgggaccatgtattaatagtgtagtatgtaactattgtatgaatgagctattagattggctatagatgaattggagctagtagttggctacactattaaacttgctcttaggaattattcaatggtgtgttaggtagtaatattttaggacggtggtagtagtgttgtttgctactctctccctcttagaatataagaatttttaggtttgagcacgggtattaagaaaatatgtagaattaaatgtgtgaaggttgtgattggttgtgaagtggaggtaagtgaaaaaattgaatggtgaagggttgtgattggttgagaagacagtgttggtgaataagttgttatattttgagacaaatcttgagagttataagttgttatattttgggacgaagggagtagtagaaaaatttttagtgaggggcaaataaacttatttctattgcacaaatccttcaaagtcagccagaaattcaatgctttgaaaataaaatgttagcaagaaattattgcattttcaaggtcttatgagctgaagctaatttcaaattttcgaagaaatacacctttctacgaagggggggggggggcaagggggataaactgtttcatgtgcgcatcctccaaattcaaccggaattcagttctggggggaattagctagaaatgcatgcattttcaatgtctcctaagctgcagttgattttaaaatcgaaattaaatttaggctctggaattgcaaatatacaaaaatctttatttatatataatggtgctacaaaagtatacatttaatttagtcgctgttacacttcaatatactgctcatgcacattttgacatcaaggataaattacaacaaaaaagaatcaacaacatttccattcaaaattagaagaccctcttgaatgtgccttctctttcccgagaccaacaattacaagttaacacatttttcactaagaaaacaagatcgttaaaaaaaaagaagcgaaagaaaacaaattaaaaagagaagcttcaatcaccagcgctgctggagcgcgcttgctcgctctcacgcaaagggtcgccggccggcggcacgcgtgcgcggtgcgcgcgccggcacggtggcgggcggcgagagcgatcgatcagatcatgttggagagggagcggcagatctcggacatctcgaggagggaccggttgaagtggtccatggggttcttctcgccgaccttcctgaactgctcgtcgcagccctgcatgtcctgcgccgccatgcccatcatggcgcggatggtgacggcgtccttgaacccgatggcgcgccgcgccgcgccgaggttgtcctcgacgtccaggtacaggctgtcgcacaggtccagcgccttcgccgccttcggcgtcgccgtcttcaccgcctccgtcaggtgcttccgcgccgcctccgtgcgcagcgcgaacgcgtccacctgcatgttgagcaccgccagcgggtccacggcggcgccgtacttggacgcctgcttccccgctgtggcaatgcacacctccgggtacgacgtcttcttgcatatctccgccacctcctcgttctcgccggccgccgtggtccagcaggccgccgccgccacgacggcaacgacgaggagcagcgtcgcgtgcgccagtgatctcgccatgtctgcctctggtcttcactagctagtctccactcggttcccaacgccaacgttgtcgttgcgggatcgattgaggttggccggagacaggggcgagagggagataaatactcgcgaggctgatccgccgtggggcggtgtggtgagggaagcggcaaaaatggcgggtggcctccggctggccagctgcttcgagccgctcgtttggtgtttgctaaaatgccaagctttctatttttgcatggaacccgcggagccgttggaacacaaagattgcagtaaaacttcttttttggaaacattttgcatttcttgccaaattaacacatgcatggttttaacttggtagcaaaagtaaataactaaatactgggaatatattttatctgcaattttgcagaaaatctgtacatacaagtacaacaatgcctagattgcaccatgcatctgcaagccaagggattaaagtgtacatttgtgatcacgccagctgtccatggatgatggggatcacggtcctttgctgtggtcaaacagacctaaccgaaaagtctgaattcctaccgcgccacaaaaattgttgtctaattaatcaagctatagtatacatgtttttttatactcgatcaggtcataaatatttgatgtttacaatcaaatttagacaaactttttaaaattttgataattaattttgtatcaagatgaatatgtaaaatcctacaagtttttaaggcaaatcaattgaaggacttaagaaattaatggttggaatttcaaaagcttaaccaacgtatgacgtattattctaaatgccaaatatttattgccaatctagccatcaaagggtcagtttggtatttgaggtttccgtttattcacatcagtcttctagtaggtatagtgttggcttaaaaacatcgtgggactcactggatgtgtcacatggttaatcctaatcaatatttctgttagaaaacgtttttgcccttaatctgcatacactaaataagagaaaaaaaatagagttgtacacgtacttcctattgttttagcacgtgcacacgagggttgagttttaaatgattgtagtatgcacatggaagtacataaatatttcctttttagataaaaccaataagaaagtattgtacgcaaaattcaataaaaaacatcatataatgatgggttaattggatccatgctattacaaatataccttttagataaatgacactattattcacatatcagctacatgccactggaatttgggaaaattgaaatcgtgtcactctgtcaagtttcccgtcatatccctagacgtgaaacccacatgtcggttccatcttcatccatcctccctcttctttcttcctcacgtatagttgattctaatagagatttttaatagaaaacgtgatggagtggggcacggttccaatttccccaaattttagtggcacgtagccgatatcataaacaatagtaacatttatctagaatgacatatttatagtagcatggatccaattaactctataattattgttggatacttggatgtaccgctgacatgaacttagttatatgggtgtctcatcatacattttcaccacatgaattgcaatgtgtgtgtgtgtgtgtatatatatatatatataaggggtataagggtcgttgatcaaccatccatgtagctttgtaagaacatgttcagttaatatctaagagagaggggttagagggaaagcgattatacagcagtagttggttaggtttacccagctatgtagcttttctaagaacatgttcagttaatatctaagagagatggattagagggaattgagggaagtaatttcacactataaaataggtgtgaactaatctttttcaaaccaaacaaggactaagtaagttcaaaagaaagagtttgaactaaaatataaaaacttaaaagagtagtaggatagacatatcggaattttaaggaccaaactgagacatgagtgaaacttggagaaccaatctggctattcacctaaagtaatgcaaagtatgtcttagtatgggcggtacatgccgactaaaattaaaaccacacttgagctagaagaagacaacccttattacacctttacgtgccaatggcatatacgatccatctaataataaataaatattttctataagtatggcagaaactaaacatatatataacttaatcagacctgctcatcttaaattatgacatggtgaggtaatttgtggttgcgacccataaaacgcctaggtcgttctcttgatctctaacacatgaataaacatacacggaaagtgaaatggttcggcacgacgaaggtcgcataactcttttacccacccggatttaagtcataagttaatatcactgtcatatccttcaccaaaactttttttattttcttaaagacgaccaagtgagtagtccctccgttccaaaatataagtaacaatcacccttaacccaaagttcaagaaacaaatattttcactttctaatctggatcaccctaataatatagtgcatgcactcaatagaccaatagaattaaagatcttgagagtggaggatttagaaaaataataatttagtgaagaagatgtgctaattaattatatgcatgcacaccttatattatgaaacatctagaaaaaaagttgtattatattatggaatggagggagtaacaactaacaagcaagttgttatgatttccaactagtagcttttattcatttaatcgagcaaaaaaaactgcataaaagaaacaacttaattccaatgttttttatcaactgcagtttaattaggctggtcaaatccgccataattaacttcgattgtttcgcagttaagcatctgcctaagttagttatttcaccacaccaactttatgatccattcgttaggtccatggtttgtcctcctactgaaaacctcacttgtaaaggattttgacctctacctgtatacgggccagcaaaagtcaagcaaaccaatacaaggtcatggcttcctcccgccaggtcaaagctggcaaccgaaatcaaccacgggaaagcgccgtcctggacgagattaacgtctctgtctcattcttcagaggaagaaaatgacataacccaaagaattagtaattaattaaatacgatcatggataaaaatgagccttacacatcagttagtaattaattaattacggtcatcagtttactactccctgaaacggtcatcagtttactactccctccgtttcaggttataagacgttttgaccttggtcaaagtcaaactatttcaagtttgactaaatttatatataaatatagtaatgtttataatactaaattagtttcatcaaatcaataattgaatatatttttataataaatttgtattgggttaaaaacgttactacttttttctacaaacttgttcaaacttaaagcagtttgactttgacaaaatttaaaacgttttgtaacctgaaacaaagggagtaattaattagccaaggaattaaactgatgtgttaggctcttgatgatgattcgtttgctgtcgtcgattgattatggaagaggtaaagtgtcattatcagtttggtaggggggagggggggggggggggagggtncattgggcacagggcaggcaaagaatacgcatgatggcacacacatgtggtctacgtctaccgggatatgatacgcatctatggctctcactactgtaccaccctacatggcatcgtcctttgagtgattaaaataattagtagtactattagaaatttgattagtttacgctaacctagtagtagattagtttagtgtgagctatcactgtttttttcttcttccatttcagtaggaagcctaaccggagtagaatatcctttgattacaagcacgactgattcaaagtttgaaattcaagatagaaataatttcaacattaggctacgatcagttgagccactgttggcaacatgtagaaaaaccaacaaaatattaaaaaaatatttatggctaaaatttttacatatctaatatgagtagtttaaatgccaaggttgtgctcgggaggagaggttagcaacctctccccatacacggaaaacgtggttacttattaacatatggttaattaagtattatattaaaaacttaaaaatatattaatatgattttgtacaacaactttcccatatatcttttttattaaaaaacaatgtttaacacttcaggaagcatgcacgtagaaaacaaaagaatagaagttggtactccctcgatcttaaaatataagcaatatggattgattaggacacaccttattactacgaatctggatgtaggaagtaacttatagacattagtaactgaagaatagattatgagaacaaatataaaaaaactcataagttctctttttatttaaattttaaagttttttttagttcatacttgtaccatgtgtctgctcgtggtgaatttcgtggtgttttttttttactggttggtttcacctgtcagtggcagtgccagcttcgagcagtgcaacggaaaagggcaaaaaagtcagcaggcggaaaaaagcagcagcgagaggagagaggagaggggggcgcaggcgcaaaaagcaagctaccaccgcagcccagctcgaggccaccaccaccaccaccaccacggcacggcgaaaggggaagaagaagaggaaaggaaaaaaaaaaaattccgcagctgctacctctcgccgccttcgccgccgccgccgcgagaaacccagcggcgtcccgggaaaccctagccccatcccccaccccgccgcgcgccctcatggggcgtccgcgtcggcgccagtagtagacaggagcggggggcccgccccgtcgccgacgaggggcatccaacgatggcgcggatacggcgcgcgagctccggacgaggttagtgtggcccgatctgagctgagctctccctcccgcgcttgctttgctgctggctttagctaggtggtgtcgtgtggtctcggtgttcgcgctatagctaagcgtagagagcaatccgagggtttagctttcgcggcacggcggcggcggctcgtgcctgtgcggcgaggtgatgcggcgaggggttgggcttgaggggagaaggtgcgtgatgtcggctaatcaactactgtggtggcggtgggggggttggcgggtttgttccaggatcttagtcgtcgccgcttgttcggtagctcaactctcaggccgtgagaatttgggtttggtgtcgcgggaatggtggtcatactactatgtaggattcagtgctctctgctgccgtggcgatactggatatctggaatctgatcgaagaagtggggcttagcttaggttatcaattatacaaatccatgccttggatagctcttggttctcttgtattgagcttttctatgttgattacttaaagctgtaaggcggttttctaccacagaagcactatacattttctggaccttccatgtcaaattgcaccagttcggagataacaaccattgctatacagaacaagtactttttagtctagttcatctaggatttgtatcgaccaaaaatatacgatgagcagctggatgtccctagttcagcatacattgggttttaaaatagtcaaaattgacattagtctgtatttgttgtagcctctgatctaagtttgagtcactacaaatggatttgtgatattgattatcaaattcaggccaatggatcctcctttacaagaaaatggtcattactgaactcttgttactggaatgatgagaattcctgcattgctgggtttgcggaaagtatctactttatgcagagaaaataggcaacatcatgtttaccatgtttggccttttctgggaaagttattataagttttaatttgtgtttatggcttcttatggaaggaagctctttcgttttcttgcaataacttgtctttctagaactaattagctcaagtcaaaaaaatgtttaatccaccaccatagccatgttaattagattatgctttcatgcagggtaataaacatcattataggttgaacatataccatcactgtctctgctgagtttatcaactggagataaacactttgaaaatagctgtcatactatttctggttctttatagctaaataatggtggtttatcgaaatatttacatggtctgtaaaatctttaactacacatgccatgaggtcttatgaaatcctctttgctattgatttacactatctttacttatacttggaaacatctgtgaatgcatataaatatatgcttgtgaacttttgttcaactactccctttgattccaattataagtcgctttagacttgtggacacaaagtaagaaaacagctcaaatgacttagttgacttcattggaaaagatgagccatttatttgtgagaggggtatcatttatttagcaagggcaaattgggaagaataactgcagaaagtgcctagaagttccataacttcttacatttaggaaagagttgagaatgctaaagcgacttatatttggaattggagggaatatttgatttatgtgttagagtgactatcttgaaaggtgattctgtacatcttttgagtgttcatattcattagttgcacctgaccagtgtcaatgtacatacatattctttaaggcgttgacttgttgattcttcattgtactgtttcttggcagggcttttggaagatgctcgaaggaaaaccttcttaaattttttggctgtggtatttactctggaattgattaccagaatcaatttgattgcccaaacatcagctctaaatgtggttgcccctgctatatctccatctcaaagttggagaccagttcgctccatgttgtcaaaagctaaagttgacattagtatttcagtcagcgaacaaagacgaaagaagctatattcatcaccagctactctatctgtgcaccctccaatgtcagcgccaagctatagctccatttctggtgattctgatctctccttttattcttcagacatgtcagataatttggtgcagcataacagacgctcagaagcagaaatttctactcatgtagatgctgcgcctcctgatgcagcctcaaatactagtgcagctccttctggattagtacaacctccagtatctcctcacaatggtatgtttgattgttagagccttggaatcatctaatttatatgattttcattattcaagcatgacttgaaattatatggtgtaaatacaatgcgtaaagggccatctggttattcgagtagatacacaaaatgatgcctgtgtggttatttctgatttgcctttccaagaatttgttctttgattgcacctcaaccgtaggcatttgagtaaattgtgcaattcttttaccaatcaaccaagtgatatcaacataaattattcaattgcaatttgcttattaatagttaattagaaatgttaactctattgtgcatatccacattcacattggaatgtacaaagcttttacttagatctgtgtggtatcatggtgcaccttgatgattcggatcaacattttggagatcaatgctttggatgtttctatgatcgcaaacgccggcaacagaaaacgcgcaaagaaccagaattaagctgaggggataaagctccatcattatcttgcttaagttttgttggtcattatcttttaagttagtcgtcatctttagttcactatctcaagattgttagccatttatctccaagtttgttaggcgtgtcaaatcccttgatctagaaaagggtatccgggtgtaaggaataattaagtaagattaatctaatcaagtttaggcatgtttagagcctctcgctctcgggggaagagccctgcctcccgccagaggatgatcgcgagtttcgcccctaccccctccaaaatcatccactcgagcattcactgctctgacagccgctgcaacaccatcaccatcgtgcgcgtatcactgcatacttgaagcatactgaaatgctcagtgcctgcgatccttttggccaaatccaattctctgaatactggtgtcagatgtgaaactggctggttgttttgtaacctgtttggttggcattgtaccagctttcaataaaggcttgcagcgagcacatggaactttgcaaagtccatgtatgcggtctaagccaatttataagctaggtctcgcttgtgctatttgtcactctgctttttcctgtcatgtgagctattgctattgacttgaacaactggcttctgtgattaagcttactctcattgatcttaacttttactgctcctaattttggcttatctgcctgatcacttgagaactctatagtatgtccagcttatgtggcctaaccacaacccttttttatgctcacattaaacaataagatacaaaatacatgtggtaagtaaacattggtatttttgttgttatcttgtgtaaaataattaatgaattatgtgaagagtgttatatgaaattatagtatggataatatcttctacaataatctgttttatttgaaacatgatagtattctgttgttatcctatttgcagtttattctgacttgcttattgaacatggcccccaaatattgtgggacttcagcttagttttcttcatcccttagtaatactgaagtacacattattgttgtgctgtctgcctaagaaacgtttatgctacaatatggcatcttttctctctcagttatttccagctctctaagatagctcagtgagatttaaccttactgttttccccatttattttgcatttggaattttctcatgtccttggttttggcctatttgatccaaatattttagtcacagatttgttgttaaccattatttgatttgtagtattctctaacagctatagatatgctgttactcacattataatttaccttctgttttaccagcatgttgttcacataacatggtacaaaagagagggagccaagattgccattgtgtttacccagtaagagttgagctttttctccgaaatgtttcactgacgtcaaattggagcgatgaatttctgggggaacttgcttctcaactcagtctgagggttactcagtttgagattgtaaatttctatgttgttggggcttctgggctaaacatcacaatgtatatagctccccatacaggaattagtttctcagccgaccaagttaccgcaatgaattattcacttagtcagcatacagttcagatcaaccctgtactagttggtgactacaatcttcttaatttaacctggttcaggccactggttctagctcctggtaatgctaactgatcttgactttgctctatatattacaatgccgcagtttattttagtgttaaggtagagaacactgtaagactacttcagtttttttttgcttctttaatctctattgtctactgtactagagaaactgaagaatatatatagtatgtggtaatactgctcatatgtttgtgattatcaaataagcagatgattataaaaaaatcactgtgggttggcatattccattctatagaatcaattagcaactatatgccaaagaaaaaacagaaaagaaaagtaagataaaattacaatattcagttccttacatttcttattctgtttttgttctgctcctctatacccttcatgcatacatagagtgcatcttttaatttgcatccagttctactgagatacatatatcttatactacatatgctttgagtttagcactggttgatctagtactctagtgcaaactttgtacacactacacagtttcttatacatattccggtcattaattcttggtgtatcaacttggttatacagttaatgtgctattttctttggtgaacttggctgtgcttcctttgttgatgatgtgacagaaaaggatgtttggtgatatcaatatgatacttcctatgaatgatataaacattatttctttatatttacagccctgtatgctgtccagctatggtttttcttttaacaaatctcctttcctaatattgtgatctttcatttctatttcagctccaacattcacaatatcacctaaaccctctccatctcaagcatctacagtaccaagacacagtgcggataccagcaatgaaaaacacatgagcttgattactatcatttgcatatttattggtgctctaattgctgtcttggtgattgccatgtttatttgcttctgcaaattaaggaaagggaaaaggaaggttcctccagttgagacacgtacgtgcagagttatctattctcagctacattccttgaaaactatagatttgttatacttcatgagatctctaataattgatagtgaagttagatataccatgtccatagctccccataatatttttggtttcttaaccaaatttaaatgaattatgcttattttctggttcattatgcatgttggagcattcttttaggagcattaataatatcagttctcctgtgcagccaagcaaagaacaccagatgcggtttctgcagtggactcacttcctcgcccaacaagtacaaggttccttgcatatgatgaactgaaagaagcaaccaacaactttgatccgtcaagtatgcttggagaaggaggttttggccgtgtctttaaaggggtactaactgatggcactgccgttgctataaagaagcttactagtggagggcaccaaggagataaggaatttctagttgaagtggagatgctgagcaggttgcaccaccgaaaccttgtgaaactcattggttactatagtaaccgtgagtcatcacagaacctactgtgctatgagcttgttcctaatggaagcctagaggcttggcttcatggtatggccaattgagtcaactatttctccttctgaaattgctgcataagttccactcagttgcagttgaatgtggtccttcattgtttaattaattagtggtgatcatgtaatcatgatacaccttgactcttgagtctctgactacttacatttttttcaggtacattgggagctagccgccccttggactgggacactagaatgaggatagcactagatgctgccaggggattggcataccttcatgaggattctcagccttgcgtaatccacagggatttcaaggcttctaatatattgcttgaggatgactttcatgctaaagtgtctgattttggtttggccaaacaggcaccggaaggttgcacaaattatctctcaacacgtgttatgggaacattcgggtaagcaggttgaccaccttgaagtactccccagatgtttctgctctgcttttgcttcatatagctgtcgtgctttcaggtatgtagcaccagagtatgcaatgacaggacacttgcttgtaaaaagcgatgtatatagctatggagttgttctacttgaactacttactgggaggaggcctgtggatatgtcacaaccttctggccaggaaaatctagtgacatgggttagatttctttctgctcttatcttcagctgttattgtattacctttttatatctgaacatggatcctttagtatgataattgtcatctgaagttcactagccatgcatgttagatatttatcgatatatctcgacaaggcaaacaaacaaatggacttagagcaatattactactaatctgtttcctttttcgaaaaaagagagacattttttatgttcctctctattcatatgcattgtgtacatccttgggtggaaagcagatttatgtgtgagtaaatttacacttcaacatttttttatgcctgttgtgccaaagcgccatctatctgtttgtttctttttgtgcctatgtttatgagcttacacaaatgtttcctgatctttccactaaaagccttgtgtcacatcaacctttgctggccaatttgtcaggtttgttcattaggtttttgaaagccaactctcaaacgtcaacgtatttcttgtagacagtaccaaattcttatccctgcataggtgtagagatacttatttgctcaattttgactacgcaggcacgaccaattttacgagataaagatacgctagaagaactagctgatcccaagcttggtggccagtatccaaaagatgattttgtgcgagtatgcacaattgcagccgcctgtgtttcaccggaggcaagccaaaggccaacaatgggcgaggtggtgcagtcactgaagatggtccaacgctctgagttccaggaatccataccaacacctccagcacgacccaatgttaggcagtcctcaaccacctatgaatctgatggcacttcatccatgttctcttctggacccttttcaggcctcagcccctttgagactgagaacatatcgagaacggctttctctgaagatcttcacgaagggcggtaacagtggtggtttgtgaagctgttttgggtagagcctcagagtctctgaccacccatttgaaggctggtggtgcaagtgacctaaccagttttattgggaggtaaatcctgtaaattccatttttattcaccacctgcgaaagaccaaattgttacaagaacattcggtggctttgtatgatggaaatgattttgttccaagttcttttttgctcctatagctcctgtctcatttactgtatggatcatagacatttaattaggtgatgtggttgtattcttcagtgacaaattgtggtactgtagctcgtgtcctgattgaacagcagagagctgcgctggtgaccctacacgtgtcatgcccatggcgagtgcccctctcctctcgtggacccggcaagcgctcccagtcgctgacacgtgtcaccccgctaatactgtttccctcagcctcctcgttttgctcctctcccctcgtcatctcgattgctgtgtgcgcctcacactgtcttctccctaccctctgtttgtctcctccctctccctctgctcatggctggtagggttcggtgctcgccggcggtggcgctggcgctcgtcgtggcggcggcggccgcggccgcggcgacggcgaagctgtacagcccggcggacaggatcctggtgaactgcgggtcgacgacggacgggctggacgcggaggggcgcaggtgggtggcggacgcgacgaacgacacgtggctgacggactccggcaagtcttcgatcatggcggccgccgacgagctggagacgatgctgccgtcgtccatcccctacatgacggcgcgggtgtttaccatggacacggtgtacaacttcacggtgaacccgcgcgaccgccactggatccggctccacttctacccgtcgtcgtacaacgggctggagccccaggacttccggttctccgtcttcaccaccacgggatacacgctgctccacaacttcagcgtctacttcaccaccaaggcgctcacccaggcgtacctcatcagggagtactcgctgccgcgtgtcccggagggccacttcggcgtcaccttctcgccgtcgcccatgatgaacgtcacctacgccttcgtcaacggcatcgaggtgatctccatgccggacatgttcaacaacccggccaccatggtcggcttcgccgaccagaccgccgacgtctccgccgccgcgttccagaccatgtaccgcctcaacgtcggcggcgcctacatcccgccgtccaacgactccggcctcacgcggccgtggtacgacgacacgccgttcgtccagggccccctgcgcggcctcgtctacaacgccggcccgcacttccacatcaagtaccccagcgacgccgccgagtacgccgcgccgccggaggtgtacctcggcggccgctccatgggcagggaccagcgcctcaaccagaactccaacctcacctggagcctccacgtggagtgcaacttcacctacgtcgtgcgcctccatttctgcgagctccagctcatccacggcaaccagcgggtgttcgacatctacatcaacaaccggacggcgcagacggacgtggacgtgctggagatggcgacggagcgcggcgtgccggtgtacaaggactacgcggtgaggctgagcaacgacaccgccgacgagcatctgtgggtggcggtgcacccctcggtgatgctccgcccgcagttctacgacgccatcctcaacggcctcgaggtgttcaaggtgaacaacaccggcggcagcctggcgtcgccggaccccgtcccgtacaagctgctcgcggagaaggagctcggctggggcgggccgccggagttctccaccgacaacccggccaacatggcgtcggtgatgggcggcacggcgggcggcgcggcggcggccgggatcgtggcggccatctgcgtggtggtgtacagcaacaagaggagcaagaagctgggcggcggcggcgccgactcgcacacctccgcgtggctgccgctgtaccactcccacaccagcggcaagtcgtcggggcacatcacggcgaacatcgccggcatgtgccgccacttctcgttcgcggagatcaaggcggcgaccaagaacttctccaacgacctggccatcggcgtgggcgggttcggcgtggtgtaccgcggcgtggtggacggcgacgtgaaggtggcggtgaagcggtccaacccgtcgtcggagcaaggcataaccgagttccagacggaggtggagatgctctccaagctccgccaccgccacctcgtctccctcatcggcttctgcgaggaggacggcgagatggtgctcgtctacgactacatggagcacggcaccctgcgcgagcacctctaccacaacggcggcaagcccacgctgtcgtggcgccaccgcctcgacatctgcatcggcgccgcccgcggcctccactacctccacaccggcgccaagtacaccatcatccaccgcgacgtcaagaccaccaacatcctcgtcgacgacaactgggtcgccaaggtctccgacttcggcctctccaagtccggccccaccacgctcaaccagtcgcacgtcagcaccgtcgtcaagggcagcttcggctacctcgacccggagtactaccgccggcagcagctcaccgacaagtccgacgtctactccttcggcgtcgtgctgttcgaggtgctcatggcgcgcccggcgctcgacccggcgctgccgcgcgaccaggtcagcctcgccgactacgcgctcgcctgcaagcgcggcggcgcgctgccggacgtcgtcgacccggcgatcagggaccagatcgcgcccgagtgcctcgccaagttcgccgacacggcggagaagtgcctctccgagaacggcaccgagcgccccaccatgggcgacgtgctctggaacctcgagagcgcgatgcacttccaggacgcgttcgacgccgccgccggccgccccgtccccgcgctcgacgccgccgccggcagcagcagccacctcgacgacgggagcacggccagcatcaacacgctggccacgtcgtccacgtcgcacccgcacgagccgtgcgtcgacgttgtcttggagcccgacgacgtcgtcgcggagcgcgccaccttctcgcagctcgtccagcccaccggccggtgacagtgacaccactacggcactaccacaagtgaaccatgcacatagatccaaagtttaattagttccgactttttttttatttctttcgaggaaattagttctaattaatgccaaagtttgattagttccgagtttttcttttgtgttaattaatgctaaatctcggtttttggtttatatccctattccggaccagattcattcgtttccgagacctaaatcgagttcatcccaagtccaattccgaaacctctccgaattttcttcctctatcttaagcaacatttggaaaaaaactctccgaattataccattataaatttccagtcacccatgtaacgtgtgttcaacttgcaacgaagctaacccaaacgattaactccgcctcgaccgggagcggatttcaactccgcctcgaccgggagcggattttaaaaacatcccctcattatttgcatgccatctaaatgattataaaaaattttaaaaaaaatgactagatagattaatctaaattaatatatttcacaaacatgctggttaaaattcaacttatacaaactataatgaaaaaacaaatttcattgcaacttgttgaagttaaattttggataaatgtgacatatcctacattcaaaatcctttatattttgaaatggagggagtatatatgttaactcaaatataagtttatagctagttaactctactattaaacatcttctataagtttatatctccctagtagcaaaacacatatttttgatggttggcttttggggtggacaagaaagagagcaagcataacacatattcttgtaggagcttctgctatacgttgggctttgtagttgtgcaggaataatgcggtttttgacaaatcaccatctattacatatatgcaggtaatttttagggtaacatattggcttcagctctgagctcaactacaaagatctgaagaagatggtgagttcatacaagtagcatgtcggaagcttgagacggcggttatgcaactctttaccaattatagatggagattaacaaatagacttcgataaatgtgttctccttatcttttgttttggttggtttctctttaatctttggtggatgtttttgttgttttgttgaactacaaacatcttctaaattaggatggagggagtagcaggatcagggtttaccaaaccgtatggttatcatggttatcatgtgcggtagcctttttagtttttgaaccacggtatatctcgcgaggttaccgcaataacaatcaaaccgcgggttaatggtaaccccaccctaaacggtttggtaaaccttgacagaacccaaccacaagtattctattgctctgtaacgaataaataatggtttcaattctccagaaaaaaaagatgatgggttgatcagggggagtatccttaatgtatgttcattaagagcatgttagtttttcaaactattaaacggagtgaaaactttctgtatacaaattgctttataattttatctttttaataattaattagttatatgctaatcacgtttctcattttagttgtagaagagagggaaaaaaatatgagcatgttttaataatgtactccctccgtttcacaatgtaagtcattataacattttccatattaatattgatgttaacgaatctagacatatatatctttctagattcattaacatccatatgaatatgggaaatggtagaatgattcacattgtaaaatggaggaagtaactattatttattattttatgtattttacacgataaaaatatattagatttatttatatatttttattaagagaagaagtatgtttcatttgtcccggccccacgtatcaatgaaaccagaggatcccaatcctctactcctagcccaccccaaccaaaccatcgtgattcccgagccggacggacccgaaccacagttcacccgtttaggtcgccgcctcgccgcttcccactcccgaaccctcccctcccccctcccgcccgccgcgtacggcgccggcggccacggcgagggccctcgtcgtcggaggccccctaccactggcctggcggggctcacccgccgccccctcctcctctcccgaaggccgaagaggcgcgcctccatcatcagcaggtcagtttgggggtggtggtggtggtggtggtggtgggcgtcgtgtacctgcgtatctgtggacgcgtggggtggccgcacccggtgggaaccaatgccggcctagagccgtcggtcgcgcgcggcgcggatgcggctcttaggggtagagagggggtagggcgaggcggattggctcgatttgttcgcgcatctgttcttttgttttttttccctcgctcatagaaatagcggggatggatagtgttccgcgcccttctgagttggggggcactgcgtatatttgtccaaggttaaactgatagacgcgaggatttatgagatggctagggattgcttatgcggacgctggtagtggtagggttcggaatcgatttgctgctttttcgctctctgtgaaattttagaattttctacattagaaatgccatgaagcatgaaagaaaagaaaatctttagtcgtatatgccacttgtaattcagaactgtatatatatattattgaaatgcgcatgagttcaatatcatcgtgaaagagatattcattggctgcttttatgaacttcatgagaagcatgtttcagtttgtggcttttagggaaatgtaggtctggagccaatttttttgatcgaattgaacatgtcctgtatgatatcgactagtacgtgcatcctagtagcttatatgaactaagggagaaagcaattatgggcctgcttgggagcgattgctgtggcttttggggctgcagcggcacagcgcagccgcttggctgcatctccaaaaggccacagccattgcatcaatcagctgttgcgggagaagctggctagctgctgcagcacagcgacaggcagctgaaatgaacaagccctatggttcaaccaatgacaaaaaatgccctctaggaactatgtttacttttatgtgcaacagcttctatttatttacattgataagcaaacatcactgcagacttgaaatatttcttttgccttcactaaacaacttcttccttctatttcctcagcttttcatagcaaagactagcttgaatagattattatctgccaatggcaagggaaccaagtcctgaaattgatgatgaactattcaatgaagtttatgggaaggcatacagtggtccagttgcaacaactactaacaatgtgacgcctagagtgaatgatgagaagaggcccctcgaacgtgaaaagtcagatgaggaagatggccccccagatcccaatgctgtccctactgacttcactagcagagaagccaaagtctgggaggctaaagctaaagctacagaaaggaactggaagaagagaaaggaggaagaaatgatttgtaaaatatgtggagaatcaggtcattttactcaggtagtcttttctctgaataaattacaactggcatgcttgttgattgagatagacacataatgcattactagactttgtttatccacttgcagtattttcaactctgcagtaagtcagtaacgagttacactcaatattgatactgaatttaacagttagcatattcaaaatggagattgctctgtaaaaagattagtctgctgtagtgttgtatcaacctttattttttatcttgaatctaaaaagtatattataacaaaaataaattctgtgactactattatttgtcattttcttttcctttttcctttcatctttatttatcatttttcagacctttctcctttttcattactctcaatggtgaatttggacttaaaaactttaatacaaaagaaacatgttcagtagtacatccacaagttcattcattctcctatctttcataatttatatgctaatctgattgctcaaccaaacattcgtgcactggataccttaaattcattgagtctctttaaagcacctcagggagttgcctctatacatcttgacattgattacagtttagagacactgtagtgttttatgtgcattgtttgtgcatacttataggccctgtttctttcagcttgggattattataatccagattattgggagtaagctgagagaaacagacaacttattgaaataacttattataatctagagcccagcctattataatctgataagctcatttaggtgagctttttccagattattgggtgaaaaattacccaccataccaccccactccctctttagacttgcaaaccaaataatctaggctctaataatctaggaaagaaacaactaaccgcttattctactacagattataacaatctatcttatagtaatctgactcaataatctagattataataatcccaagctgaaagaaatagggcctcaaaatttgtatttcagcttacaattttttccctttggaacagggttgtccatccacgctgggagcaaataggagaaatgcagatttttttgaaagagttccagcaagagataaacaagtcagggatctattcactgagaggacaataagtcagattgagaaggatgtggggtgtaaaataaaaatggatgagaagttcctgtttgtcagtggtaaagataggttaatactagcgaaaggtgtcgatgctgttcataaaatcattcaggagggtaaaggtaaaaatacttcaagcagtccaaaacgggatcgtttgagatcccctgtgcgaactaccagtgatattcgcccaaggcacactgattctagatggtcacatagtccaagaagtgctccgcgctctcaaagtaaaggatattataacgaaaggcctctagatggccgttcacatgatgatatgcctaagttttcgaaagaatctccacaaggtagggcgctcaagcacactcgtcttatcattgttgtatcggcaaatattaggagccaggcattttagacgatttgagataaagaaaatgcctctgatccctttttgttggttaccaccatctatggtaatttgtttggttccttttgcagctagaggtaagttcaagatttatgtgctcaaatgactcaatgtatgtctggttatgatcagacaaatttacttgaatacaacaagttccatatcgaaaggttttccagacatctgacttggatggcctgcaatttgtgtattgcatctggcattattcctcctttcagtgta

SEQ ID NO: 67912 - DNA, 1779 bp, Oryza sativa
gcgggcgcaccgcgggagggtgaaaaagctcagcaagctcgcgctgcggcgggcgcgggactggcgcgcgcgcgtcgcgggcctcgcggaccgcgtcctggcgctggcccccggcgcgcccgtcggggacgtgctcgacggcgcgcgccccgcgccggacgagctcgcgttcgtcgtgcgcgcggtgggggtggcgtcctggcggcgcgcgctcgacgccttcgagtggctcgtcgcgagcggcggcgggcgtgccccgggcccccgcgtcgtcgccgtcgtcctcggcgtcctcgggcgcgcccgccaggacgcgctcgcggaggatgtcttcctccggttcgcccgcgagggtgccaccgtgcaggtgttcaatgccatgatgggcgtctacgctcgttctggccgcttcgacgacgcgcgccagctgcttgacgcaatgcgtgaccaggacatcgagcctgacctcgttagcttcaatacccttatcaatgccagggccaagtctgggtgtttggccgctggtgtcgctcttgagctcctacatgaagtccggcaagctgggctgagaccggatgctatcacttacaacaccctcatcagtgcttgctcacaaggttctaatttggatgatgcagtggcggtgtttgaggagataatagcttcagagtgtcggccagatttgtggacgtacaatgccatggtctccgtgcatggccggtgcgggaaggcacaggaggctgagctgatgtttaaggagctggttgagaagggttttcagccggatgcagtcacatacaactcgctcctttatgctttcgcgaaggaaggcgatgtggagagggtggagcgtgtgtgtgaggaattggttaaggctggtttcaggaaggatgggattacttataataccatgattcatatgtatggaaagatgggcaggcttgacttggcgcttgggttgtatgatgagatgagggctataggctgcactccagatgctgtgacctatactgttttggttgattctttagggaagatggataggatttctgaggcagggaaggtgctggaggagatggctgatgcaggattaaagccaactttggtaactttcagtgctttgatatgtgcatacgccaaaagtgggaggcaggatgatgcggagcgtacatttgatcgtatggttgagtcaggtgtcaaacctgatcgtttagcctatttggttatgttagatgtttttgcaaggtctgatgagactagaaagctgatggttctgtaccgggctatgatcaaggatggatataagccagatgatggtttatatcaggtcttgcttgctgcactcgcaaagggaaatgaacacgatgagattgaaggagttatccaagacatggaggccgtttttgaaatgaatccactagtaatatccagtatactcatcaaggctgaatgcatttctcagggtgctagtctgttaaagagggcatgcctccaaggatatgagcctgacggtaagagcctactgtccattttagacgcatatgaaaaaatgggtaagcatgaaaaaggtctctctttgcttgaatggatccggcagcatgttcccaactcccacaacttaatatctgaatgctcgatcatgcttttgtgcaaaaatgggaagattgttgatgccattcaggagtacagtagaaaacaaatgttaaaacgtgatcctttggtcaagactgcgacttgtatgagtacttgattacttaccttgaggaggctgagttattt

SEQ ID NO: 67913 - DNA, 1798 bp, Oryza sativa
tgtgcctattatcatgtccaccacatcactgacgttcatttagctgacctcatttgctgtatcttttgcttatgagtgaattgaaattataatacaatatgtaacttgtttacatcttttagctgaagtatttacataaagatctacttgacaggctagacaggcttacctgattggcaacaaagctctagccaaggaattgagtatgaagggacagacatataacacacaaatgaaagcatctcatgagaaagcaagagaagctatttatcgacagaggtcgcctaactggttccctgttctttctgcgctggatggaaaatccttttcatgccaatttatactttgtccacccgattgacaagctgcgccttgtactgttcctaatatttacaagtacacttaacatatcatatgtttttgttgcaatgttcctcaggaacccatcttcgcaacgagggagcgaccgtctgatcgatctacatggtctccatgtgaacgaagcaatccatatacttaaggtcgagctcggtactcttaagagcaccgcgagggctacaggtgagaggatgcaagtcatgatatgtgtcgggacaggtcatcacaccaagggttctcgcaccgccaggctgcccatcgccgtcgagcagtttcttctggaggaaggcctccactacacgcaggcacaacctggtttgctccgtgttgtggtgttctaacatctcttaggtcagcagcacgaagaaaaaagaagcaaaacaaaaaaaggagaaagagatgtagggaaaagaaaaacctaaaaaaaatggccgctgttgcagcactgtaattttcttgtagttgtatattaaaagaggcagcaggagaatagcctgacaacagaatacagtgtaaaattatacatagcttcattcaattcacattccattcccatccggttgttcttgcatgttcttgacgttttcttttgaggtactcgaaggttgtttgggatgcatatgcgatttagtatttgccatttcttgctgatgattgatgatgaacatttctaatagaacgagttagaccatgttttgaatttctgaaaattctcctggttactgtggttgttgctggaacggaaactgatcaagggcctgttcactttgatgttaaaaaaaaccttaccaaattttggcattgctaaaattgctaaaattttggtatagttaccaaacttttgacaggattttttatatactttatccgtttcacaatgtaagttattctaatattttttacattcgtattaatgttaatgaatctaaatagatatatatgtctagattcattaacatcaattttaatgtgggaaatgctagaataacttacattgtaaaacggagggagtagttatcaaaatttagtagcaaactaaatgtaaccacttttttttgacatcaaagtaaacaggcccgaagtttagctatccaaatatgccccaaacgttcaaatccaaacgaaatatgttgaaaaattgaaattatgtcggcctgtcagaggctctttcatcgcttctgaaacactgaaactgcagctacgaaatttgagacagatttttcaggagcagggagacgcgcgaggaaaaatatcttgcgctcgattagtgattacccgctcaaactcccgcaacgttatcatctccactcttccacctccatgcccatgcgcgactgatccgccgcccaacgcgatgcctctcatggccgtcgcctcccaacccttcctctccaccttcacctccacctcctcgcgccat

SEQ ID NO: 67914 - DNA, 8406 bp, Oryza sativa
agagcgagtaactagtttgactagtcaaattagatgaagaattggttatataggtgtttgagttggctatatagttgtttggagagtccgatttagataggctgttggtgatgctctaaaaaaagaaaaaaccaatctaaagaaagatgtgacccttccttacaacgaatctgaacagattccttctagtacagcgtgttcatatttgttttagtaggagaggtcacatcctctcttagattgattttttttaacgaagggagtactccgcattagtattaacccaagtgaagtgtagctaacaaaagaaaaaagtacattaaattaatcagaaaagctgttgaaagttgtcattatgtactactgtcgaacgattttttttctgagattacccagcaaacacacatccacacaccactatacacgtaacaccaatcactgttaatgaaaagacacgacgacttgagagatctgcttagctccagtgcagatccaaaatactgacaagatacacacattctagttagtttaatcttgtaactgacaagatgtacaaattagagatcaatgagtcgattgtccaataagccgatatagcatgctagctgatgcttataccaggcgatgtcaatagagttttgaacaatcggctatatttccaatgtaaattctgacacttgagtaaataatctatcgatgaaacaatttaactgacaccaataaaaccctagaaaagatctagtcgatacatgtaaattgagacttcgacttagattaactaagatatatgataaataggtgtttacatcaacaatattagagtgtcgaggccctagcccttccgatacaaatagctataacaagccttacccctcgttggagatcgaagccgatgcagcccaactcgaaacaagacctcgtcgagaaagacgaaaataaaaaggatggcgatgcgccgaagttgtattgaccgatagatagattacaaggatctcgggtgtacatatttatacccatgagtggatactaatcctgagcggatactaaacaaacttttctaaagataaaagaaaaaacataaaatcctcatcggacatgaatcatactttcctaaatacaaaacttgcttaactaatagataaactaaactgctatgacgtggtttccatggttccttcttaaactcgaactcttttagataagctttccataggctcattgtgctctttccttaaccgaatccattaaaaaatcttaccaaattttggcgttaacacacacttacacccccgcgaatgcgcccctaacaccaattgcatattcctgatctcactaaagtcatgttgaaatttcatttgcttgtgcataatatttataggcaccaggatttgaacccagtaaagtcatgcacccacaacttcaccatcacaccacttgtatttccagaacgagcgatttggtatcacagcacagcgataatattttgtgtgcgagtgtgtgtactccctccgtgaaaaaaaaagctcaaccttggtgaggatgagataacctaagacaacaaatcttgatagttctctgtccagattcgttgtactaggtgatgtccaaccttaatatcatccttacttaaagttggacggagggagtaagatccatcgggctggtctgttgtcttacgtggcgttggcgatcaatcatggccatggaatgaaatggcacagatggcgtctcgagctcgtgccgtaggcgtagggtatacacctacaagatatatatcactatcatattttatcacacataaagtactattcatattttatcatctaataacaataaaaatactaattacaaaaatatttaaataatacgaacggttaaacgttggatacaatcaatgcaaaactacccttattttaagatggatagaaagttatgtatatgggactgcctatatatcatctgacagattttttagcatcttatcatacagatttcttactctttggatgaacatctaacagatgatgacagattttttagcctcttatcatacagatttcttactctttggatgaacatctaacagatgacattaatatacacaaacaaaatataaaacaacaaacaaacaggccacatggacaatctgaagctcacgtggactcaaatgggctcaagttgatttcagacttacatcataaatacactaaaattacatatgtaattttcagacttacatcgtaaatacactaaaattacatatgtaattaatatataattacagtgtaagtacggtgtaattagtacgtgtgggatcataaacaaattagcattagaaaacatagctcaaatcgataatgatggagtcggcaaaaatgcaccacgaatcttgacaccatccaacgcacataaatctgcaagatatgtgactcaaaaatctgtcaccaaacagatagcaattccgtatatcggaattcctgagtcagaactgtatatgatgatgatgatcagtcagcggtcatatatcatatttctattattcatatatacatattattaatcatgtatatattattatatttaaagacggcgtcgttgaattattatgggttaatttgatctataccactacaaattttgctattcagaaaaataatattacaattcgtttattcgtaaccataccactgccgttaggtttccatccattttcttccttctccatcttcttccttctctcttccgtcttcttcccggtgatggtggcggcgaggccttgtcccggtggcgagccgtctcccacgcgggagagacggtgcggcggcgcccgcgcgccacgaggtgaagcaacacggcagtgctcgcgcgagtctgtcgtggcggcatggtggttctggcgcggaggcggcgaggcggctgctcccaaatgagacagatcgtgagcgcattataacaaagaccaagcgtccatgctgcatcctactgtactgtatcactccctccattttgattgaatgggacctattatattaccaatctaaggaggtgtttattagggggtgtaaaattttagtgtgtcacatcaggtattatatagggtgttgtatggagtgtttatgcactaataaaaaaaataagtatccgacagtaaatatgagacgaatttattaagccaaattaatatgtcattagctcatgtttactgtagcaccacattgccaaatcatggagcaattagacttaaaagattcgtctcgcaaagtagtcacaatctgtgcaattagtatttttttaagcatatatttaatacttcatgcatgtgctcaaacgttccatgtgacatggtgtaacatttttaggtgggatctaaacaggccctaaacaaaaaaaaactaggatacattgtatttaaccaaaatctattatattttaaaacggaagatatagaggctagccaaaataaatcttactagcgtccaaattttgataaactgacaatattatcgtttatcaaaatttttataagatttcttatctatttacctcaatttgacgagaaactaaatacatacacatctttgataattttagtaaaaagtaatatggtttaaattttaaaataatatcaatctgaatagcccatagtattcactgttgagggtacgagctgaattgaatggctccatagtactagtactgaaacgactgatccagtagtcattgtagcaacagtactgtagaaggtaggactgacggactgtggtggaagtgtggatggatatacggccggccatcatccattcattcgtcgtttcctgtatccaaatattccataaaaacgaatctacgatcggatgtgacatattctaatacgataaatacgaatctacaatcgaatgtgacatattctaatacgataaatctgaatagatgtatatccagatttgtagtactatgatgtatcacatccggtactaggttgttttttatgggacggagggagtacacctttaccttttgtcctaaaataaatttatttttcacaaatcctacatatatcaataaaaagttttaaaaaatatttctacaatatcaaatcctaatgtaactatttctcattttatctactctcaatattatttttttcacttttataaactttaatgtaataattactttaaaaataaaataagaattcattttgagacaataaaaatggctaaaaataaatttattatggaacaaaggaagtcctttgacaatgcatatgcgctaaaaatctgggactattaggccatccccaataaaaaaactatcaaactatcaattagctttcatacatgttattcatgtagatactgtataaaaactatatattcaatggatgatgtcgtcaaattaaattctcatccaatcatctctcttctctctttttatccacctatttcctatttttcattatttgttcttgcgtagagatggttttttgcgagagaaatgatttcttcatttttttacctccgtcattaactctattaactctcttgtcacatcagattttttattatgtgacaaatatttaatgctacctagctgcacccgggctgccttcaatccgttctgtaaccccaaccccagatgcgttgtgcaatgcattctgacacactcaggtggtgtttggatccagagacttaactttagtttctatatttagacactaatttagagtattaaatatagactacttacaaaactaattatataaatgaaagctaatttgagagacaaattttttaagcctaattaatctataattagagaatgtttactgtagcatcacatagactaatcatggattaattatgctcaatagaatcgtcttgcgaattagtccaagattatggatgtgttttattaatagtctacgtttaatatttataattagtatctaaacatctgatgtgataagagcttaaaagttttagttccatctaaataaggtatcaggtgtcgttgtttccaatttttaagtttataggagtaataattaaaacttaattaatcatatattgataatacttctattttatgtgtccttgcttctttatcggatgaaaagaacacctcctgtataacttatccgtttaattgcttcttgcatgagcacaatttatacacagcaccaagctggtgcatgggcccatcaatcaatggttcgactcacaaccagggttgatgttaccaccgtaaccagggcttaccgcggagtatggtaatataaataccgcggtaacctccttaaattcaaataaatttaaaaaataatttgaatttttgataaattttgcacggtttttcatggttaccgcggcgccggggtgcggtaaccccggccccggcggtttgagaaaccctactcacaacacataggcctcacgtacatcacgtgacatatgcctccatcataacagcctcagacgccgcagccacctttcgtagtccttttggctgccctggggcgtcattgtttttctttatgttttagctctttaaaaatttattttacaaatatacctttataaaaaacttacttagaaataaactatttttctcgacgtcaagattattagaaccgagtttcaatgtcttgacgtcaatcacactggcaccaatagcctcaatcagacccgttgatgcccaagagccaaatagacgaccgcatagggtctatgattttttttgggcccatgtgaagatgaaggactatagtctattgcccacaactatagcatgcaaggcaaatcgccaagcccaggtggccacgcgtacgacactgcaacatcatcgcatcgatcctaattctgtgattgcgtgcgttgtggctgctacgagaatgagacgagattgtcgatcccaattccatgccgcggtgaccagcgaggcgacgatacaacttgcgactctgagtggcagcgcgatggccgtagattctagtctccgagcagctctgcagtgtgcagctgcctcctgggctcctggctcctgccttccttacctcttcgctcttttagtatgattatcataatatattttaaaatagtgtacattatagcacatattgcatctacataattgagcgaaaatatgttttgtttatattagacatgctttttttaaaaaaattatagggcctcaatttgtatttcaacctggtgccccaaagtactggagacggccctggcctcaataggtgaagggagtctatagttgaagtaggaatgagggttccattccatcagctgctcagagcactgtagggaccacgatagtcaaagaacggaccgagaaagagacttgagtactaccaccattgaccagaagagactaagcctgtgttctttagcgttggttggaaactaatcctccacgcaccgaaaataaagcggtaaattagcatgtgattaattaagtattagcttaaaaaaacttaataaataggattacctaaaccccaatatgattttttaaaaaacaattttcgtacattctttttttattaaaaaaacactgtttagcaatttaggaagcatgcacatgagaaataaggttgtgttcttaactcaaggttcctaacctccactccctcgtttcccacgcgcactcctccgaactattaaaggtgtgtgtttttgaaaaaaaaatctacagaaaaattgctttaaaaatcatattaatttatttttcaattttttaagctaatacctagtaattaataatgttaatccatcgttttgttttgcatgaagagtggaggggtttccaaccccaccaaatgaacacagcttaagagtggagaggtgaaaagagaaagaagaggatggagagtgataagtgggtcccattgtattttctatttttctttccaaatgtaataccattgaagagccacatcagatgaaaactaggttaacttgccacgtaggataaatctatatatcatccaaaccgtttgaagagaaaaaaagagtgttttttttatagttgggggataaaataagacttaggtactagctcagctcatttaaactcgttatcttagagagccagcttgtctcgactcgtaatcttattgagtttaaaaggtcaaggtcgattttgcttacgaccgagctcgctctatctcgtctatatcacctttataattttaagtttgatattttattgatatatattaacataataataacatgtactaaactcgctagtttggatatagttaaaagaataagcattagtatcagttaagaagtagtagagctgaagccacgaggttatctccggccgctatccacgaggcatcatcgccgggggaggtggagctccggccagctagcggtgcggggagtcaaagtgtcaccgccgatgccgatcgagatcaccaccaattaattaagctcgctgtcgctgctaccgaccgaccgtgactgagaacaatgcaaggccgcctcgctctagctagctgtgtttagttcatactaacattaaaagtttggttaaaattaaaacgatgtgacggaaaagttaaaagtttacgtatgtagaaaagttttgatgtgatgaaaaagttaaaagtttgaagaaatattttgtaactaaacacggctgctcatgctcggcacctgtgctggagtggagctgctcaccgtttctattcacagcccaaaaggtcaatttcatccgttcacattgagaaaagaacaaaattaagcaagtcaattagaaactgaccaagtgccatttaggcaccatttgatgatgagccaaccccatttacggaatcacattttggccattttagcatgacaccatcacatatatttctcctaaattacaaaccaaaacaatcatctaacaactatattactctattcttcttcttatcattgtttattttggaactgtaaaatataggagcaaatctatattacctcatgagtttgtttaaaatggagtacttccccgttttaaaatataaagtgtattttgttatattggaataaggttttgatcaacaattgatctattaagatcaagtttattaggcggtatggcgagctaaggcgctgcacacccgcctcaacactattgcggtatggcggtaagacggacggtcaaacgttaggcacggatatccacggctgcacttattttgggatggatgtagtaaaaaatgctatcacaatcaaatggatccgaccactcatgacattatttttcactattcgatcaacctgacaagtaaaagggctattctagtctaaacaggtgtgattcttccaatcaaatgataacaatacaagtggacccaaaagctacttaacaaataggagtagggctgcaggaatt

SEQ ID NO: 67915 - DNA, 26832 bp, Oryza sativa
gtggttttgtgaaactacaacaccaaaatatatgtacttaaacgccaagtgtcaaagtgtgggtggttttctgcaacttggactataaaatgtgtaattttgtgaaatttactctaatttctaagcccgtttggtacggctacaactccctaatttaactctagaagttagatctcaagtaaagttagggagctgcttaagcccagtttccaactctctaattttagtcctcagatcgatatcgatcttctctcgcttatctggtgacattagctgctttgctctccagtaaaaaatagccacaaggcattctctccattaattagcatagcagccagtgctctccctccatttacagtttttaaatttcttctacaagaatacgggctcaaacacgcgtaaacatcaccagcagatcacaaactcaagtctccaggcggcagatgcagcactgaagcagcaacatcaacacctgctcaaattatggcagcagggaagggccattgaccacacgcacaaaccagacaagattgatgatatccccttcctagatttcactgttagttagattccaaaaaaaaaaaaaacccaacctagaatgggatgggacatgttctaggacaacgtatttggactgtctagatacgttgtactagaatatgtccaatcacatcctagattaggttttttttttttggacggagagagtagatcatgcttcacaaaaatccaaggtgggccatccaacactccatccaacctaccctagccccaatccccaattgtgaatcacaatcattactgtcatcatgccagtatcaacatcttctggaaaatttatataacgcagcagctaccggaactgaagtaccctgcctagacatccttcaccaaatgcaaagctacggctgccccaccttgtagcctacggtacatccggagcataacctcatccccatttatcctcgtttcatttgaaagctcaacgtacgcttcattgatcctactgaaaacaactcgaagcgggatgcatgcaatgcccagagatttaacctattactgacttcttgtttccggcacctctgtgatttatgtcgaaagatgaaaggctccgcatctttcttgaggaaggcacatgatttttttgtgtgcggtcgccatgatttctctgtttcgagttcggacatcttcctgtggcttttgggctctgttccacctgtgtgtgattccagacatcccaggcttgaagcttaatccttcttcactggtccatcaacagtgcttgtggcagggcggtgatcacttacacctgatgtaggaagaaaacatacaccatccgagactggataacccacaacgggtcttcggttccatatactcattagggaaacaagaggaccagttggcttgtttaatgaactcttgcccaccttttcttccaaaaggataaccttattgattgatatccaaccctgtctttgtgatatctaggctccaatgcatttcgttccatgttgttggccccatgatcagcggagctcatgatttgcttagtaaaatttccgcgttcgcatcgggaagatatgctagctttgctgcagttggtaggtcgccttttgcgtttgcagataggatcctttttttttaaaaaaaaaaaaactaaaatcgacaagagaattgtcgggttggcactgccataaccaaattattttttgaaaaaacactatgatgtagtatgcaatcaaaggacataaaaacagaatcctctcagaaaatagaatataacaatgatcacggtttgtcttgatcttgtaatcgtcaagaaatcgaatcaggggaagagaaaaggactagatgaagagaaacagtgtgtggggggggggggagaagaacaactaaatagattaggtcatggaattgattgttctgaatttgatagatcttcatgaattatggatcacatttggatagtattttgaaaaatctgatcaaaatctgccaaaattcttccataagaattgggtgttttctttaaaaaaatatatatggtgaagtgatcactagaataggcacacccagtataatttttctgggtccgccactgccgagagaaagaaaagattacggcggtttgaaagcaaactctctatcgttgatgtcctctaggatgacagctacattgtgggcaatatttgggagttctcctttaaagacttttgcatttctcatgaaccaaatatgccaccatgtcgttattaaagctccaatatttattcttgcttgcaccctatttccagaggaggaaatatttagaatctagtcttatatgttatcctacatatgatggtttgggattccttttatcgttgagattgattgccagatctgatttgtgagatcacatcctctgaatagatgatcagagtcttcaaaagcgcccctgcaaagtggacaaatccaatcacaaggccaatgcctaattagtaaattctctactgttaaggtcttctggtgaaggattagtcagcccaggaatctttgcttagattgagcttctgctgtccatatcatcttgaaggctgggtttgtctctgatccaatgaattgggcttggtaagaactctttgctttgtagatacctgcagcatttcttgtccacacaatattatcttccccagtttcaatgagagtgatttgtgtgagtaaacttccaagttgtactagctcatgaagagtttcaacatctgttatctgtctaaaggatgacagccaggtgttgtcgttaagctctgttttgactcttctatttttcctgattgccatgttgaataggttgggtgaaatatcttggagcatagaccatggagccagttatctttccaaaacatagttttctgtccatttccaagagtgatctttgtgcaagcttgaaaaagttgatgatctgaatcattacatgggagatacatcagttcccatggtttcgaagagtctttccatttcagccagagccacctttattaccaaggcagaaggttcacactctttcaaatgatctgggggaaattcaggtgataagcaggagtcaatcaaaaatataggaagataagctctttttccttgccgaagcgttaccgtgatatatatattcattttttgctgctcgtcatatcgctgctatgcatatggttagttgcgtgttcttcagttaggttcctctgctgtttggtgttgataaatgtacggttatatatacttgaatgatcccgataataactcgttcttgctggtgatggtaaatatatatacataaaatctgtttgtgtatcagtatcagcagccaaagcaaacattgatgaatcatttgaacaaaagccatattatttttcctcgcctatattatgtaacttgttcttacagccataggagcgtactatgcgtaagaaacagcaataagcttctgttccgtcctctattagctactccatatagcagtaagtaagttgtaagtagtactccagttactagtactataaatttaacaagggcgatggatggatggtgtgttacagtagtataattgagatggaagaggtaggatggatggtcaggcgaagagcttctcggcgaagatgtcaagaagggatagggcctcggcgacggtgagctcgaggcggaacttggggccgtcgtagtggtgcagcacgggcctgaaggcgtcctcctccagcggctcacagatcttgcgcgtggccacccgaacctgcgctgggaacctggactcgccgccggggcacttgctgtcctcccaagcgccgggatcgatgttggatccgccgaagctggtggcctcgaagatgccgtgaagctggtgggtggagtagttgtagaggaagagcgggaggccgggcctgatggccctcaccgagtccctgtacctggatggcaggccgaacagctgcctcttgagattctcctccatcgtctcgttgttgcacacgaatatgtatcccccgatcgcctcctcctttggcaccgactccgacgccggcagctggctcttcttcaacctgctgctcatcttgttgtcgttgctgctgctgttcttcttgttgttgttcctgcctcctcctcctcctccagcaggagcgtcgacagcggccttcttcttcccgttgaacgcatctacgacgacgctgttgctgttgtagttgaagttgaagttgttgttggccggcctgccgacggacttgttgaagtaggtcttggcggtggcgttgttgttgctgttgttggcgagggcgagcttgttgctgctatgatcgacggcggcaggcgagggggaggaccagatggagtcggcgatggagaggctggagaagttgtggaggcggagctggtcgctgaactgccagaactcacgctcgtcgtacccctccatcttctgaattaacagaaagatcgggtctgctgccaccgccgatgggagatgatcgattgatcggaggaggaagaagcagcaacaccaatttactcaattaacagaaagagagaggaaattaaggtggagaggagggagttaatttggcggtgcacgcgggtggatggcacttcctagatatgcttgggttggatggggagatggaatcaaagtgaacacttgctttgcagctaagcaactaggcggacgactgaggactaattatatgaatcggacgcgtagaaacaaagaaataaatggacgaaaagaaattatggttggacgtgcaatcagtcaataatctgatttttaaatttcattgcatccatagacacgatgacacgtacacatagagtggtgaagcaaagtctgcctttttgaacgcgtcaacggcccggacttcttcttctagatggacctgctactatacattcatccatccaccacctgaccgcctaaaatttccttttaccaaacaccgtagagacatcttcaaagatgttactttgcccaataatatctactccctatgtccggatttctagtttttcttacaacgtttgaccattcgtcttatttaatttttttttgcaaatataaaaaacaaaaagttgtgcttaaaatactgtagataataaagtaagttacaaataaaatacttaataattttaaatttttttaataagatgagtggtcaaacgttgcaagcaaaaactcaaaatcctttatattatagcatggagggagtataaaactaagatgttttaaataaaaaaagttgcatattatgatagtatgtttaatgataaatctagtaacttcaattttacacgattgattctttttttttctattagtggttaaaattaaaaatgtttgacttgttactgtactaaaagtgcttatattttgggacagaggaaatacatttttttcacctgttttacgtataggaatatacatgtttcgaaagtacacaagtggggatggaaacttgcaccgaatctgcacagtgagtgtgcgaactaatgatatcgcgcaggccaatagcagagtcggacccgcctcgagttcgtgcagaacggcaccaagtcgcggcttcgcgcaaagaaaatgtgactcgtttcattagctagttaggaattaggattccacaggaagtcgtcgcgacttcttgatgttccggtgagtatactcgaggatggggtccgagttcgcgcacccactatgcgagctcgttgtgagttcgtgtataattctaccaattctttcgaaacatgtataaacctcgaaaactggttaaaatagtttttttaaagtcatctttaactttatcccaaaagactatatttttacttgccacgaattaagaaaatttatctctttaaaattcaaaatatacctcttacatgccgcttcagaatactacttaaggataccttttgatcgaaatgaaggatatttaatttgatttttatcctcatcactattttattaactttgttaaagaaaatgcgaaaataatacaatctttgtgcggcgagagagatcgagtaaatattgtactatgcagattactagtttttgtttataatatgtatgctatgaataactacagtatcagcatgatatgaaagtatttttaagtatacgactctaatgtatggcatgcatgacactaagtatatatattagtactagtttcgaggcgcctacaaatcggacgtccgatttttttagcaaaaatcggctgctgttttaccacatagattagaattgtttcactaaatatatcgaaaatgtttcaatattaaaaaaactgaaacacaaccaaatcatgaataaaacattttgctacaacgtatgaaaacaatgattttcaaaaaatcaggcgttgtttcaccctatataaaaacaatgctttagcaaatagcaaaagaatgtttcaattcactgcactatttgattcatatataatgaaacatcatgagtacacttattgaaatattgttggtggaaaaaaaagaaacatattcccttaatagaacattttcgtaatatacggatgatttgttgcaacggcgcatgtggtgggatagcgcggaggcgcgggagacgacgggcgcctgatttttctactgctgatggggcgctcgatcgtggtcattttcctactagtttaattacatgtgtgcgaagagatgaacaaatatatactggattggagtttctagtagtaggctactagctaatactacctccgttttttaacagatgacgccgttgattttttctgacatgtttgaccattcgtcttatttaaaaattttatgcaaatgtataagatataaatcacacttaaagtactatgagtgataaaagaactcataacaaaataaattataattacgtaaattttttgaataagacgaatggtcaaatatgtgagaaaaagtcaatggcgttatctattaaaaaatagagggagtatatataagatggtggtaacatacatacatacatagaagaaattaaagtggtgtgcatgcttttggttaattagtggcgtaatgagtggtgtgcgtacgtcgagcaagcgcgatgatggcgactcatcacctatctttgaatcttgctgaccgtgacgccgtaccgcgtttaacatttcctccctcaatttaattttcttcggtcagtatcaaagttatgtcatactatatatctttattttaaaatgtaataatcttaagatggatgtatattctagtagttcgataaacctaaacaaactcctttgaaaaagataaatataaacaaaccattccaaaacgacctaaactaaagcaacccattaaaacccaattgtgattccctatttgaatgaccaaaccagccaattgcagggacggatggttgggtcgtggtatcatcctctatcgtccgtcagtctaaacaaactggatccatgcatcgatctccgcccagtccggcttcgatcggctgcctcctcaagcaagcagatcgtctcgtctccgccgcctgtgctagctacggtactcgatcctcttctcttgtgcaagcagtagtacagtagtgtacaggagtactccgtagctagcacgtactgtacggactccatatatatgttaggcgcatgtacgtacgtttctgcttctgcggtctgcctgttagtaatttgctacacaatcacatccagatggtgaacaccgtccgtccctcctacacacacacacacacgcacacgtatatatatgatcagtcggccggcgatcgaccacactatcaaatgccaaattactactctactctactgtctagtagtgcttcctacatactgtagtagaaagtacataacataacatatacctgcagaacgccgtcttataacgaaaaagcacacgctgatgacagcgtagcacaggacaagaatcaatcccttcagataatgtgattctccctcctgaaacatatatatacttctaataaaataccgacaatcttaagagttttactgtactactgtatttcactttgattctgaacaagatcgaaccaataatttcagcttttactagctagtacttacctggagggtgaaggctgtcactaatattgctagaaacagagagccagtctccagcaggttgaaatcaagatccattgggattcccatagtccaggctacaatcacactcactggaacctgccgcacagttcatcacttccatcacaacaacatactaacacgcatgtctacatacatactccactaataactattccctccattccaaaatataagacacaaccacccttaacccaaagaccaagaaatagttattatcaccttgtagtttggatcatcctaataaatgtaatgcatgtatccaatagagttagagaatgtgagagtgaaggattttaaaaaaaatagtaatttaatggagaattgtcatagttaatggcatgcatgtgtatgtatgtcttacattatggaacatgtaaaaaaaagtggttgtgtcttatattatggaatggagagagtatcaatgtatagagcgaggttagtaaattactagtactacgtactagctactcctacataccacaaacatggagatctgtgtggcagagcccaaagacactccgagagtaatatcctgtcgtcacaagtcacaacaaattaatgataagaaagaccaatactctgctgcatatatatatatatatactgtatgtgtgtgctgcttaattatatggagtaccatcttgttcttgagagcaaatatgacggcaccggcatgctctgctgcgttcccaacgatgggaagcaagatgatgctaatgaagctcactgatagttcccatgattctgaggccgcctgtacattcacaagatacgtacaaaaggtggtttagctagcttcattatgcatgcatcttgccaattcactgaagattaatacagtacagtacagcagcatatatgtaaatggtactaggatgatatatatatatactgtacctcaattgtgctcacaacataccctgacaagagcgcagtcaggagagtcatgagagccagccaaatcatggcactcgagaatcccagtactggctcatcatcttgagcgatcactaaatcatcgtcgtcatcatcctcaacctaattagaaaaatataataattaccatttggtgttggtgggatcgaacgtagtacaggacatgcatcgatcaatcacagacgggacgtacctgttggggctcaaacagctggcgatgcgtgttgagttggaagaagaggtaggccaggtaggcgatgagcatgaggatgctgcaggcacgcgacaggtggagggcggcgtcgccggagacgatggcgtggtcgccggaggtgacggcgtacctgagcatgagcggcagggagtggcagaggacggcgagcatgaggagggcggtgttgacgtgagcttgcttggtgtcgtacggctggtgggcgcggaggttggcgatgccggcgaggaagagggaggtgccgaggacaagcagcaggttggagaggatggatcccagcagggagcatttcaccacctcaatctttccttctcgcagcgccaacagcgcgattatcacctccgtcacgttcccaaatgtcgcgttcagtagtcctcccactgcaaccatgcatgcacttcacttgatgcatttccacttgatcctgatcgaaacgaatagctagcatgcatggaattcacttaccagtaggaccggtgtaaaatgcaatctgcctgcatgcatacacgcaaccaattaattgtcacaaaattcaagatcactattataattactctcccccatttatacttataagtcactttgacttttctaaaagttcgatcaagtttataaaaaaatatattaatatttacagcattaaattaattttattaaaactaacattcaatatattttatattttttcttgttttatgttaaaaatattattataaagttaattaaaactaaagaagattaatttagaaaaaaatcagaacgacttatgatcagaagagtatatggttgcatgcatgcatgatgtacattatctgagcatggtaggaattagttaagggagcttactcggtgaggaagctgagtcgctcagcaagaggaacgaggccgattaagctaagcacaaacacccacacctgcaattaatactgtaagaaagctggttgatcatttagttttttttttgaatggttgattatttagtttgtacttaggttgtgtttagatctagaggtgaaaagttttggcgtatcggatatacgaacacatatttgaagtattaaacgtagactaataacaaaacaacaaatgacagattccgcatgtaaactgtgagataaatttattagcctaattaatctatcattagtaaatgtttactgtagcatcacattgtcaaatcatgaaataattaggcttaaaagatttgtctcgtaatttacacacaatctgtgtaattagttattttttttatattaatacttcatgtatatgtccaaacatttgatgtgacagggtgaaaaatttcacagggatctaaacaggcctttagcttagggatgttacagtagtttttggttagtacagtactagtggagtgtatctaggacgcaccgttgccatatggctgagatgcgacgacgaaaaatccgtgaccgtgaggagggggattaatattagcctggccatgcatgtgatgggtgtgtcaagtgtcaacttgcttaattgttgcaattccatgattccatctgtttgtattttaatagggtttcacaggctgcaggcaacttcaccacatgcgcgagcacatgcactcagctagtacaaattaatctaatcgccatcatccggctcgatcttgtattcgtcatgtgttgttggtggagtgttttttttttttggaaaattataaaaaaaaacctgttatgctaagtttaaaataccctcctaatttactttggtttgacgtaatttagtgcatctcttgatgaacatggccccaaacatatttctcagcgacacagtacgcactactcacatctttcttatctcgaatctaacgaacaaaccaaacatcgttgaaacccatgagacaaatgcagtttatcttgcggtaacataaatgttcaagagctaagactcacgaccttcactgcctaacgatacgatgggcgccatgggtagggattatagggcttggccaacaattggagtttttttgtgtttagccccgtagtttttttaagctttagctttttattttgttttttctctcttactctagtataagccggtctggctgattgtgttgtgtaattatacttttttcttctaatatattgacgtgtaattcttttgcgcatccgtaaaaaaaaaaaagggctgggattatcgaccacagttccttgcctagtactagtattgatatgagcatgcttgtggcttgtcataagaatggacgagcaacgtaaattggagagagatggatgaggagggtacctgtccgaagtggaggtaagtggcggcgatggcgaggaggacggcggggaagaggaggaagagcctggtggtgaggaggacgtcgttgagattggcgaggagggagcggagggcggcgcagggaaccttgtggaggagggaggcgtcggagcttttgcggagggaggaagatgagaggttgtgtgcggtgcggcggcgaggagaccccggaaggaggtggtgccgcacggccatctccttggccatcgtattcgactccatcatcatccgcgacactggcatcaagctctagttgttcctcgctcgctgagtcgctgtgcgtggttggttggatgagagagagagagagacgatctatcgatttcatacaaatgcggccgccgtcgtggtgctaggattttgctgtatgtatgtagtgaatgactaattgaggaggaatagtatattaatggagcagctcagctcatcggggtggatgcaaatgtcaaatgctccatgaccagagtactccagcatgcagtagtagaatatggagtacagatattaataatgaggaggcacaagcacaacacaagaagaagcagagagagagagagagtggactgatggtctggtcgaatcccgggttctctaaacttaaacgtacaaaatatcacgcgaataattagtatgcattcttggtagtactcctcctgttaattatgcagttactagtaactaggcaaatgcaaaacctccgtccaaaaggtacctaccatagacaacggagctgcaacagagcagaaagaaaccaatccaatccaaatccagtgaggactgaagaggaggtgagagactgacaaaaatggaggaagctccggtggtctattccgctccttccaggggcgtcgccgtcgatcgctgcttctcttgtcttctattgtgctcccctccctaatccaatccgtacccacccaagggatgacaatcccaatcatattaaacccttttcttcttttggattttttgtctccggtgcaacgcagccaaggcccacacgcttacaaataaagtccatacaaatcacggcccaacccaccacaccaacctatccttttaggcccatttgatggataatagtttggaggaaaacgttcacattatgtcctccaatttatgggttgagtttcatttgcatccctcaaccgtaaaatcaggtatatagcgcccttcaattatcaaaactagatcaaattgggtcccctctcagtggggcatgcatgtcagtggggcccatctctcttccttccttctctctctctctcaccatcctctcctgctgtagggcggtgatgacatgtgcacacatgatggaggcttgcaacatcgggtagaccagcagaggcccactgggcaggggagctcgatgtcagctgctgctctgctcgtccttccattgaggctcggcttcttcccaatcaacatcaacgtgcagaggggatccccattcccccgtcgaaagcagagcgcctcccaccttgatggaagaggcagtcaacggcaacgaccttgcatggctgttccaggaggccgtcctcaacctcaagcgcaacgccaatgaggtcctagctaggcttctccttgccattcatcatcgacacctctgcgcccatcgctattctgcagcgctcgccgtctttggccacatagggaattgtcgtcaaggcgatagtggcggcttggtgtcctcttcatcctcaagggcttgatggtggtcatgggacaacaagcaaacccctttccttggacacgacagcgacagtagtgctggctacaccaggtacttcgaggcctgctaccccgtcatcagtagcaaagccggtgaaggaagggacctgttgagcgtgcatatgttgtgaccacggcgatgattggaggagatattgaactatatgccacttttagatgtggcaattaactgtttgccactagactcacatgtcatagacacatgtggacccacatgtcattgagatatgtgtggcaaatagttaattgccaaatcgaaaagtggtaaatagttaaatgccccttattggagatagagaaaaatggaatcgtaaggggaaagagtgaaaggtcccacatatattttttgtttctattttttcaactataattccacatgaaccccagagcatattagagaccatgacacattatgaaaccaccaaccaaaccgtgagggatgtaaatttaccccgctttaatagttgggggtatccttcatatctagttttaccgttctagtacatgaatcaaactggggctatcgttgagggatttaaagtgaactttttcctagtgtggaccagcgttattgggctggggtacagttaaaaaatgaattgctcctactatagttgaactaacatttttcactctgcattatactccatatgttttgcatatattttgcattatactcccctgtttcttgtctgaggctgagcagattcgagcagggaggccatgcatagggcagaatagatgaaggtgaagttgtgcactctggttgctctgtagtggacagggaagaagagggacatcaccagcttcatcgctggattgatcgtcttgcatacattgaatgattgattgctatactagtacatatacatacacgaagaacatagtatatattgtagctgctgccgtacccatctgctacctgttggagaagatggcctcaagatccttgtagagtcccttggacttggagctccactgcgaatgcgagttctcgggtcccttcgccttggagtccgacgacgacgccaccgacgacatgctccggctcccaccctttgctctgctccccgacgcctccgcctcccctccctgtccctccttgctgaagctcgccttggccatctccctcagctgccccagccacgacctctccgtgccaccaccaccaccacccagtgccactgcctccggctgctcctgctgcttcttcatcttctccagctgctctccaagcgccgacgacggcagcaccagcagcagcagccccacccacgccgccttcgcgccctccacgaacgacctcctgtccgagctcagcagccgcacctgccggtacagcgcgttccactcgttgcacacctgcgccgccaacgccaccgcgaacaccgtcagcatggccagccctaccccgctcccctccgccacggcgctgcccccgctgtccaccagccgaaggcatgcggcgaacaccaacacctcgcttgccaccgccacgatctccaccagctgcacccgcttcttgatgaagggcttcttgagcaccatgaagaagagctggaaggaggcgatggcgagcaccaccacggcgtgcgcccgcgacgagtggtccgacgacgcgtgcgcgcccgccacgatccccagcgccacccgcttcaccgactccaggaacgtgtagtagatccgcagtatgccgaacagcttctgcaggaacggcgcctcggcgtcctcgttctcgtcgtcggacacgatgatccgctccgccgcgcgcttgccgccgctgccgccggcgatctgcgagagcatgtacttgggcgggccgcgcaggtcctcgaagagcgggccgagcttgacgaggcaggcggtgcgggcggggtccttccacgtccactgtccacgcttgccgggtcccagcgtccggcgaacaatctcctggtaccagtggtactcccgcccctcctggtgcacctccttgtactgcagcagcctccccgtggtgacgcccagcgacaggaacagcagcagcgctaccaggaacgccgttagcacccccgtcagcacgatcccgacggccagccccgccgttgtgccgcctcggatcagcgccgccgacgcctgggacacgcagggcatggcgaggatgacgagcatcagctccagcctggggaacacgagcgcaccgacgtgtgtgtggctgtgcctgtggcgcagcttgaggtagaggaggagggtggcgtgcagcagcaggaaggcggcagcgatgacggccagccagaagatgttcctgaagaagtacttccatccgtccagatcctgcagcttcatgatgatctgcgcctcgggcttcatgtcctggttctcgaacagataccggtactccatggcggtgagaggcttgccgtccaatggcgacgtcgacggcatggccattgcaactcctggagctgcaggagggcggcggaggacgtcggcggcgagagcggtgcggtcgagcatctcggagtaggcgatggcgggcatggtggagtagccgacgaaaggatcggcagaggggccttcccatgggaggcgcatgtaagggatgctccactccagccccttgctcagctcgtagtactccaccggcagatttatcgacagccatcgcgacagcgcgaatacctgaatgtggcacgccattctctgaaaccaacatcgccatcgattactgctctacctgctagttactccatatgattctatggaattcgattgtagtgtaccaaccaagagatttcgtgatggctcggatacgaggtaagaaggcggcctctggatgacacctgatgccagtagcgacgatgttgaaacagtcagcagcgtggcgaatgctgcggttgctgtaaaaattaccgtcgtcacgatcgcgatcgatgatgatgatgcaggaacagaatctgcactcaacacagtaaaaatgcacacaattagttcgtgcgtgcatctgtctgctattgctacctaataattcaggttttgacgagcatgcatatatggactctgcttatgctagctgacaattactactacattacgtatccagactcatgttactaagatttactccctccgtcacaaaaaaagacaaaccctggtttccgtgcccaatgtttaaccatccgtcttattcaaaaaaattatgaaaaaaattaaaaagacaagtcacgcacaaagtattaatcatgttttatcatctaacaataataaaaatacgaattataaaaaaaattcatataagacggacagtcaaagttggacacgtaaacctagggtttgcctttttttgggacaaagggagtatgtattttggaacgaagagagcaagtagtaatgatgcccttacaatgcctcacttccagacgatctgacggtaagttggtatttcctgcaacgtcctgagcagagttctcggcgacgtggaccgaaaccagattatcaaccgcctgtatctgcgctgtgtatatgctcttactagcttcatggaagctgaaaaccacgacgaattcgtttaattattaggaagctgcatgcatgcatatggatggatggatagatgggtttgttcttgcctgaggagattgcccccggaaacctgcaccgcagaggaagtgaagttgaagacaggctttgcaaactttatcaaaaccgggatgttgcgtgaacttgttctgacagtggatgtcgccagcttaacagaaggcctttgattatctgaacaaacattctcttgtacacgtgttatcgtattgaaaactgaaagtaacgtatggattgagtggaagtggagcagagtagtactgtatatatgattggcttactaaccgtaaagaaaagtgtatggctctgaagaagaaacaggagttccttgtctgctgattatggaattcccgtcacaggaaacagtgacaacggcggtgttggatgtcctcttaacctggaaatggtatggaatgaaggttgttaacccagcaagcaattaagcagtgggattagctaggacatgacagtgagagtggattagagtaacgtacgaggtatccaaagcggcgattcccgagcgtgcttcggttggttggcgtgagaatggcatcggtggcggtgagagcggcgaggatttgggaggaagaattcatgacgggttcagcgaaggagaggtataccctgaggtccttgtcgtcgttggtggcttccaccaccctggtggcgccctcgatctgaagcagcttctcagggatgctgctgccgatgttcatcgagtcgctccgtctgtctgcagtacatccaatctcgatcgatcatgaataatactagtactagcaagcaagcaaagcaaatgaaagtgtatctagtgtaggtatacgtaccgaagcgcagggtgaaggtagagttggcggttctgatgaagtggtggccggcagcatcggtgcagaagcccttggccatgacgagaatgaggcggccatagagcaactccggcgggatggtgacgtggacggagtattgcagggcagggcggaggacctgaagactcgacggatccacgcgcccgggaccgtacacgctcagctgcaaatgcaaaattccaattaataccgtattacattccattccattcagtaacaaaatgatactactccatgtggtagtgtactagtggctcgtagtacatggcagtaggtggcgttgcaggtgaatccgcctccgccggggcagggctcggagaaggagacgagcaccgacacgttggatccgctcgtgaaccccgcctccgccttcacggacgccgtcggagcaaccgtgtctgcatccaaaccattttcatttctactactataaggttcccgcctgttaaccacattactggagttgtacgtacgagtactgtactagtaacggcaacaatcaaatcaaatactagtacaagtaaaaaggatgggaattaattaaaatgctactactgtactgtctagcaatagtaatagggtgttgttactgaaccaaccaacatcccaggcgtaggtggcgcaggttgttgttgttgttgttgttggtggtcgtcccgcacccgcgcacacagccaaggtgtggttgccgtctttcagccgcgagtacctcaccaccgctgtcccgttgctgctgctgctgtttcttccgcactcccacgccctctccccgtccacctgcattcacgcatgcacccaaataccaacttacattcgcatcttcttcaatactcctaccttttttctcacttaattaacctccttcctacaaaaaaaaaaaccttgatactactactacaatgctgtaccacaacttgttggcttgttgcaaatcaaatggtctaatccgccaagacatttccacctacctatatagtaatctgaccaacatctatgatctatccttgtcatggtagtactatactagtagtatcaccggagaaattgatgcatcgatgaatgcatctactatgaggctattattaactgactaattgctctttcaggggaccaggcacccaaatccacaaaaaggcacggcatatgctaactgaaaccacatttttacacttgattctctctatgcattccactggagtaggagtactccactaccactacctagggagataactcgaggcaacacatgacattagcaactgtaaaaaaaaaagagatttcatttcagacagaagctactcctaggtagcaccgcacgcacacatttggaaaataaaaatgatggatgtcgaaattaatgccgagacatggaatatatgcaatgcgagtgcgtgatgaagcagatgagctagaaaagcatggaatggaagcaggcaggtggaaagtgaggagtgaccttgcaggtgatgaggcaatcctggcacgggcctgatccattggtgtgcaggacctggaaggtgaagacggccgacgccgacctggagacgcggggaggggtcttggagaagctgacggagaccacgtcatcggcagcatcggaggagcacaggagcgccgccgccgccgccgcaaccgcaaacacgacgccgccccagctcttccacaccatcctacgcgcgcctactattatctactcctactccctagctactcagcagcagcagcttgctatgctactccagtactgttgcaagagaaaagctcaagaagttacacctggtgtgtgtcgacctactgagctactcctactgaattcattcatgcaggcacccagccaacagtgttatggactggagtactggacagggagggaagtgaatgcacgccacgctgctgcctctgcctttgggaaaggaaagctagagctccctcttgacaatggcagtattactgacttgagttcagtgtggtgaggtcgcagtgcagtaagtatggtggtagattggaacagacaaaaaatgaagggagggagggagggaataatggtgggggacagacaggaggggagagggggccaaatgcacactggcaggcatcgcatcgcccgccatgtgaaggacgagacggaccatggttgaaatgcatggttggctgcaatgcaagcagaggactgaagaagaggaaatggattggatgatgcacatgaggactagagcgcccaaactgtcttttgtgcatttctaccttttatcctattttccctaatcctttcaataatcaatcaatcctccttcctactcactagctcggatgtaatccatgtcattcgatcggcctagcttgcttccatccatagacaggaagaaaacaacaaccagcgcgagatgcacagattgctacagtacgcgacgatccaaatttgcgagcaatactgatcaactgtggcagcaaggacaaacatgcagctatcaccgatcgaggcactgaaatttcagtcatacggtggcgacatgacgatgttacgtaatcaaaattaaggatgggcctcgctcgcgaaccactgaatcaggatatgatgcctggggattagctcaccatgggtggctgctgtccgtcatttagaccatgcatcaacaacaacacctagtaactcttcactagttacatcgatcaaagatggagtactacatacatgtaagagtagttaatactagtttatttatctcagcgcgctcagttatcatcgaaaaataagggttttctgacagcaaggcatactgctagttgccaaaatgcaatcggtgacatgcaggtcccaaaatatgatggtaggagtatatattggaccagcaagccacaaaccctcttaaacttcttctttcaccctcaccctcaacaacaacatgcatggtcctcatcacagacagattcacggtgctgtgtgaaacatacgagtaactagtacataatctcaaataagcatatgattgtagcacaaaaataggggaatcctctctgaatcttggaggagactccagatctgtacgtgcacatgcagcagctgcctgccccccgcaataaccaccatgcacattgtaggtcagctaacttcatatatactccagtttctagtattcttctattgtgttgtgtcaccttttctacactggtctccaagattcatatcgtacttcgtacataccacagtgatttagtaaagaaattcttaccacaacttgtgttttttccaaaaaaaaaatgcaagtcggaagaacaagaacatgtccattctatttcgtggtgagcgttagtagtagtagacgacaaacaagctaggtgtggtaaggcctgattcatagtgcgcagcggttataaaagaaattgtcatgcatccatgggcagctctgaattaacgtcgtgtcgccagggagaagggggcactatttcagagggtcggtctgtaacatgtagtattgccaatataattcatctgagcatttacacatgtgtacaactgtattgactgcagatcgacgacgagggaatccagtcagagacgtcgttggacggatcaaaccttttctccattgtaaatcaggcagatcactgcagctgtagtactactagtgctggagtcatgtgattatcactgaagattactgcagtccatccggttgcctccgactgatgaatgaagaatcaatcagtagcaagagcatcccaggttagttgatttttcaaattatttatattttaaaagatttaaaaaataaacattccaaagttcttaaaaaaacatactccttctgcccaactgtagggcgaggcatataaatcccctacagtacggcaatctatataacgtggcacctggcgagagaggcgtgccatggcaatttttgcaagcagccccttctcagcaataaatcgcattcccctatagcgatttatcgccaggagggaatggtatggaaaattatcacagcgcaaagttgggtgatggatggagtgtgccatgtcaattttgcaggcggcctcctcctggcgataaatcgcccttccctaaagcggtttatgaccgggagggggtcgtctgtaaaatttggcaggcattgaggaatatatttatgtaaaactttaaaattgtaatttatttttttaatattttaaaaaataaataaaaaatcaggttagttcccggctaatatatgatgaagtcaaattggaccttttccacttgtatcatcattgttgggttctcgaagccaacccatcctgctctaaatagtactccgtagggctgggcctgtttagttcgtgaaaagaaaaattttgggtgtcacattggacgtttgaccggatgttggaaggggttttttggtatgaatgaaaaaactaatttcataactcgcctggaaaccgcgagacgaatcttttgagcctaattaagccgttactagcacatatgggttagtgtagcacttatggctaatcattggactaattaggctaaaagatccgtttcgcgatttacatgtaaattgtgcaattagttttttatctatatttaatgctccatacatatgtcaaaaattagatgtgatgtttttttaactaaacaaccccgtagtattaggaaaaagtacaccgaaggtctctcaacttgttatcgagttagaaaattgtctcccaaccgcaaaactagatatatgacatctctcaactcacaaaacctttgactttaggtccttcgatggttttgatctgatgtgacggttgagtcagcgtgggacccatatgtcaggatgccacgtcatccctttcccattcctcctatttctctcgcttctttgcgcagggccggcgggtggggaggatgccgtcatcgttgaagaagccgcacgcgtccggcgagtcgcgtggccccgacaacccccacagcgggtcaccagcctccgccgcgtgccgcctcagctgctgcagcatgtacttgtgtcgtagcactggaactcgcccacctcccgtcgctcccgacgggtatcggagctcgccgttcggtcccaaccccactgtcacatcctgcgagaggaagaagagatcctggaatgataatgcacacatgcgtccatggtagatggtcggccggcacaggactgcggcgacaacggtgaacggcggcgcgacggtgaaaacggatcggagggcaccggaaggaagagcatgacgcggggaactcaccgaggggcagctcgacgacgacggacggcaaagggagcttcaaacagcgacgaggtcgggtccaaggcgacggcggcgttcgacgctctttggcggcaacgaacgggtggacggtcttcaccttggtcctgcgaatccaacggaggcgacatctaatcttggcgtcgatgggaatgccggtgaggcttggccggaggcggagtagatcgatcgagttcacacttgacagtgacagcggtgttccggtggcttgtggcttcgaggagatggttgccggcggtcttcgtttggcgagatgcggctggagcagcagccggcggcgttatgtaaatcagtgattcagtaaatttaatttgggtatatatgtgcgccatgtccgtcccgctcctccgtctcgctcgccgtagcacttgtgatttccaccgccgtcctcccactcgtcggagcggaggtgcgtccgccgccggattgtcaaacgacccccacctgcaagaccgcgggtttgtcagcgaggtcaattgcatacatgcccatgcgtgcaagctaaaactcacaggatttattttcatggcgggttgctgccaccagaggtaggactaggagttgaagacgaggatacgtcggcgtgggcggcgtgcttgttgatggaggcggcgcggacgatccggtcagcgatgcggtggcgcagcgggtgataggagttggattccaccagcaccttgccgcgcgcgttaacaacaccttcatggcgcaccaccactccaacagaggagagggaaggaggaagggagagagttagaggaaaaaggaaaggtgctaacgtggacaccttgacatgtgggatccacgtgggtcctatgctgactaagccgtcacgtcggataaaattgggtcaaaaccacccaaggacctaaagtgaacagttttgtaagttgagggatgacaatatctatttttacgattggaggatgattttgtaactcgatgacaagttgagggaccttcggtgtactttctccgtagtattatgggcttatggccacatccccgcgtataggtcgagaaatctaggcgcatacatatacgaggcctgggatttgggccccctcaacctcaagggccgaatgtgatctcgctcgctcaacttcttttcggtcccccatccccatccccatgtaagataccatagagttttaatctttgaatgaattcttggcacagcaaacaaggaatgaaatgtctaaaatcatcggataagtggctgaattaggcttggttcgatagtagtacttctagctgtagctttgcgatggtataatgtataacgatatgagttactagggtacgagttgtaattaactattcactgttaataaactcaaaaggtaagtttactttttaaaaaaaacttacataaagtttccttttagaaaaaccacaccgtataacagtttaaaatttgctcacagtaaatgagctagttgaaaaagcaaaacgtggaaacataacccttagggctcctttgaatcaaaggatttatataagtatttcatacgattcaaatcatataggaaattttcctatttggccctttgattcaaaggattgaagctttccaaatcctatgaaatttttatggaatggcacattgcatgtggattttggagaaaatttagcaagagctccaacctcttggaaaatttcctttgagtctatctctctcatccgattcctgtgtttttcatgcgctccagtcaaacgacaattcctgtgtttttcttgtgttttgtaatcctctgttttacacttcaattcctgtcagaatcctgtgttttttctattcttttgttttttctaccctgcgattcaaagggacctttagagtgtgttttttgcatggctgtagaggaaaatttgtagcgcacgtgaaacgagaaaacccattaaattaaaaaataaatacatttgatttttttaaaaaaacaaaatttatataaaaatttattgtaaaatacgtatcatttaaccgtttaaaaaatatattaagaaattgaaatgtggagttaaaagaaaagagctgagcttagtcccactaggccactactacagtcaaaataattgaaaatttgcagctacactattagttttcaaaataattgaaaagtgagtagtttagtggtttcgtgcagtgtgcggagcattgttgtacgcaagcatgcatgtgtgcacgtgggcagccacgtggcaatataaaaaccaactcgtctacatctttgagatgcagacaagagtcaatgccgttctaagaaaaccatgagatatcgtacgagtagaaaatagaattgagtaaattacataaattttctaaatattgactaagaaacagcacactaggagtaggggatatgcttcccagcggtctaaacatgtataaactgttcgttccttacttttttatgtgcccgtgatttagatcccgcgtacctcctaagaggccaaatctaaaaaagcggtttgttctgctccccgctgaaagagctcgggctccgatagatatataatcgtagttactttcttcgggttaatagtatttatcatcttgatcaaagctgatgttaaactttaaaatatttgattatatcatagaaatatgaacgatatgtatagagtagtattagaaaatactacaacaaaattgttgatatttctagttacattataataaaaaataatagttaatgctatttatttgaaacgataaatactgtcaaacctgaagggaatatggtactagtgctacacaaaagcacacagttttgataaattctacttataaatcagacctgacattttagatggtaattttatataatctgacagaaactctaaagtggataaaagaacttgtggatcttacatgtttgttttgggtttttatgattttagttttgtgaagcacggatactgtaatacctaggattatgtatcacgtgtaaagataaacttgtgattttatataacttgaacaacaacgctataagattagtgcaatttactgaataaaataaaatgcaggacaaaacatatagtagcacaagtagtggtagggggaggagcagcgtacgtgtggtttgcgacgtggtgtgcgtgggcggtgcggtgggcatgtatctgcatctgcatgatactagtgtccaccacatattacgggactattttcatctgctttttatttattcattgattgattggtactactactgctagaagaaaaggcggtttaggctgtgtttagttctttttttaattttttttaacatatacgaacatacatttaaaatattaaacgtagattaataacaaaataaattatagattccgtccataaactgcgagacgaatctattaaacataattaattcgttattagcaaatgtttactgtagcaccatattggcaaatcatgacgcaattaagtttaaaagatttgtctcataatttacatataaactgtgcaattgatttatttttatctacatttaatgctttatatatctaaatatttcgcaaccttagtttaggctggtggcagcaaggtgaccgttgcgcgtccccatccaaacccaaccccccgtaccataccatagatatccccaatctccccctctcttagctttctctctctcgagacttccttccttccttcccttggtggtggtggtggagactggagagtggaggcgaaaaaagaaacgaatagaatctctcgtccctcctcctcctcgatctc

SEQ ID NO: 67916 - DNA, 1537 bp, Oryza sativa
ggttggtttgttcatttgcgtcgcaggtgacgccgtcgcgcagcggcaccgttggtgtcgctgtcaccgcacagtgcaggtgcgagtgcacacaggctcgctcggcgcggcggggtggtgcggccgcatccgtccgtttcgcgtgggtgtcccatgtacagcagctgttcgcgcgcactgggccccgtccccgtcacgatgtggagtggagatgtgatcgtggcgtcgtcctgctgtccggtggcgtagaccgctgcaagtagcacatgtactcgctacgtgatcacgtggtgtggtgtatggtggtttccaaaagtgacaagatccaagaaacgggtggagatttatcgtccgcccaatgtgccgctcgagcctgcacgttgcacggatctctttgatcgatcagtttccagctgcaaattctgccgttcgcgaacataacaggtcaacagccagcagttctctcagctgattttcgctatttgtctacggtctactggatttctgggctgggctgaccgttgtcgatccatttcatcaacaggctgggccattgcaaagatttttggaataagttcagaaatcgtccctcaacttttcatcgagttgtatgacatccataatctttacccctaaactatataaaaccgtataatttaggtcttatagcagtatgtatatctggttttgctaacgtagcatcctagtcagcaaaataaaaattaaatttttatggggcccacatataagtgagtaaagtggagactgcatctcttctttcttttctttttctcctctcatctcttttcttttctttcttctctactcttcttcagcgagctaggaggcctgcgagcccagccgagctccgccgcctcgagctcgtggagggcgccgccaacgccgtcttcggtgcgctcgtgaagatcttggccgcgcggatgagcgacgccgtcgtgctccgtgagctcgcctccgccggcgaccgccacaccctagaggccatctagagagcccacaacatgtgtggcgcacttgttggcctcgtcacgagccctgtctcctcgcaagtcaccaaggcctccctgttcatgcacctcctatgtgccctagaagaacctgtccttctgccgttgctctggccctcccagtgccaccatggcgcccaaccaccaccacccccaccgcaacaataacagcaacaacagatcaaatcaagaccctcacagtcgctatctctcacctcataaatcctgcggacacaatcttgcacacgcaaaaaccgaagggatctcaccgacgacggatcgatgagctgtgcaaggcaagaaaaggcggcgttttcttggggggttttgggtgcctcctccgcccaacccgcctctgtcctctgtgtcaagctaccctcaccgccccgtcagtgaccgccgtggggaagtcattggtgaagaggagtcggtcagtcggggagcttgtccgtcacagactcatggaggcgtgcgctgacactccccaccatcgtcgatgacccctctgc

SEQ ID NO: 67917 - DNA, 2715 bp, Oryza sativa
ccacaggaggcccgaagtcacccgcgtctcggccctctccgtcctcgttgctttcgacgccggaggccgagagacaggcgacgcgcacgtctgtttgcgccgttgccgcagatcagcctgacgaggtaatcgtgcgcgtgcgcctgcgcctcgatcgatcgaccattcctgccctactcctcgatttgttcgcagtcgaattggattgcgatgtgctctcttcctcctcggttttcatcgatcgcttccttctttttgggcgcgttacttcttgaataaatccttttcattttctcaaactgtcaaacaccttgaacaatatttgccgttatctcgattcaccattcatacccttcttactttgtgatgatcatcacctaggtttattcgacttcaccaatagtctgtcacgtttattgtgttacaactgagaattaacaaattctttctgaccatttttccaattcattgcagataccagctctaccaacaactcccgttacttctctgtatgatgcctgttctgaactgagtcttcatagatagagagaaatgggttctctcacagatatcggcgtcgccgcaggaataaacatactgtccgcattgggttttcttctcgcatttgcggttctcaggatacagcctatcaacgacagggtctactttcccaaatggtacctcaaagggacaagaagcagcccaagaagcatgggaacggttttctcaaagtttgtcaatgctgatctctcgacgtatatccgcttcctgaattggatgcctgcagcgctgcaaatgcctgagcccgagttgattgagcacgcaggcctcgactccgcggtatatgtccgcatatatcttcttgggtgagcatgctgttcgtgtttcgcaattggtctttttttttgtctttaaagtttccgaaaaggttgaattcaactgataaatgtgactatatgatttggattggatgtcagaacatattcggtgtattatgcttactgcatagttctcttgctatgcaggttaaaaatatttgtgccgattgctgtgctggcattcattgtccttgttcctatcaactgggctagtggaactttggagaaggaaaagagtctaagttatgatcaaattgacaagctttcaatatctaaccttggaaaaggatcgaaaaggtataattctctgtgcttcatgtgtgtgtcctaatgcttgccgcaccaccatggatcgtgcctttgtttctttgaatgattacctgtgtagcgtataatgttaccgctagtctttacttctattccggtatatgcaacctcatatccttcgaacaagataatgacatagaaggtttcctttcctatctgtactttgaaaaaatggcggtcagacattttggaattttgtgaatatgtttgcagtttttcaatatcggtgcactattagatactttccattaatttagtacaaaaatatttatgcagtgataacctatgcttaacctaaaattgtaacaattaatggagactggtgtgactaataatccaaactggacctcttcgaaattgatgcatgttctaactttttcacataaatctgctctattaatacagaagtggcaaaccttctgccctttcttcaaaaagaaaaaaaagcttttcacataaatgaatgcaaaggctttgcctccaaataatttcccaattatcgatgattattctagcatttagtcatcatcacttttatcaaatcagtttttatgatgctctagcactagaatttgatcaggctcttgcggtatttttctaaccaacacaaatgcctactaattagttttttttcgttgtcaatttcactagtgagagtttagccgaatttatatcttgtgttcgatatcctgataggctgataatttctctaatgaatttatgttttttccctgtcaatagattttgggcacacatagtgatggcctatgtatttacgttttggacgtttttcgtgttgtatcgtgaatacaaggttgtaacaactatgagattgcgctttcttgctattcagaatcgtcgagctgatcagtttacggtgagagatctttcccgtaacactcagatcaacgaatttaaacttctttactagattatttcaactttgcaacttattatatagttatgcttctttttttttttgaatttacggcggtgaaaattttcttatttatctaggtcctggtgagaaatgtaccacctgacccagatgaaacagttagtgagcatgttgagcacttctttgctgtcaatcatcgtgatcattatctcagtcaccaggtaataaattttgctatcttcaatccgctgtggacttcagcattgctttttgtggaaaaactagataattaagttgtaaggaaatccaaataagaaacgactcattgtatttccttttgttctgttctcctgaattaccgacagttctttactcttagcacataacaaatagtccagctcaaatgtgtgctcctcatttggagtaatttcttttttatcatatgaccaacagaccgtatacaatgcaaacacccttgccggtttggttgagcagaagaaaggcttgcaaaactggctggtctactacgaaaaccagcatgctaaaaaccctgcaaaaaaaccaactatgaaggtacgggttgtctgttgcagatttattctcatggaccca

SEQ ID NO: 67918 - DNA, 8924 bp, Oryza sativa
  unsure (1)..(8924): unsure at all n locations
gatatacagtaggtttgttcatcttaaattagaatgaacccgttggaaaactaaccataggcgccttgcgagcttgcccgatcaacttatacaatcaaatgctaataatgggttagaatacaataaatgagctttcctgaatggtggtatcttcacaaccacttgagatccgtaatgacatgatctgcaacacagagagttatattgtcttggagattctaaattaagtgcttaccgtctgacctagtacatttgtaaatacgattactacttcctctgtttgatatatattcgtctttttttctttaaaaagtacagacgcagacgctcataatacacggacacttatccttatgagcataaacacatgtatcttaatcttaagattgataaaatcatcacagacgcctagctattgacggtatgtcaccaaccactgttggaataattaattgtaaatatgagcacccctgtcaagcctagtatttaacctgatgggtaggttccaccacaattaatctaaccagttgagagctatgtccacttcacactgaacgtgtagagatgtagcctagagggggggtgaataggctttcctgaaattttctcaacaattacagcggttaaattaacagggcccgaaacctcctggtgatgaacaccggaacttccgggcaggatgagtagcccgaaacttctggagttattgagccaggaacttccgggcagctgagataaattaaaactgagatgaaaaacatgtcctagcaagggaagtttaggcacacagaggaacaagatgaagatcgcagaatatcagcagattcatacaaagatcatacacaagagagacaaagacgatttttttcccgaagttcggattacacgaatcctactctccgttgaggtgctccaaagagccgggtctcgattaaccccttgcctcacttatgaaaagatcccagaagaggtccacagccttcaactcaacacttctaggtcattttctagaattgagtgaccaccaagatccaactcaaaatttcttctagaaaagaccacaagtgcaagttgctctacctaggacaacctctgaaaactcagcacaagaatctttactcacttaccttgtttccttgtggaggtgaggaaaaccttcccaaactttcccgggacatccacaagatctttggaagctcacgggcaacacctaaccgtctaggagaagatctccaaaagtaataagcccaagtgacagcccacaagatatccaaagtgctcaatcaaacctaatcttcaagccatctccaaaacactcctacactctcatctaatctcataatctcacaagatatgctctagatttgagtggaggaagcaaatgaagcttgggggtggctagaaaaccctagaacatgaatgaacagaagtggaatcgccaaaaggtgacctggggatgaaatccatatatataacggctaggtgacgccatctagctgttactcacaagtttgaactggaaacctgctaggaggttccggataaaagtgccaggaacttccgggcagcacttaggaaatttttgcaaataaacggtgcccggaagttccggccagaacctccgggtagccctctctgtcccggggagaaaaacatttttcaaaaatgattccaaaaatcttttgactcatggataagactaagagcactttgtataccctagaaccacacttgaaacccctcttaatagtacggtttttcctaaactcaatttcgaaagtgaaaaacctagtctaatcaccttcgatgatttttgcacttaggaacattcgaattggggggtctccttgcattcttagccatcacaactcgctttgggactaaactcctgtgaataaacttgataaacacgttagtcccctttaaccaccttgtcattaatcaccaaaacccactagggggtttaagtgcatctccacacacatgttcgcttttgaactactatatcattttgcctgccttgcctttttttttcttttccataaatataatgggagtatctataaaacattcaacattttttaatgaatgttttaattataactatattataattggggtataattacattgtatctataatatagttacaacttaacttatatatgcacaaatataattggataaaacaaatggtgtggacgattagcaagcaagcattcagccatcctgtaattcgactcttggcttcagcatgcgtgtgtaatttttcccatcctgtgcaaatctcgaggcgatcagaggatcagaaaattcaaaagttttgagcagaaaaaaccgtccaatgtttttttaagccattccgaattacaattagcagagacacattgtaagatgaattagttacagtcagcatataacaggcaattctatacataaatcagttctatacatatcacagtatcactatttttagcctcaataccattgccgatcgcacgctagcagcttagccgcacggcgcttcatcttgccaaataagcaaccatctcactcctcctaaccgtttttcccaatttcccactagctttactactccacaaatctgcgtgacagcgaccgtacgtgcacgttacacttccgtggcgcgactcggcccgcccccgccgccgccgctgcacaccctgcaccgcggccgctcggtccaaacctaagcacaactctgtcgagactcgagagggaacgggtgaatcgatctgaacgggtcgcatcgcatcccgcgatgtacgctggcgacgcgcaccatactccatcccactccgccgcccgcacggctgcttctccccctcccgtgcgcgaccgcgaccgcgagagcccaagaaaggaatagctagcgcgcgccaggtagtttgccgcgcggggtggaaatgcttggatttctccgtgcggtttccttttcccccccgaggggtgggacggatcgggaatagtattatcgtacgtcgccgcccacccaccacgcgtgcgtgcgtgcgtgagcctgcgtacatgctctccacgaacgcaggggatatcgcgagagacgtggaggagatcgagtagtaaggagaccgaatcgatgggagagatcggtaatcggaggaggaggacagaataattaaccggtgtgtgctagagattatggagtccgacacagattagcactccactgctaactaagaaaaagaaatgattgattattgagagtggatgaatgggcaggcagggatagattattatacaagtattttgttggccgaactagaggggaactaggtggtgtttggattaagcactaaactgtagtcactataacatcggatgtttaacgctaattcaaaatattaaatatagactaattacaaaactaattgataaatgagagctaattcgttagataaattttttaagcttaattaatctataattagcataggtttactctaacatcatatagactaatcatgaattaattaggtttaataaatccatctcgtaaattagtctagagttatgaaataggttttatcgttagtttacgtttaatatttttaattagtatataaatatccgacgtcatagttttagtccctagtggtcttagattcttggggtcggagtcggagggttagtgagtggaaatgacgccattagctggtcgaaaataatagtggaaaaacgccgcccgtgccggcgttgtcataggtttcgtgtatagcgcccgggggaattattttcttcttcttttcgttcaggaccgcttggttttgtttcttctgatgaggatcggagttcgtgtgcatcgctccttctggagagatgtcgtgagctatccggcctgtgtgtttccagagaacacatggttcaatgacaacatgacaacagcacggggtgaaatcgcggtgaagtcatggtcctgtacgccggtgggctgtatgtgtaaaacatggaaaagttctccagaaaaaatgaaaacgtcggtgacgtctacgcagacttaactctgcagggcagtacggtgctgctgctgctgctacggaagctgtggatctcctagttacgccagccaccgttgccatcatccacagtgctagtggtacattttgtactctctcctcgtagtagtagcatgcagcagcaatagccacgggtactgcacgcggcgtcacggacggtggatcgaatcgaccgagcggctggtggtggcgggggcacggaaactactgcagcgacgcagggggaagcagtaaatggtccgaagcttaggtaggaatgaaaaaaaatagaaatagaaaaaacaaagtgtaaaacagataattgtaaaacacggaaaaaatcatcagattggaccgaaaaaaaaacacaagaatcagatgagagatatactcaaagaaattttttcaagaggttggttctcttggtaaattttctttaaaacttacgttcaataagctattacagataaattttatagaatttagaaaacttcattcctttaaatcaaatgaccaaatataaaaaatgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttgggccgcggacagatcccgagctcacaaaagggaagcggaagccaagacttggaccaaacatcacaggcgcgacttgggaactaggccgaaaccctaaaactcatcgtagccggcttgctcctggaagaactcctcgtcagcgggatccgcttcatcttcttcagcaagggtgagtacaggagtactcagcaagccatgggaaataagtgtttaatgcaggcttcaaagaaaggccgttgtttttgcgattgattttatttaaactcttttttgaaacaactaagggagtgcttctcaaacgacacggatgagacagtgcgtctcgtccggtcggagtatgtgcaatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactatgctaggaatcacctcacatccgcccatgaccgtgggcacggctgctcgaacagttttaataacctctgcagagggggcacactttacccacacgacattactaacccggatcatccagcccgtgcagaacggccacgactagagaccttaaggctttcatgacaaagaatttcaaaagccgacacaggttcaccatatgccaacgagaggggtcccagaccaacaccagattaggtcccagaccatactgtgccaggaagccaaggggtcctccccgacaccaccccggcgaatccacatgtctcttagcatcatggctcccccgataagctagttactcagccagaggtgtcccattccacccatgtggtcgtacttgtcttatattcggatgaaattccaaggaaacggtccttaagtgcaagagcgggaaaccgtacacccggtacgttcctcggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaatgtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaattttggaagttgaacggagtcaatcggacttacggttgggaagatattgaatttctaagattattggatttttggtctaaaggaaaaggatttatttaaatcctttttgaaaaagaaaagaaaagaaaagaaggaggcagggaaattagactttcctcgggcggctagggcgcggcccgagagaatggggcggctcggccgagcttaatgggccggtcggcccaagaaggcggcccaaagcgcgcgcgggggcggggaggggagagagagagccggtgggccgggtccatcccgcgtggtcccgggtgggacccgcttgtcggcgactcggctcaccgtgagcgaggtgcacgtggggcatgctagggtttggggagggaggcgcggcgcatgcgcgcggttcgtggaggacgcggtgcggcgggcccacgcgcagcctcacggctcgcggtggaccgcgtgcgcgagggggctgtcggtgacatgggaccgggagtatcatgactagaggcttgggcagccgcgatcacccacgtggcctgaccccctcgggggggggtcgggcccgagggtgatgtggccgcccctcgccgnttgtctccccgaggggtcggaccattcccgtttcggccccgagggccggggcgccccgaccccctgtgggtttggcaccacgtatatgggttaggtgagcacagcggggctcacctaaccgcatttattgcgggttggatgagcgcgtcacgccgcatgtaatgccgcgcagcgagctcgcttatccggtccgtgaccaggcgcagcgtgtgaccggtcagatcgcgggttaggtggtggcaggtggcctgttacacgcctcgccccgtcccgtcggaatgatgagagcctccaggcacttatccctagccggagccggcgtgccaactcctggggttggcacgtcagccccggccagatacatgccaggcttcatcccaaccattacaaggaagtaattgtatgaagaagggcagacgtgcggcatgctaaactgacacatggtggacaagaatgaccggtctgtgactggtctgacaccggtcacgtcatcggcaaacaaactgtgctcccacattgcgtctgcagccggcggagtggaggtaggtatgacccgtcccatcgaagggtcattcggacaacagccattgcaaatctctgcccattaatgaaggattgacaaggtgatcccctgtgtcaggcgagtgtcggcgctgggtctcactcaaagacaagctatgacttagcttctaggagaggtggtgcatgtggtatccccttgagatataaaaggaggaccttgcccaccggaaagaaaaaaaaaggagagaaaggagaagacgatagctgatagaaaacaaagagtagggagagggtctctagagttcaaacgctcttgctctccacctctttataatttcttcatacacagatccaccagaacacaggagtagggtattacgcttcccagcggcccgaacctgtctagatcgcccgtgtcttgtgcatttgctctctcgcgaaccattccacatatcgagggcttagaaccttactcagcgcccccggccgaaccggcaaaggggggcctgcgcggtctcccggtgaggagccccacgctccatcaggggcggagggaagcggcggaccggggtctgcttgacccggtcgcggccgaggtggcaccgacgtggcgcctacgtggctgccacgtgggccggcgggaggtagacgacgacgccggtcgaaacggacggcggacgacagcggcgagcggcggagcgaaccatggcgatacaggcgaaggcgagcacactgggatgttgcacaggacgaggggagacgagccaatggctcggattcgccgggggatgctcgacggcggcggattgcggcggcggcaaccgacggcgggagaagggggaaacagcgatgaggtcacaaggggccgattcccggcggtgagagcatctacgcggctacgggaatccgttgctagcgtcggattgggcggagctacgccgagcgaggccggcgacgagcgggcgctacggagcacgggcggcgacggcggcgagcacacagcgagcagcggcaacgatcggggcggcgccagctagctacgggaaggctacacatgctactaccgaaaactaaggggaggagatggatcgaggagggagaacgggggaatgcactaccgagatgaggcggggcgctgtgacgagaggccgacggcacgggagtgatctctccggcctcgggccggggaagaggaagaaggcgagcgcccggagtccccttccgtgtcctcgctcgtgccggctcctccgacacgtgcgacggcgaacggcgacagcgaacagagcacgggaggcggcgacaatggagtggaggcgaatgggagaggaaaggaaaggggggggaagcttgggtttatatgggcgacaatgtcggtttgggagaggggaaccgactttggacggtcaagccagcgagctggcgctctggctagcagccaaatcggcgacagggagtaggggaatgactccggcagaggaagaaaaaggaaaaaggaaggaagaaagggggcttgccccttgccactttgggaaaaggaggaggggagggggcgacgcggcagagggaggaggagctctgcctccgtcccttggaggctagcgcgcggagtgtccggggcc

SEQ ID NO: 67919 - DNA, 5792 bp, Oryza sativa
  unsure (1)..(5792): unsure at all n locations
agagagagagagagccggggagggagggggagatgggccgagagggattcggcccatcgaacccgagggaggcaaaatagacttttgcggagggatttgatttgggaaggatttggattcgggattgaactcgacgatagatcggggatttgagatctgagatggcacggacactagacaataagcaaagaaacggatttcgcaaatagggtttttaagagatagtttttccgctaggcgccacgacggaacgggcgctacagaatttctataaaattcttctactaaattcttttgattcaaatggccacaggaatcagataagagatatactcaaacaaattttcctaagaggttagtccttttgctaaattttctttaaaacctagattaaattagccattgcagataaattttataggatttgaaaactccaatcctttaaataaaatgatcaaatagaaaaaatttctataaaattcttctactaaattcttttgattgaaagggtcttaggccattctcaacccaacacactagacatagtttccataagctccacatcatcaaaaaaactagtactagacactactcttacaatgcaaaaaccattattccatacttaaatttagtgctacttatctcacatgatgtcttggatattgtgtagaaccatgtctcatgcaaaacatggtttcctttgctttcctcatttattcatttgccacgtcacttttcatcttaggtagtaacttatttaatgctatagacaccattcttgtcattgggttgggaatggcattaggagtagtacgtccgctgtacgctgcacgagccggggagcccaacggttggtggctgcctgccttcgccaatttatttcgccgcaggccgcacagccgatcgatctgcagagcagcagtaaaaacgctcgtaacgacggggtgttttggaccggaggaatggcaggttccagatcgatgcaaattcgcggtgaattcttcttctgctactgctactgctgctgccgctgcgttatattagctgtgatctgggctgtgaagtcgctcgggggatagaaaaaaaaattgctcgtggctgtcaatgtgaatgtttgttggtgcagataggtcgttaggtacttgcatgatggtgagggttttgggggcggcttcggatgcaagggattgggttacttctagcacggttggtgttactacgtacgtacgtgcatgcgtgcgaatgattatattctagcttcaagtgcacactatctgatcccagatcaagtcgtggtagggttcatacactgggttgtcgatatatcagttacaccttacgagaaagatatggtgaatgcctgttttcagacaaaatatcttttttttttagaaacacaggccaataaatctatgggtatatctatacctttgaattctaaggttgtgtttgtttctaatggttgggaacctttctcctctagcacgtaaaatgaaacgacggtgttaacacacgattacttaagtattnctaaaaactttaaaaatagatttatataatttttaaaggaactttcctttataattttttttgaaaaaatacaccattcagtagattgtgaagcatatgcgtggtaaaagagagagtagagattggaaaagtgtatgattaattaagaagagaattggagaacattaaaaagataagaaaaacgagatgaaacattatagtatacgattaattaaatattaattattttaaacttaagaaacagattaattaatactacctccatattttaatgtatgatgccgttgacttttttttcaacgtttgaccattcatcttattaaaaaaatatataattataatttattttattgtgatttgattcgtcatcaaatattctttaagcatgacataaatattttcatatttgcacacaaaatttgaataaaacgaatggtcaaatgctagttaaaaagtcaatggcgtcatacattaaaatacggatggagtatgattttctaaagcaattttcgcatagaagtttttttataagaagaaacacaccgcgcagcactttgataggcgtgcaggcggaaaatgaaaaattttcctctcagaccctgtttagatcaatttgatgtggcaattttttttagaaaaagttttggtggcaaaagatttggtattgaagttttgctagttggtgtttagatgcatggtaaagttttaccattttactagtaaagacagagagagcacggttcccaacatacttttttggtaaattttgctactctaaactttcaaatgacaaataccaaattgccaaccttttctaccagtgtttagattcattttagcaaaagtactctaaaacagcaaaaaaaaatttgttattttggagaaactaaacaggacctcagccatcttgtgccgaacacagctaattaattggataattccaaaggcgctccgatgtaaaccaaaaatcttacacattgatttcatgtattattgcgaccatagatactgttgagagtttgtaataaataaatcacgtaactggaaatagtgtgcactctactttactaattttgaaatttgtaattaataaatatgatatcgtaatcatttcgaactctcagttagtttagtgatatgtaaaattaattataatattccaatttactactctgctatgttccataatatagtaaccgagaataagacgagagtacaacaaataatctagatagacgtatccagattcgttatattatgaaatatgtttcatccaattataggctgctataattacccataactagttagggctaatgacttatctgtcgtttttagtctttcatgggtaggctcatggggggcgctgatccgcggctactcgcgcagccgtgcatgcgcaatcagctacacccctctagtagatgtatatacagatgtatatacgtatgtataacatgcatatgtataaattttgtatactaaggctgtgtttggcattccttattcccaaaaggaacagtgcgtatgaaaaacgaagcgattcattagcacgtgattaattaagtattagttatttttttcaaaaatagattaacttgatttttttaaagcaacttttgtatagaaactttttttgcaaaaaacacaccgtttagcagtttgaaaagcgtgcgtgcgaaaaagagagaaatgggttgggaagaaggggtgccgaacacagcctaaaaagatcaaaaaaactgcaaaagataaaaaaagaacaaagaaaacagaaaaaaggaaactgcgcgccaaagaaaataaaaagaaaagggaaccacgttgtccgccgcccccactcttcgcgcgtgaaacatgtcgagtcgtgtgggggagggcgcacgagactagttacgaattagcattcacataggagaaaagtagaggttatcgtaccccggcagtataagcccgataaccatttagttatcaccacgaatagtaggaaaattggacggaatttattaaataaataaatatcgcttaaatgtattttgaatttggtagagctattaggctaccttaccgttaccgcacccaactactacggtcggtaactggcggtcggtaagagaagctctccttgctgttcccatctttccaatgccacccaccgtgctatgtttaaaaaccgtgaattaattatttctccgttcagctgaaatcgaatcattccatataaaattcttgtattctaaactggcgcttgcccatgctgtgcgttcgtaaattgtgttttttcggaaagagaagtggctcacttagtgaaacaggacttagacttacgtagctgggcgtttaagcctccttgagctgtgttttttatcttttgtaatcaaggatctgtttgtattctgtttttcttcttaatcaaattccggcagagctcctgccgtcgtcttcctcaaaaaaaaattgtgttttttctactatattcaccacctgaaacgtttctaacgatagcattcaaaaaaaagctggaaggctggaaattaatgggcagcacgtttgccttgtcccgtcctgttgcacatatttgtacagaagtgggccaacaacctgaagcctttgccgttatttggcgacatctttcggatgggtgttacatgtagtagacgctttgtgtgtcaggtcaggctgcccctctcaacggtaaattattctccctgggtcaccaaatccctttcctttgtctttacaatcacaagcagagacggagaaaaggacaaagcagtaggaggctgagctcacagttcctaattataattgcctgtgtttctagaccgtcgctgggatatgatgcatctggatctggacggtaggtagctgtccgtgcctgaatctgttgctgcccacacgaagctgcgtcgtcgcaccttctcggctatttcaggacttctgtaaagcgacagtttcatcagacggtgagtattcagaccatcagtcatatttacaattttaaactgaagatatactccctccgtaaaaaaaaaagatttttttggacggggagtataacttagtggtcaaaatcgtttttcatgtactaactttgaaaattctatgatcaaagagtataacataatctctacgtctcaaaatatatataaggatttttttatgaatcttgataatttctggctataatacctgttcagattcataagctagaaatgattatattttaggccggagagagtagatcatcaagatcatcgtcatatttacaattttgaatctgatcaacaggtatttattctatttgtaaatcataaaaaaattgaatggaaacttctatgctcttcatcaataaaaatgaacagtactcctacaacttcaccaatacatcaatgatgctttctcatatagattgttcttatgttcattagctttagcgacacggaaaatgttgaaaatacttgagttggggatatggggaatgcatgcatgcaggcagcaggttgtgtaccggcaaagtgccaaaccattaaagtttgcaccattaattgggggcaacacagctcacaacctaaccatatgccacgagccggtgtaagcgggattgggagccttcagtcatgaacgagccatatttttttttcttttcttacaaacaaagaaaaccacttggagatagggttaattagtcgtcaaacgtatgtacgacttgtagagctagctggaaacatttgatagttttagttgataccctaatgttatggaatgtagcagcatgtgcataggagtatataatactgtcacattgctacgacggttgttgtatgtactaattattaacaagccatgtgaaaaatacactaaactaattgacatcgacgcttatttgtattaatttcttgagaatctattgggtgatctttaataaattttaccgcgtttagacaagtctgcaggaaaatgtgtgttattacgcgcgtcgacttcacttgattggttttgaacccctgcagcttaggcaagtctacagcttgagattggagcaagaaacggtcagttcattaaataattatcaccgctaattggtcccatggcatgtcaatttcgcggctaatcccatcgtgaacaatcgttcaattcgtcaattagagtacgtcactgcatacctgaactgaaagaaagttgggcatgtgaacagtcaagtcgtcatagggaagaaaaatactgaaagtaccacgcgagacaaattcaaaggatactat

SEQ ID NO: 67920 - DNA, 13648 bp, Oryza sativa
acacatgtatcagctagggatatgtctcctcgagagtctagggcctatttagagaagcttaagattttgagaaacagctggttaattggtagccagcttctgagaatatggaaaagctgggtttcctagcttctggtttctagttcatttcctggattctacgtacaactacagtttcttagaatctggaccaaaagctggactgtttgggagagcttctgattattagagaagttgtagcagctaaaagctcttctaaacatacccttataatcgtttctacgccatagctactatacgtaggttgcatgcatgtaattgtattcgtgcgcgtatgtgcgtttgatgtgccgtaggcatcgtacgttgcatgtattgttttgtatgtttgctcgtcacatggtgaattgagcacacacgacacatctcatcatcagctgctgcccctgggatttgtagccttcttgtatacctgctgcatggatgtggatttgtacatgcagctggggggcacgtacgaattaaagggcccaaggaattgatcatcgatcgatcggcaataattggtttagtggatcgaattccgtaatcagtggtacctgcatgcccccattggatgatgtttgcatatatgtgcatttatatttatattcgtattgaattattgatattagcgtgttggaccattgatccggatcttgattaattcagtgccatggatgccagctgctttaagtagcttcccgtggatgaacggtctgttaaaccctatgtgcgagaagtgatatgttaaactcgaattgtgattggatgatgtagttaagtgtcaacctatatatagtctcgaagctgtggacactaggacagtacgattctgattgttatgcacttgtgtgcccatggttcagttacctccccaagctagcaaagcacatgttgataggctatttatgagcatttttttcccatgagctgaacccgtgtgatctatctgtagatttttgttgatcgattggactagtaagatgactcatcacatatccaaattgttgcgcaccactccattgaagcagctagccaaattaatgatactacgaggcacttactatatatttccccgatctatttttgatagtcatatttccaaatctgaaaaaattattttttagacatatttcaatccaacaacttattatcttaatgactttctccgatttaatacgtgactctccattcctccacacaagattggttacatggacatcgagaaatataaatattaatgaatcacttgtttacaaggaatgactagtagcatgtttagatagatgataagattgatcttatacctcccggtccagaactagaattacttatcattagtctatatgtcaatatgaaatatgactatcaaaagtagatggaaggagtatgtcgtaattaaaattagttatgtatgtgaacaatagttaagtagtgctgttttaatgaaagaaccaaattacttaaagttccgtgtttttctgtgtgatgattaaccacgcctacctttaggaatcaacttcgatgagaaaaagttggtaagctaacacacaagtcaagacgaacataaatacaatataccctagagtatggtcggtcgatcaaagaaatgaatggcaaaagggaatggattcaagtttaatttggttgcaataattggatgggtagttttcaggcttaccaactacgagagaaagaatagattggaaacattttatgaccttatgtagttggtggtgtagttggagtcctaacccttttgaggtaacaaaactaagatcctctagttgtagatgtgagtgatttatcaagctaggttaattaaaaaacagaaacaaagacagataatgagacaaatcaatatcaataatgtatctgagcagtaagccatatatacggattgcgatgctatttaggacatgtataaagggggagcgtatcctatgcacacaagccctcgcgtgtacacaccgtgtacaccaactaaaaattatcacaaaaaattctaggaaaattcatacatgtactttcaatagtattacatctacgtgcaaagtcgcatcttcaaattcattctacatagagaataataaaaaagataaaattctgacaaaattgcaaccttaaaactgtcagattttttgttttttttgttacggctaaaatataatgaatttgacgttaagattttaaccctaggtgtaatacaattgaaagtatgtgtatgattttttctagattttttggtgacattttttagttggtgtgcatgtgtgtacatgtgagggcctgtgtgcataggatatgttgccgtataaaggtgagacaatcttgctatatatatatcttgtaaagacaactgtacagcgatcacaaacactataaatacaatattgcattattgtctttagaaatagacttcacaataaatacaccacaatttattatagctaacccatagacaatcaagttgtgttttttttttctttcatatgcccaagagcttgtatattttgccttctataacacatcaaattctcgtgacatgttcaccagaataatccacagttttgttagtagtattattttgcaatgataattgatcgatgtaatcttcttctatggagccccacaatgcataacagttatcaagcatatatagtcaacacatcatcacacgcttgatcatccaattaggatgacacacacagcactagaacaaggaaaaacacctgtcctaagtcctgaccgtgtcctagttaaggacatgtaggcagaagagaaacatggacagttctgtacagtctgttgcatctctgtccgtcaacactaagaatcacaccctgtttatatgcatttgattgctgtacaaggtactccatcatccagcctatgcatgtgctataaccgcatcaggtacagagaaaatgcatagacaaaggaaaaaaaataaagctataattaaaaaggtaagagaggatgattaagtaaaccaagaaagcccagatgattatcaacaacggcagatggtttctaacttagaattaattaaatcaagggttagtttgggggggtatggcccaggtttgttaggagtctctaatcatgcttgcagttgcattagcacacacactgtcgaattgccagcatgttatgttctacttgcatgtgtgctccctcatttagacagaggaatgacatgtacacgcaagctaccccctgaatttggatggcactgttgattagttaatgctacttgcacttagttgcaccttaatttggttcgtgcaaatgggtaaattgtattgaatgtaagatttttaggaattgttaattactacctccagtcacgagtcatttggacatacacctgatcaaagttttattttttttcttaacaacgtattataaatatttgtattggatatatggatgtcatatatatgcatggatctgcataaaagttactcacatgttataagtttattgggtttcaacaataatacatagtacggtagaaaattagtggtaagtcacagtaaaatttcagaggttatgtgattttttctcgaataaaaaagggttatgtggatgcttaaaatggcatattatatatgtttaggttgttttcaaaagaagtggtagtaggtgcaattactaagtgttcacgagccacctcacccccaagcggtgagccagacaataaatcatgatcgaagcagatggattgcttgatgaacctaggagtttcacgtgaataataatagaagtggtagcacttgaattttcaaatagatgtagtcaactgtagcatagcttagcggtgtagcacgtctctgtggctaatgactgtgctttacttaattaattagctccctcaattgttcgttgggcggactattttatatggacttgtaatcattaaaacggcagcaatataactaatttgtccatatgcatagaaaattgcatctttatttgagagagtatataaaaaaatgcatatgatatatacaaacaggggattgatgccagagtgacaccaaacttggtttaattttctatctgattccttcttctagacttctagtcacccatgaatgcatagttggtacgtacttggtagcctgcattttctctctccttggagcagagataacaacctgctaataaataaccaatttcctcaactaattttaacgacttgcattacttgcacttccatataaccaaaacgacaaatcagattagttgtaggcttcatacaatatttgaaaatgacaataatatttcgatgctaagtaaccaatctagcattttattaatataagttgtgcgccatggtttacctttccatttccgaaacaaaaacagctccccattggttgccgggctatcggctaaaaaccagtaaaaaccgacgtctttcactcaacaccttacgaaaaccgttaaaactgaacaattttcataaaccgaaaaccaacgatttaaaaaaaagatatgattcgtgaaaactctgttgtgcacgatataacccgagtctgagatagtaacaggggtccatgtcactcttctgtaaatgatctgtacatttgttagtatgtggcgacgtgaggcatcgattgaaacatcgtttttctttttagaaaaggatagttgcactgtgcgcagcttgcatccaacaactgtgagaaatctgaaaaattagcaacagtagcaatcaattgaatggattgatcttatccgctcttccattacttaagtgagcactagtagggtttagctgtgatgatgatgatgatgaaccggtggtttgtatggagaggatgccatcgggtagatgctcttgtcccttttatttggcgatgtgatgataatattgcggtcttcaagacaaataagaaaaaagaaaaggatgataagattgtgtgaatggtactcaagtcattcgtggcaggccaactgatgtgcacttgatgcggcctagcatgatatgcatcgtcccaactttcgcactctagttaattggaggtgatgtcgtgtacgaatcattctggcgtcaacttaaaacaatagtagtgactctgatgcggagggataataatttaattagtcacttttcaaggtgtatctaattcgttttaggtgattaaaaaaaacctcaacttcttctcttcttgtcaaaaagaggacctaatgtggcctttaaaccaaaaaaaaaaagaaaagtgtgtggtcatgagtagagtttcatatctattatatactaaaagtatataataaagtccatgaaacttcatacaaacgctcccaagccgccatgtggcgctctaataaaatagagaaaatcctataaattctataaaaaaaaaagcagaacatatatcccttgattttcacttaaattggtgggtccaatattatacaccgttagataaaattgatcttaaaacaaactaaataccatgggtcccacctatcctcctcccgcgcattggcaggtggagtatatacgtacgtacatggtacgtacgttcctcccccacttttttttattttttcttctttcttcttcttttttccatttatatatataatggatatatttttaaataattataattttacaaataaagaatctaccatcatataacttaaaccggtttactttgtactattattttcaaataatgcactattttaaaataaattttacacaattatatcgtgtacctatcaaataaataatatctatattaactaatttatacgtgcacttaagtgcacttaaactgatggccccattatataaatcatcggatctactttttattacattgatatattattctcaagtaatgcactgtttcaaaataaggtgcacaccatgtgtacccattaaaacatcaatttaaaatatatattaactaatttacacttacactagaactggtggacatattattataatcatcggatctattgtttgcttataaataaagcgtctgaaattctctttttgcccgctgcacaatacacgtctgcacctttgcctttcacacttgtgacaaagcgtagtatctgagacatctaaggtgatcgcaaccgatgtagcgctaccgctttgccacatatcaaatcatatatggagatgattaattttgttaataacatgaaaagaaaattaaaggtgtgatgcagcgagagaataattaagtaccatgggttatgtttttctcaatactaattagctctatttaagttgaaaccaagaattgattacataataattgtaatgtatttgtgttatgtcgtatttggattttgtactatttattcgtacaggtgaaaggaatcattatgttataaatgtgagagtaatattgacgaatatccatagaactcttactacgacaagggtgataaatagagttttaaggccctctctttttttttccccgattccatattttggatttttgtttgcacgctttctaagtttctaaatgttgtcttctttaaacaacattctaactttttagaagtcaattcattcgtttataccctcaaatagctatcacataaattatataattcatcaatttcatctatcctaaaccttactatatatttttttcatgcaagtcatggtgattagtaaattggtgaacaacggatcatcgaagtcgtaagatgaatatgtaagagttactctgaacaattgtaaataggtatcaaaattaattgctattaattagacataatggcttgctagccacaaaattaatttctctctacatgtatagaaacatggacgaaactggaacaaatactaccatatgtcccatacatatatattgcgcagttaatattctaattagtcatttaaaattccttaaaatgctctcaagctaccacgtggtgctctaataaattagggcaaatattagaagttctaaaaaaatcaaagtatctattacttaattttcacttaaatcggtaggtccgatattataaaccattagattaaattgatcgtagaacaaactaaatactacaaggtcccacctcagcataggtgtgtacctacgtgcgcgggttcgtacgcctcccctcccttttttcatttttctttcttcttctttttcccatgcatatgcttccctccctttattactatatcatgcactttcatgagacgatttaatcaaagaattttaagtatcttgcactcgtattttttatttgcggccatactacactatatgtatatagatggactgcatgataattaactaccaatagtttcttatttactcgagaaaaaaaacatgattcaaaagttgtaaatacttaatccatctcctactcaaaagttcgtgaatggttttctaagataccttaagaaaaatagaacccttaaattattataaaataaaattatctaaactttagtttgtcctaaatctatgagacaaaatttctgaacaaacaataatcttacctttcaataatataagtgcccgcgcatacgtgcgggccaccttcctagttaaaactaaaaacacatttgctagtgattagggtgacaggaatcaaatactaagcagcaattaaatgggataatgcatacgagcacatatctgcaggaaagcgagcggttcaaggctcttcttttcaggtcgaaaggtcccttgcagatgaattgtcttcccctcttcaatgcacatatgaaatcatgaggcaatcatgcataggatgaatacaataggtctacaattccacgcagtgtggtcaagaacaagtcggaccttatcggttactatagtatcaattccatgtagtgtgaccaagaacaagtcgcaccttatcgggtgcttgctagtatggcaatgctccaataagtaccatttttgaaccatgtttttttactgtgtcagataaatctagcatactagttgccgattactatttcccacttcttggcaaaaatttgacgatgagatgaactaagaaatagtgtacgttgccttacctgttcagaggcccttttgttaatgtccatccatccaacctggagtgaagcaaatcgtccacaatgccagaaacctactgttacactggcacattacgtagcaaaccggggtccaactagaagtactttatttttgtacaggtaaaaggaactgaagtactgtatggtatactgggctactggcccgttcctaagagcacagagttttttttttttctcttggcaaccaaactgaagtttcgcatagcttgccatgcaacgcatagcattacagtctggaatggccggtaagtatcagaactgcgcaaacggaggcagcagcagcagcagctcggaaaaacacacaacagcatcagatctgtatcccagcaggatgtagacacagggcacctcctggacatggggcacaggcttggcactccacagtccacactccaaactccaaactcagccagagcatggagaacctatcagcacagccgccaagaggaagagtaaagatccaaggacactatcaattaaattaatgttcaggtccaaacctgtacacgggtaatatgatacaaaaggagtcaggcccataattatacatgtaaaaaacctaggtggtggttatcatgtctatttcaaagttctttttcagccttcatttcgttcttttccccctgctttatcaacacgaaatacaacccgccatgcctatgcgatggtgcctatgtgcaacttgcaactccattgcatgattgggaccttactaaatttgaaatactgcacaatggaagggagcaagaaatcaggtaatggggtcaaaagaataccgcgagactatgaacaaaagccattagaagcctctgtcagtgatgggatatcatcaagaacgatatcggcaggatctccaatccaaagcccatccctccatctgaacttgatcctcagtttcccatttgcatcaacgcctacaacctcacctttactctcatatgtctcctccccccatccccaacgtggggttacaaggccaggtcgtatccgtactctgtcccctaatcggaatggcctcaccttctccacttcccaccttttgcacaaccattgtctttcacagaaacagaaggcaacccaaagttcaccatcctcggcccggtggattacccctatgctattatggttcacgtcaccccactgatatgtgggggtcgcaacacaatccttaacctttacccagtccccgacacagacttcttcctcttcctccaccttttcaacctccgctgggtctatcaaccaagctctcgcaccagcgggtgtatgaatcctaagcttcccatcagcatcaatagatgagatggtccctatactagaatgattatgattagaccagccaaatcttggctggtggatacagagtttgacccgcacgcgctgcccaacgacaaacttgctgactccttcaagctggcttgaaggccctatccacctttcctgctcaccacaaaatgccacatgaatggttccatcccagacatcatcttcatatccaatcccatgtaccacgccaatgctacctggtttgagcgacttccaatcatctgcattatttctcagcctaacccattcacccacctcataaacttgctcaatctcaagatctgcaggatcacctttccacagcccaggcacaccaaagaaggctactcttacttctccatcagcatggacaccagcaattatgcctctggaatcaggctttgcatctctccatccccatctgggctctgtaattccagcacggaaccgaacatgatgaccaatcttgagaggctctactttatcaatttctgtgttatgagttaaccatttccctttcctgaaacaaccagccaactccaggtaaccagagtttgaatgctatgaactactgcaatacttattttcccaacactccagtcataagtaggcctgctcccaatactagatttcaaccgcacccagtctccaacctcaaaagccgaaagcctctcagcatcacctggagctaccttccacaagctatttctgccagacaccttgacatttagagtcccatccatgtctatccttgagatagccccgatggttgctgcagtttcatttgaccatccaaggcgaggctgagatattgaaggtaacacatgaattttttctcctacctcaaaaggctgtgccttctccacatctgcaactgagcaagaaaaaggcttgcttctgaagcagaaagcaacacccatatctccatcttcttctagactatgaaccaccccaatactgctacgagtcacatcctcccagccatatttaggggatggtactgctgccttcactctaacccaatcaccgacctgcaaataaaatgataaatagaaaatgagagtccaattaatttgctgtgctccaagcagagcaaatgctggtttgaaaggaaaacccagtaaacttctaaccttaaacttttctatcttttccatgtctgatggatctgcctgccaatgtacagcccggttaggaatatcaattatgagtagcccatcactctcgatgtcaattatttttcccacgctgtgatgggtttcaccaccccaggcatatctaggctctgcaacagacctttttacgcatacttggtcaccaatctggaaatttgaagaaacatgagcttcacactaaacaaaacaaaaaagcagagcaaacaagcacagatacatgcaaggacaagttcataatcgctgtgccatgtaatctaactacaagagtttacaaagttgaataaccaattctagtaaataagaggctatcacatattaatgtatctgaaagtccaatagaaccctcaacattccatcatcatcaatacagaaaattgtccaaatgctactcatgactgaccataccatccaaatctgggaacagaggattttatatgtgattcacatttctcccacaataattgataacctactaagatgagtgaattctatttttatgagacattcctcaaacattggtatattaatggtaaggactttaacattcacatgcaaatggcaaatcccaaaatcatattttaattttgctttttgcagtaagcagaagagcaacttcagacttataataggtaaacatattagtacaggaaacaaatggtaagagtaaaagaaacagaactaccttgaagggatcaacatgttcaacctcctctggttcacaaagccatggacttgacaaatagcaaagtcccaatagaagactgctgtctggcctgattgagtagacaataccaacacttccaggagtaatagattccatgccatgtacagcaaccgttaatgagggacgaatccgaacccagttaccaaccttatattcttcaacccttacaatttcagcaggatcagctctccatcccctagaagctcctggaaaaccaaccctcaagattccatcatcatcaacacagagaactgtcccaatgctatctcgtgactgaccacgccatccaaatctgacaacagaggattttatatggtgattcacaatttttcacataataaatgattacctactaagatgagtgaatttgttatttgatccatgagacattctccacaaatcttcggttagtatattgatggaaggaattctcattaacattgacatgaaaatcagaacagtggctcctattatcagatttttaaagtttgcctttttgcagtaggcagaagagcaacttcagattttgaaaaggtcaaaaatcagaagcaaatcaccatttgcagcgagcatcattttctttctttgggacgaccaggatgccatcatttttgacaacatccagtacatcagtgtaaacttttaaaaccttttaacagtcaaatgcaattgcaagtcactgaaaggacagatcacctcccaggttttgggtcaatggatcttggaacttcaacttacaatcatgatcagcacagagcgaaacctagcatgggctgcatggcacacagaaagtataaactataaagtagagacgaatttattagctgtatcaataggcctttcacttgcaagtatcaataaatacatgggcagacatctaatccagtaaaccatgtatttatgtcagaataaagtagacataagtccccattacttttataatctcggtgtccagatgaatcaaacaggctaatggatttactgacttggtaatgcaaatcgtttaagacagtcacaacttgcgaagttgtttttgctatgtagtaagaaccacattctccacttcatagaaaggcaccatgcacaaaagagagttcagtgatgagaatatgaaggattaaatttcacttacctaggctccaaaacatcaggtttgagctgcacatgttggcccctatttaatggaatgactttgataacttcactcgtcaaaacgcgggcttctccagaacaaaatgacacaacaaggtggtcatggtctacaacagactgaacaaaaccaatgcttctgggtcctgcaccttgccagccaaaagctggttcagtaactgttcttctaaatttcacccaatctgcgaactcatatctggtaacagcatcaagtaaaccattcagataacttgaggtccaaagcaatcataattccagcatgagatcaaatacgggacagccaaaaaatatcgacaacattatgcctcgagttccttacatggttggggtgagatgaactcctttttcttctaaagtttccatcagttcttcagaaatccattctcgtgggagcctctccagaaaatctcgcaatgtccagcctctgtagttgatagaaacaataccgaacatgtaagtatataataaaagatacaaattctgcactgcacgaactaacccatgagagagttttcaagcagccttgcaataaaatgagaaaatactcgataaccaaaatttgcttgctatttacttctaagataccattcaatcattctacattcctggcagaaggacccatctgaaaatttaatgagcaaaatactggcataatacactacctaagaaggggaactaagagaatcttcactcaatcaaacctcaactaagaatcaccgatacatctgccaacagctattcccgtacacataaggagtatcagaatatctataccacttaaaatgtgtgtagtggtggtgtccattcccacaccatctctaccactgatgtgtgggccccacaatctatactattacaccacctttcaatgagtcctcccctgtttcactgttggttctccccaaaatttaaaatcacctactggttttaataagaaaaaacatagtacttggactaaataagtgtttattaattgatttaataggttagaaactcaaattgttgtccgttgcaacgcacaggctcttggctagtattgaagcatttaacgtttaaaattaagtaaattgcccattgtagtgggtaaatcgcaccctgttttgctttgcacaaggtttagcacataccttttactttgcatcacgttgtatt

SEQ ID NO: 67921 - DNA, 6445 bp, Oryza sativa
acttgcctgtggtttctcacatcaacagccggcgatggctgttgtaacatttgaacaatccatgagaggttttcacgtatcattttagccgcatcagcagctatgtggaaagcgttatcgccgtcgtcatcctggataaccaaatagcacaacattaagcacataataacttggtcctgacatacaatggaaattgaataatgttcgaaggaaataggagcagtgacaaaacaaaatgaatgcatggattttaagttattgcaccataattacagacctggaacaagtccagcagccaacccaccataacacctcatatcagacaaattagaaggaagaataaaggacaaattgcagaacaggccttcctattcatttaaacttaacaacaataatttgaggaaatggagaatctattcctcctgataatctagaaaagcatgctggggccttatactttatggtgagataatacagtagaatttgataaggttcagggtgcaaaatcactgggaactacaataaagcaatattgttgggcattacacatttcatttctgaaatatcaatagataccatagcgcctcttggaaggtttttacgtaaaataagctattgttaagagctgcagaggtctacaaaagcagagttttccctcttctgggtaactatatcccagtggtttcatttttttcattcccattcctgttttttgttctgctattactatccattctacatttgattttgtttcaagtatatacataggctcccgctgccctccacagcggctccaagtaatgaaatgaaaactaaatgttttcttaagtatttcaattctcaataacaacaaaaaaatttcttatcatgcatcaatacacaactatgacagtgcctgacagcaaattgatatcatgatgacttttaggatttgtgcgcatcataagaacaggaaaaaacatattgtagccggatatcgagaaaaagattattcaaacataaaacatctggaatcataaaacattattcaaacatcacattatcttgctatctcaaaaaaaatatcacattattttatttatgtttatatatatatgcttcatgagaaaacatgatgacaattgcataaatccccacaagtacaaaataaatataaattactagtaaagaaatgaatcagaattcagaaggataacaggatcagacaggttgacagtttacaattcctaatacccagttgcacaagagatcatgttactgaactatgctttcagaccaacacactgctatccttaaaaatgatcaatgaagccacagtacctgtagattgcagtttgctccagcagctaaaagcaaaccaacacaggagtttgcacctctgttcagtgcaacgagaagtggtgttgtgttctgagcatttcttatatttacatcaactccagcttccaaaataatctgtcaaagaaaatataacaaagggaataaagcatattttcatatagaattaaagcagaaacagcagaaaaatgaagtaaaattccaaccatcagacaagaacagaaaagcaaaggaaaaataataataataataagtagataacctttaccttaaccaattctgcatcattgatcattgctgcagtatgcagtgcagttcgacagtgtgggtcatcttgtgctgtgggatcagcaccagcagaaagcaatacccgtactaactctcgaccctctgtcacatatatatgtcaatattactattaaaacagacacattttccagtagataaaaaaaaatagacttctgtcctcatccttagtgaactaaaacatgtaagtttgcttgtgctaagtgtgaatgagataaatatgaattaatctctagggtgcccatgtgaatcgcatttaaaatacaactctcgttagtggaataagaagcagagttgtgaatatcaaagttctcttctctaacatgatgcttcttctataacagcattcagtgtatgtaaagaaccaacgagatggctcttgatatttgactatttgtaagtatggatgtgacatgaacaaagtcaggaataacctttctcgtgctcttttttaagagcagctgccatgcacaaagcagtcccaacagggctaggtacatcaattgcttcagctatctcctcttcagatgcaacttcaacccatcttttcaccacatccgcattccatgttttaatacataaatgcaatggcctgtgcaccatgacaagaatgaaatatcagtcgatgaatcaagcaggtaacggatccaaaaggaaaatatttcatgattccacagcaccaacagcataaggaaagccaataagccatataaatagaagaaaatatttcatgattccacagcataaatcaaccaatagaagggcaccaacagcataaggaaagacacatcaatagaagggcatcaacagcttgccatttcaaacaaaaaatcattcttacgttttattcacagaatttggtatgcccatagacctgcaaccaccattttccaataagacgatagcacaatcagtatatctcttggccacagcaatatgcaggatagattcgccttctccgtctattgcattaggatcagctccagccatgagcaattcctgcatgacacacagagaatttaaatctaggaacttgcaagctgaagtcatgaaaggtgagcataataacatacccgcatgcactctggttggccatgatgagcacaaacatgagcaagagtaggaccaagaccttctctaagcctcgaattaacatcagaagatctccttacaagtgcgcgaacacactgtggagagccagcagccatagcaaatattattggaggattttcattcttatctaacaagtccacattctcttgataagccacaatagcttcaacaatttctgctgagcctcttcggcatgctaaatgtagggcagtatatccatctgcattctgtgcttccaagagcgaacgaattaaacggccatttccatctgaggcagcttctgcaagaagattcctgacaagcaaaggttgtgtcagacagtataggctatacgatgcagcaaacaaaaagttgtcaaagactaacctaacaccagcagcatctccttcacatacaagatgatgcaaagcatttggattgtcctggaccatgtccagaactgaggctggtggcacatccgtaccgttgggcatgcttgcatttgtgaaatcactgcttgagcaagtagtgcattagaatcctctgtatcagcaagtttgcatacttcaaaagaataagttggggaaaataacatgcgccttactgcagttgatattatagtaaatcaggttaactcaaatatatttcactatatgttttatacacttttagctaaatttctacaaaccttagttccatttataaagcattgtagttaactaatgaaaaatcaggtaagaaaattacttttcaggacttgcaggtgggctccttggtatatctagaagatgcctcagaaaagtttttagcatgtcctggaaagatggtcttcttgaaggtttgaactgcaaacagtcaccaatcatcttccagagctccccaggaagtcctacaccgactacccttgaatattgaggcggtggcttcctctcttttacaacagacttacaaatttcctctgcacttagcccagcccatctgcatttcaattagcatctaaccacaccattcgaggagcattaagaaacacaaatgaaataatcaggctacttacggaacagcaccagtacacatttccacaagtgtacatccaaaactccatgcatctgactctggtaatattccatttgcactatcccaaaacagattcattgacttcttcaatggcacccaagcctcaggagctgtataattggggctaagaagtgtagcatccaagccaaccatgttggaatcatcagacactctacgactagtgaggttcttaagaatggccgaaagaccatagtcggaaacaactgcatgcccatttgtatccaaaaggatatttgacggctttatactcatacaaacaatacctgctgcatggagttctgctactccacgagcaatatctgctccatatctgcaaaactcacgctcgggaaaaatataatcagaagatataaagacttgagtaaacaaaagggaaggtcaaacataatcagactgaacaaaagggaaggtcaaacataattagactgatgaaaaaactaaatccttttgatgtgctcaagaataataacaacagtatactaggaaaaatgaggtggcaattcttataatggaaaaataagtaaagaaattggcatgctgacaaaataagttattttttccctatgtatggcatgggctatttcatgcacttagtacagaagcaattcgcgccatgtagctaccagacaaaagagaaatctgagttcagaattttatgagttatgagtcatggacacttgtgattgtatatcacattctattagacaactacagttcacaaagttccaccaaactataacagaaatacaggatgctcagaaattaatttgcatcgttagtttgacaatgtgctgatgaactttgacccacatttgtattggcattcgcatcaaatgctaccagagtgtgttgagacaaagtgcttcttgttagtaaagctaactagcccgattcggccattaacttatgtggcaccaaactcccttcttcaaaaagagtaaaaacatgtatcaaattgtttagatcacaggataatcatttcttattctttttaacccatggactaatggtacagttatttgatatccgttgcagcacacagtgagtgtgctattatagtaagaaactctacatcaggtaaacacaaatgagtggcccacactattccactgcacagaagtattcaacagatctttggaaactaaagtttgagttgagaggaacagaattaatgcagcagtgaacaaccatctttgctccaatccctccattctaacagccatatgagttatatcttttatggagaaatgtccagggtgccaaatattacagatatgaaccagaaagtgttggcatttcattcgtcgccgtcacgaacctcacaatattctaggaattataattttgggaataaacgattgcacattgtatagtacaaattcatagcacatacaagtgatcattttgttcacaaattaaagagaactcaagctccacatgtagaatgattgatgtgtgttaaatcaacaaaccaattgcaaaacaaaactatgttattcactggacactgaacttcctgagcagcctggcttgaattttaatcgtagtacaaagagtgatctttcattcctccaagcactaagtgtgataattgttaataatagacctaagcactatgtcacaacacaacaaaagatgcaggacagatggaataacaaagctgccgacaatcacccaaacattgccgaacacgtacaaatactacaaactcattgagatcaaatttggcactactaatcgcaaaaaccgctttccacgtcagtactcaaactacaacattttccaccttttatgatccttctagctagacatgcagcttagcgaaccaccattgaaaccccatgcatttgaacacatacagttagcggacaaactgtcgtatagcgccccagctcaactgtatttttagggttatcattttcggcgatcgatagtttgatagcagcaactataaccatacatgactgcagcaaatataaccacgcaaataaaacttagtatccatgtttagatgcaatgccacacctgaggatctgctccaacgttaggcgaccgccattctgccgcatttctgtctgcacagaccccgcgtaccgatccatcacgaagcagaggtgcccgccgaccctcacagcaccatggaacgtggtaacattccggcaccacgtcgcggcgcgcctcagccgctccacctcctcctgaacgccctcaagcacatcccccgcggtcacgggcaccctcttcaccgccaccggatgcttacacctcttggccccacctcccccaccaccacgagacagcgtgccggaccacacctcctgccccgcggggcccggcggcccgctcccgatgcggcgggcgagcttgaggtccggatgcgaggcgaggtcgaacgaggcgcagcccgcgggctgcagcgacggcgccgccgcccccgcccccgcccccgcggcggaggatcggcggctgggccggccgaagaagtcgtcgtcgtcgtcgtcggagccgtcggaggaagagccgccggagtcggagtggaggaacgagggcgacgacggggacgacgacagcagcgagaggatggggaagttcttccgcagcgcggagacggagt

SEQ ID NO: 67922 - DNA, 22998 bp, Oryza sativa
ggtttgggaaggaggaatgggattttttgatgggggggttggtgatgatgatgatgatgatgatgatgatgatgcggtgggagcctaggagggacgacaagcaaggctctctcctcttcgctcttgggaggggaggggtgtgcggtggtgtgttggccgtttctactttctgttccggttttgtcgagtgttctcgccttctcggggggattttgggcgatgttggaataagttctcctctttggtttgggatttagtacttgagtcatgttcactttgatgtcattttcaaccttaccaaattttaataaagttatcaaaaaagtggctacatttaatttgctgtcaaattttggtaactatataagaaatcctgtcttgccaaaattttggcaactatattaaaattttggtaatgtcaaaatttagtaaggttttttttggcatcaaagtgaacaggtccttggttagtgtgaatgaataactaaaagcaactttgttatgttctcttttttattttcttttttttggcgagctaacttgccacaccgatcaagaaagggctgagctgacggatagaccggtttggagcttgcttgtcctagatgtgcttccccgcaacgtgcccgtacacgctatatgtagtttcagtgatatgctaacttttttttttaccgatcgtttggtccacggagtgatatgattctctttgttggttagataggtataatggtcaaataggcaagatgttgttttgataattattttttccaatgtatggcctcatcctttgccctacggcttataagctaaagccaaaatttaaattttaaaacttgattttgaatttgattttgattctattttaacatagtttttttcaactttggcttttcaatcggtaagaacaatatataaaacttttactcgcatattatttcttaatcgttaagagcaagcttaatagtatagctaactactagctccaaatcttctatagccaatgtaatagacaattcatacaatagctgcttactacactattaatacttagtcccacctgtcatacacatattacgtcttggagtccgtgttgcagctggctacagatctgtagcccgcttcccttatctctcttcttttatatttttaaaatatgtttatagctagcttatagtctgctattgtacctgctctaataagccgttatggcttataataagactagaccaaccgatggggaccgtagttattgtaagtataggagtaaagccaggtatagtattttcaaacttgagaaaaaaaatgtaaaaaaaacgtactactaaggttgtgttcggttctatgggttgggaacccatctcgcacgcacgtaaaacggagcggtctattagcgcgtgattaattaagtattagtagccttttttcaaaaatggatcaatatgattttttaagcaacttctgtatataaactttttgcaaaaaaaatgcatcatttagcagtttaaaaagcgtgcgcacggaacacgaggaagaggagttgggaacatccggtgccgaacacagcctaagtgtgtgggcgctaccatcaatcgtgaaaattgtctccacctattgtaacgcacagatatttttctagtacaataaaaataaaaatatcttgtttgtggcttagctttaccgtatcttatattcggatgagtaaactataccgactatccttaaacttttatatgcatattagagcccataatctagcttgggctactaggtcattttaaaactagtccatgcacatgcatgttcgataagaaagcatgccaaaatacaccatatgagacgaaaacatgtaactgtaacaatgaagttttatactaggtttactgtagcgatctacaaataaggttgaacagcaaaaacaacaaaatactataaaccggctataaaattaagttctgaaatttaaattgtctactgcttatttaggtttatactacttctgttctcatttacttataattgcttaccacaaaagttatttgcaaatacttgtcactacacggatcccaaagcaaaattttccatttcacctttagaattaataattccattccactcagtcatacttattgtttctagagagtactcaactatattgatgattagatagcaaaaatccgacaaaacccccttatgtgaatttggctggggaggctagtcacgtgtaaacaatatagaaacgaaagaaccgatgagttcattaggatgtatacaagctcggaggtacaataccctattcttattatttgtaggattacccctatctgttatgaggatcttacaagtctattgattactcaaaatagttatgcttcctctcttctggatttcctaagaaccacacaaaatatgataaagtctcttttctctcacttccaaccctcctcgcttgtcctggttctccccatatatcttcaccagggaacacctgatgatcaaagctcgaggaaagatattgtttttctttactaaaggaaatatattgttcgtatcgggatcaaatatggtaagtcttgccaggatctcctctcattgcccaccccgctgcccttgggtatgccttggcggggtccaccatgaacgggatatggtgagaactcaccacgatacctagctcaatccatcgtggcctcgggtagcccgagtagggctcgatacaagtagcgtgtggcggtggcttgccatgcacccctactcaatccatgcaagcatgcgaggaatagggttcttcacacattgttggtcataggggcccacctatcaatgtttggtgaatggcagttaaagggtagggatcccgacggggttatgatagtcaaccactctctcccagttccccacactcgtgtaggcatacatggttaaagtaatgggcgacaattgcaacagttgccgccatgtctttcacgcgccttgctacggggtagacatccgtcttgtcgctaataaatcatatgatgtcatgggcccgagacatctcgggctacgttgtttcatgtctctgttatataaatggccacaggctacctcggggcccttgcgaaaaatattcacgcgctgtaaggttattttttgaaagcatgggcaatcccttgagggccaccctttagcactttgaggtggattcatgtgtcatctttgatcggctatatgtttaagtaattatagtaagggtcaaattatcatcttctataaaagttatgattccctatttttttttctccctagtcaataatagcaaatgaagaaaactagtacttcctccatttcacaatgtaagtcattctagcatttcccagattcattaacattaatataaatgtagaaaatgatagaatgacttacattgtgaaatggagggagcaatacatatgcagtatgatgctgaatatcaattatttgcctttgttagttatactttataagacttgttagtttctactttatgagattattactgttttagttgttttagctggctgattacaagatataagtatcatcaacagaacaatacacgcaaaatccacacgataccctcgtgtcgtgcctaccttggatctaatctaaagcccggatcaaaaccaagccaaaagcctagtgagcccagctcgctcccgttgatccggtgagcgagccctaatacttccagaagctcctcttcttcgccgtgccgaacactcgaatcgcatcgcatcgcaccacaaaccctcccccccgaccagaaagccaagaaagaaacctttcttcgtcggtctctctctctctctgcccatggacttctcggagcaggacgtcgaaatcttcggcgaggactacgacgacgccgaggccgacggcggcggcggcggcggtgcctcgtccggctcctcctccccgtcctcatcctcctcgtcgtccgccgccgggtcctcctcctcctccagcggcgcctccagcagcagcggcgggggcgggggtgggggcgaggacgaggacggggtcgaccagggggacgccagggggtacgacgacgacccgttcgacggcgcgcccgcgagggccgccggtgggtacggtgacgaggagaggggcgagggtgatgcggaggaggaggaggaggaggaggagagggatttgttcggctctgacaacgaggattacgtcaagacccccgcgcgtagcaactacctagtcccaggtccgcctctaatatttgctaaattatcgtgcacattttgggtgacaatgatcagtctctaagcatgtctaatcagtagaattaattagggcatttttacaaaatccaacccagttcttttggttgcgggtaagctgatcgtagggtttaggggattcagtgagcatgtagaaaattgcgggtttcacatgtatgtatgatgaattattcttgttctggactttttaattcttccttccactttcgataggcatatgatacgcacaatgtgtcttataaagtaacagtacatcatggctactgtcttctgcttgcaactcacttttaaatcgcaagagatgttttacaacaccatcaagcataattgttggagagtagccattgaacactgcctaacgataagtgttaggggctattggattagctgatagttacattgcactatgctagtatgttaatctcccgttttgattataggtagactacagttgaataacatctatctgcaaacgaatttgaagtataattgaagtgaactctgcagtagattacagttatgaagaatactgcatctgatctgatttcctctgtagaacaatttttttcacattcttctcaatctgccatctaactagaaacatagaagtttgaactttgaaagatcaaagttgataataaaacatgcataatttattgaaaaccttcaatatatgctaatcatatttgtgataggaagctccctaaaatcaatacgctatttgtgatgatttagtgctggaaggaatggagatcatgctaatgctttatgtgtaacaacttgatatctattgttggcatacattttatcaatctactaggtccattagtgattggtaatgcccatgcttgtggtaaagattgtaactgggttattttactggctatacgcttgatatgttggtgcggggcttggggcagctagcactttaaaatgtttgaattatctaggagggaaggttgagcttcaacactatatttcattccatgccttcccttatagtgctaccctcaatacggaacaccaacaatcattctcggggaggatatggggggcggaatggcagaggtccacctcttcttccaaggccaggaggccatccaggacggcataactttggatatggtgggaggttttcgcatggaaatgggcgtaatgttgaaggttttgtttcagaaatgaagcttaataagagtgaagaaactttatctaggaagtttgttgcttttcaggaggtgagtaatgataccatattcttttgatttttatatattatctctggtatctatgtatccaaatcctttcctattcatgcagccttctgagattgcatgctacagccgtattgagggtggggatgtatattttgatgaccgcagcttggtaagatcacagaattgctcacgatcaatttcactttccctttagttcgccatttccttaaagtctgtctatgtagtattacagaaaagtattgttataaatttgctgctgtactaaacatactgttattttagaggctcttcaaacgtaacatttgcgactatgttggtgaaaatctcaataaaggatttgaatcttttatagagaaaagaggtaattccatcaaaaactcatgttttctgtttttatgttctggagtactccctccgtcccataaaaggcaaaccttgtacgagatgtgacacatcctaggagacatgtccaaattcatagtactaggatgtgtcgcattccgtactaggtttgtcttttatgggacggagggagtagttgatataaagagtactgttaaatgtagaaattgttcttatctctggtattgcaaacttctgtttcaatcatcctggattaacttgtccacatttatagaaagttcatgacagcatggcaccttccactaattttacttggataatttattcttccttaaaaaatggcatgagagaaaatacataactactaattagaggttctaattatttctcatagagccaaaagagaaatgaaataaattattggaactaattaacccagaagttctttttttttttttggaatgagttgaatcctacatgtggatccagataaacagtagttctgttatttggaagttgttctttccttttgaatttattttcattcaaggggactgtttcatgacgaatgtggtttaattgtcaatatcagatttgggttcagaaggatttggtgatcttcttgcatgcataagaaattcaactgtacctcttcagaacatacattttgtggtaaaatgctgctgtcaaccttccgttttctattttagtactctatgcatggcacgctgatcatgtatgatgctcttcttgcagacataccgcaacaatcttaacaaggtatgatccttctagttcgaactatctaaaacaaactctgtcttcccctcatttttgtagcatataccactcgttttgttcaatatgcttgtatgtttatagatcgatataacaactaatattgttaccagatattggccacggcttatctaagagaaccatggaagatgggtgtgcacaaaagaaatggtgttgtatacctggacgtccataagctccccgaaagaccacaaagtgaggttgaacgccggaggtgattctctttctctgaatgcttcattaagttgatgtatatggtgatggtaatactgttagtgatgctcgttaaacgcatttatgttgggtgatagaaaaagttgatatctggtatggtaaatatattaatggccttagtttatactttatacgtgaattgtcctatagagattctactttcacaagaaagataaatggagattctcttttgaaaagtgttcctgtttatccaccatcagttatttatatcacaaggatatcttgtccaattttatttctttatgctgttttaattcactggcaaactgatgtaacaagacatgcgtaactgttagattccctgggaagtttgacacatgagattagctgtatcttcactcttgctctgtgcatgtatcatgttgccttaatgtttatagtcaattaatcatatgctcagtgttgttattatcgttacatgggaagaatctgaaccataatactttttttgtgtgccttgtctttatctctatatttactctcagatgttattggggatattcttttgaaaatcttgcaactgagaattccattgatgaggatggaagaggtattgatgcaaatgtagagttctgtgctgtaataaaaacgaaattgggtgcacatcgtattatcatgggtgctgagatggactgctgtgacgcaactgatgatggtaggcggttctacgtggagttgaaaacaagcagagaggttagcattactttttttttttgtgatttgctttagtttgggtaccacatttatttgaaatactcagtttttgagcctctggcgtgtaacagctggagtaccatacagtggaaaaatttgagaaagagaagttgcttcgattctgggtaaaattttagtcctgctgtatttcttattctccattcaattcaatatcatttgtaacttactgctctgtcctgcagtgtgaaagtttattttgtgttgtggttcattctcttagaactcttttttaatcaatgtctaacgctgctatttgcttttgttaagcactgataaaaaacactcaattgcattgtaaagcaataatgagggtagggatgcgtatctgttggcccatgggtaccctttggctcaatggtggagccagggaattcttagagcctgagtgaatctaactatgttagatatttgttaccaaaaatcaatttaattcctagagtaatataaaaagttagtgtacgtttgagttttgatgatgagagtgggctgccgcccggcgctggccgctgggtggtggctccgccactgctttgggccattcaacccagccattggttgcacttcaattgctagttcatattaggtacaaaatgtaaaccaaatgaattagtgtttagctgatgggtatccatggtcaagtggtcaaccaacttgcatctttaactgagagtagatgataaggtagcaatcttgttatgactctgtctaccatgagtccatgatccacttagctgccttttatttttttcagaaagtatgcatattttaacttctaacattaactttttttctttactaaatattgcagattcaatcatttattgctggtgttccatatgttgttgttggattcaggtagtattcattctttattgttttcccttacgccatccattttttgtagtcaatgtgatgagctttctatcacctgacagctggcatttttgcaatggaaaatgattttcgtgataaaatgtttgctgatacaatttacatgttaaagaagctgtgcaatgttagtattgggccttctgcttggctaggagattgacatgctggttatcacaaatcagtatgccactatggttgtcctctacaaggaacaagagtaatttcatttacacctggtgtcatcaactgtgtacgaagcaagctcatatttgtgatagtcagtcgtttctcatggatgtcctgttgcaataaataattgtgctgcctacccaacttttgtggggctaaaggctgctggtgctattacaataaatattttattatttggtactaaggtatatttttcccggtacgtgtatgctcattttcgagttaattttgtctaaataattacaacacgatttcatcttcgggataccaaatctttgtgtagtaaactagaggttcatggagacatggactatttctggtaatatactgatatgtctccatttattgattgtaataggcataataacttaaacacatacttgattttctagattcttcagttcaatttgtttgactgcatcacatgtacttgataaaatcgtatgcttatttttaatacaatgttctgatttggtgtggtattttgctcaatatttaacctaccccatatgatgcaaaagaaggcttttacttttttaacttcgactttgtcccaattttacattgattccagtggcttgtatttgtaacttgaactagtacccctcagcattttcctactaataaaggagtttcaaccatatattttttttacctgcaggaatgatgctggtgtacttatacggactgagagactaagaaccaaagaaataacacaaaaggtgaaagcgaagaactactggcaggtaatcaagctttcttcctagcaattttaaaggacacatgcctagatagacaactataatttagacctatcagcaggttaaatactggaaatgtgaatcatctgtaactctagactcccaaaggacgtgcttcctttgcaacaatttacctgctatgtaaaatatgtgagattagattgtctaaataagtagttctcaattaatttcctgccacttcaagcataaaagggataagaatacaatgtacttatcttgaaaataacaataatatctgatatccgtatgtacttcagggaggtgtttgcttggccttcgctgatgaggtcttatgctggttgtatggcactgttagagaaagtaagttcatttatcattctgaatatctaactagttgcattttctcaaatttttaaatcacggacttattggcactcataatcatatgatactctctgtacgcctgacattgcttttttccatctcttacagacgaggactacatcctgcaatttgtacatccattcaatcgcttggaacttctacgtgcccagtctccctgtcctgatgccatcactcatcatgtggagcagctctctggtacagcaggctaggttaattcgtacacacaacttcggcaagtaaaagggctgtttgaggtagatccgtgttgaaggattctattctaggggtgctgactcttaaacaaaacttcggcaattatataatggttgagctgacgacttacccagccaagcaacataggccgacgactaaatggtttgctctttgaactgccaaagagattttgaaattgtcaaaaccttgtgtttctccagtaacattaagttataaattagggaaatggagagctatgcggcaatgctactactgggtcatgccaccgaggcaccaatgatgtaactctctaccagataccagtaccaagggaaatgatatgaattctagagagtttctgaactaacatgtggtatatagctttattttgaaatgctataaattgagaatattaaatcgtcaagaagtgagaaacccatctgcaccccagcactccctagagcagagcatgacattttttgggttagggcctgtttgaggagtttatgtcagctgaagctttttccagaaatataagttctcacaaaccaaacagtctagcttctcatatagataaggccttctcatctagataaggtcgtgtttagttgcaaattttatcttcaaactttaaacttttccatcacatcaaaactttcctacacacacaaacttcaaacttttccgtcacatcattctaatttcaaccaaactttcaattttggtgtgaattaaacactttcaattttggtgtgaattaaacacagtcttatgagaagatatgagaagttaatagttaaaatgaacttataagctactacaagcaagctagttattttagcttctttacattttcagaagctgcctactagatgatgcaattgactttttattaaacgtttgaccattcattttatttaaaaaattatggaattataatttatttttttgtgagttgttttatcacttaaaatattttaagcatgatttatatattatataatttcctaaaaattttgaataaggcgaataatcaaacatgtgttcaaaagtcaacaacattatctattttatagagggggtacttatcagctgcgttctataatttatctattaatgggctgtttagttcccaaaacaaaaacttttcatccatcacatcgaatgtttggacacatgtatggagtattaaatgtggaaaaaaaaaccaattacacagtttgcgtgtaaattgcgagacgaatcttttaagcctaattgtgtcatgatttgataatgtggtgctatagtaaacatttgctaatgatggattaattaggtttaataaattcgtctcgtagtttcctagcggaatctgtaatttattttgtaatattactacgtttaatacttcaaatatatgtccatatatccgatgtgtcaactaaacctaaaaattttttctaactaaacaaggtctaaccagtcatttttcagaattttaagaattttaagctctcctaaaaaggttctaaaagccttgtattccagttgcgcgtctgtcgccttggcagggaggcaaatctaacgttcgcttcagttggattttccaagaagtattttgccctatttttgtgttaaggtgccacgaatgcgagatttccaaacgggaaacatcttgattcccacaagattgatagaaaagaaaagtcactgatctacgcatcttgattcccacaagatttaaaagaagaacaagtcgttgatctacagtatatatagtactgcaaatttcacaatttcacgggaaatatttcagatcccaaaaaaatggggaaactcagccatcgatatacgctcttattatgttgtaaacaggagcattgtgttcaaaccgctcgataattcaaccatgttttttttaaaaaaaatctactaataatttatttaaaatttaccagttttcatggatgacttaagggttattgcggttattgataaaaccatgaatatgttcatcgtaatctttaacttgttatagttttgattgaggggttgttagaagattaatggtttgcataggatatatggttgtttggttagtgtctaagtttaccacgattaaccttaggccaaacgtggtacggcgaaaaaataatacacccatgaaatagttggtcataagtgtgacaatgttttgccaaaacaaaataagtgaataacttgcgatgggggagaagctaggatttggagattagggggacaaccacaaggaatgttcgtgtggtttataatccattttaggccctctttgtttaggcttaggcttattgggttagacttttaagtcagcttgttggcttatatgatttataagccagtgaatttaatgtcctaagtttagtggtggagtcatacatctatctcatataagccaaaaaagcttctccaacctagcttttggcttaatagtgtaagagtggcttatggttttaaaaaagccaaatgaaaaagctgcttgtttgtttaggcttagactttttgacttataagcctaaacaaataggaccttaatgcgatgcactattcatactctgcattgatacctctaaagcagaggatctgaattcaatggtaatggcttctgatgatcgctatatattgaagggtatttaaacacacggttagtgcggtaatcttacggtatacctagctgatttcaacggtaatggcttctgatgatcgctataactgtgcggttttcacgataaccgccaaaccgtgggtgacgataaccacaccctagatcacatcagatttcttacagttataaattctactacctccattcccaaatataccagattttagttagatgtaatatattataatacaacgaatctggagagaagcatccaaccaaaatctcttatctgtgcgtttagttcacactaaaattagaagtttggttgaaattaaaacgatgtgacagaaaagttgaaagtttgtgtgtatgaaagttttgatgtgatgtaaaagttggaactttgaagaaaaagtttgtaactaaacacggacatatatatatatatatatatatatatatatatatatatatatatatagggacagtactaaattatatcgggaacccttgtcgcaaattgcagtgctagctgcactaggagtacaaatccctagtacagcgtagtactccagtcgccggctcgccgcacaccatcgcccatcagaccctgccgccgcggtctcttctcgaggcctcccgttccctcttcccggcgagctagcgcaccgcgcgggagagaaaggagagcaaaaaggatgggcggcggcgagtgcaggagcaacgactacggcgccgccgcctactgggacgcccgctactcctccccttccccctcctccaccgccaccaccggcggcggcggcggcgcgttcttcgactggtaccaggcgtacccggcgctgcggccgctgctccgcgcccgcctccccgcctcctcccgggtcctcatgctcgggtgcggcaactcccgtacgcctctactacctcttttacctgcgtgccttcactcacactagcttgaaactatctgcgtactcaaattcaacgatttcggcgctaattcgtcgcgcgcgccacatatttctgggaatgcactggagtagtagattaccctgttgcattgttatactaattatacggtcacacctatccgttgcatgatgcagtttgatcttattttggcagttttgtcggaggacatggtgaaggatgggtacgaggaggtagtaaacgtggacatttcatccgtagtcattgagcagatgagggagaaacacgttgatattccacagcttacatgtagtgttttcattgataatttcaaactcatagtttgtgaattatggtttctatgcaaggtctatttacttggtgtcttgtgttttaagatttccagatggatgttagggacatgagtttgtttggtgatggaacattcgattgtgtccttgataaaggtaccttaagaattttatttaccgaagcttgctaatgctcttgtggaatacttttttatggaatttactgaataaattcatttatggtatttgtttatttttcaccactacacttaccttgttatgacggaattatggaaatttctgaaggtacattggacgctatgatggtaagctttacttgttgcacaaacaacattttagctttctgatcaggcatgaaatgaaaaatcatctgaccattattgttgttgcatttgatcttactattttagtgtggcgatgatgctcctcttggtgcttccaaaatgctagcagaagtggcaaggtgtctggcatgaaagtttatccttttcactcttttcaaactagttggttcccaatgattcagtatgtttcatgttgaactatttttccccttgcaggattcttaggcctggtgggatctacatgttggtacatcctctaaatctaaacaatacagtgtgtaatcattttgcgtgggatgatcttatggagcgatgatgttcttttgcagataacatatggttgtcctaaggaacgagtgcaacttttgtaccaatctggaagccacaaaaaaattgaactgtacattatgcgtaagtatttttcttatgctatttcttgattcatggagctggacataatttgaaattccagaaggaaacactgaataatggggagattcaggtttgactgattccaaagggaaacattggttccaaagattggttgattctaatgggaaatcttaaaactttgatttgacgctatgcttttaatttctcagttggaccctgataaaatttactgttatcattttgcagccacacctggataccagttgaaatggagcaaaggtgtttcacttgcacaacctatcatggaggaagtttcattgacagtggatggtcaattaccacctgactatgttcttaaagatccagagtcacattttatttatatttgcaaaaagccagatgccgctaatgaagctaattctgtggttgctaatgaaggggaaaccataacttcaaaatgatcttttgtatccttaatttgcattttgttttgggttgctgacgagccttggatagtatgtgctcataataaattttgtcagatgttactgttggatgaaaatcacgaccctctttagccgcctggggccccaaaggttgccaatctgtgctcgatatttcttctcggaacttggaagatgtgacacaaaattcatatgtatttcaatatgctttggaaggggccagctgagttgtgttaagtttgtttaaaacgactgagttcctctttatatcgacacccataacatcagagtgattttgatgtgatcttgttattctgagatggatcatggaacactgcatgtctgtatgcagtgtatatggaatgatattatggctgtgtttagattggcccaaagtttgcaatttggttgaaattggagacgatgtgactgaaaagttgtgtgtgtatgaaaggtttgatgtgatggaaacttggaagtttggaaaaaaactttgaaactaaacataccctatgcaaactgaactccctgggcgattagacattcccgactaatgctcggttaatccccgataggaaggaatcagaagggattgagaatttgagatccttctcaatacctctcaattctccactagttacggaaaacgagagctcatcatggtatacatttgaaggggagcgagtgctttcaaaagtactttaaagagaatcgattttgaacttaaattttgttacaagatgaaaggagcatagtactagtatgtgagatcctggtttttctgaaggaggtccagtgcacgcatccggtatttccctttccaaaaggcccaatgctgtaccgtcgaactcgaacggtcgggaaaaaaaaaagaaacagaagaaggccgaaataaataaagaggatgaaaagaaaaataaaataaaggaaaaaaaaaagcgcacacaaggacctcccctgtgccaagcggccgcgcatcgcagccgagacgagccgccccccgcaccgcactctccgccgccggcgccgcgccgacctcctccgccgcgccgcctccccggcgcgcgcccccgtcaccctctctcgcctcgccgccgccgccgctgcctcctcgtgaggggggacggtggtgggggcctctgccctatggcgagcggcgacggcggcgacgacgcgggcgtgaagcgcgtggcggaccgctacctgaagcgcgaggtcctgggagagggaacctacggcgtcgtcttcaaggccgtcgacaccaaggtccatctcatcccatcccatcaccccccccccccccccacttctcccgctcctaaaaccctcaccggtgcacatcgtcgcgcgcgccggggggcgcgctgatctgccgccgcctcgagaaatttagtcgccggccggctagttcgggccctccggctcgatccgaccgcccggtggagaggcgggtggtcgggtgatttgagcttcaagggttttgttcccggattgtgaaattgcgtcagtgaacggatggctagagctgttctttctgcaggggcagtctaggttggccacccatgagccgtggttgagcccatgaatgcaattcacctggttttgttcactgccgtgtggattgaactggaggtgttgacactgtgagggtgtttgagctgtggttattgttttgccatctcttcttaagcaaatcgcagtttatccactctgatgggaggggatctgtgggatagcagggtttgttgtgtcgtggactcatgtatctttgtattatgataggctatatggtgccagcctttcactctacagattttgggtgtgctcctagtgcttttaagttttaagtttattacatcagctgtttggaatgtattgtcgtggaattttgcttcttgcttttgttaacttttattgatatcatgaatgttcttcactttgtttgagttaatgttagggttattgaacttttacatgttccttgttttcagactgggaatacagtcgcaataaagaaaatccggctagggaagtacaaggaaggtgtcaatttcactgcattgagggaaattaaacttcttaaggagctgaaagattctaatattatagagctgattgatgctttcccttacaagggaaacttacatcttgtatttgagttcatggagactgatttggaagctgtcatacgagataggaacattgtattatctccagctgatacaaaatcttatattcagatgatgttaaaaggtttagccttctgccataagaaatgggtgctacacaggtatccactaataatcttgctaaatttcttttagagagagtatcctttgacaatctgtgctgtagggatatgaaaccaaataatttactcattggcgctgatgggcagcttaagcttgctgactttggtctggcgcgcatatttgggagtccagagcggaacttcactcatcaggttcttttttgtggaattatatttattagaatttaattctctgtataatctagtcgattgtatacttggaacttgagaatcttgttgctgaaacaaatatgcaatgaacatttcttcaagtgtattgatgtttcttttgtatttttttaactcggtcgatattgctgtttgatgcttcgttgttctgtttatcaaaaagaacatccttgtggatattttgcgcccttatgctttacccttttttcaacaacagtaggcacctaggaagtagaaaagcttaaatctttatggatggaacaaaatgcatgtggggaagttcttatgttatttcctggacatttgagttggcagagttggattttgaataaatgtcacaggatactgatttcggaagtatgtgtccttgaataaccattttcttggtaaatattaatagtgttggaatgactgtttcattctgaattatttgtgctgattttcattcaccatcatatctggaggttctcttaaaccatctttttatcagttatgttgacgatagtcaaggatcaatgctacacttattacagcaatgctgtgtgctttgcttaaatgagtgttttttattttttattagtttcactttgaatcatattatcctgatgctgctgggcacttcagttttgaattttttttctcaacatataggtctttgcacgatggtaccgagcaccagaattattatttggcaccaagcagtatggatctgcagttgatatttgggctgctggttgtatttttgctgaactgctgcttaggcgaccgtttctccaggtttaaccgactcttataattttatgctctgtgtaatttcaatctatttataactaagcactttttatgctctgagaatgttgcatggctaagtttgctgttcctatatgttgtgataactgcatgcgtaaatgtgttacctcaaaatgttgtttccaaagccagattggacttgtagttttcaactgaggaaactggaaatggtcaggctctggtgaggtgattgaactgaacctgtaaatgatttaaactttgggtttaaatttgacaaagtgtttcaatggtaacagtaaaaaaattcctctgtggatttgaacctttgtctgtagattctggaatagaagaagctagttcctctgtgcatgtagttgatattagatttatttaatgagcacgttataatagtctagcactggtaggttcacgcaaattaagcctcgctctagttttagacttcaatataacaaaattatgtatgttatgtggggctgcatgtgcagccgcctgtgcatgacagttgccatgctcttcacaaccaacacaccaactatgttggctcctccacaagtttagtagctagatcatttccactgctagtttgtttgtttccgtaggattaaattatttaagggcttgcctgagaatatgatgcaagctgaaagttgtcccacgatctctctcctaacgccatggtgttgggcgacaaggtgtcacgcccttgtcctcttgccatccatcagcacaggtattatctgactgactcccaagaatcccctgaaccatgtgacaatgtacaccttcacaataatgttatttagagaaccagttagatcagtgaacagacgagtcatagtattggctgggtcgatgcctgcaaacgaccagttttcatgcttgaggtcattgtttactatatgtgaaatctgccattagttgtttacgagtagttttgggtaaggaagctacccctagaaatctgtgcatggggagaaaagggttggactttctagattcactagggtattgtttgtttctttccttttctatgttttttggaaggtagattttgtggcatgtgctcttaggccttactttcaagtgatagatctgattattctcttcaaaactattttaggtagaaaaatgttattcctttctccagtcttatgggatataggcacttgttactaagttcacgggtttgtgcttgattttaagcttattgcctgagatttggttaccctggctacttgttctggccatacatattttggccaaagaagggttttcaggttatcacaactataatgttctgattactggtggggttcttttagcattgaaaattaaaactgcaattccttgttattgttttacttgaattttttgaacatggtgtttttttttttggattagacgcacggagaaaacattaatgcacatgggaggctagataacatgaataaaatatggacttgtggtcttgtgctaaatgtgcataattctttttcactcaactgaaagccttcttaggccagttgtagaggtttaatttgttgcttctggtcttgctgcaggtcctcttgagtttcctgattttttatcttgtgtattctccagaaatgtggaatcatggagttgaatattcttgtgttgatttattttttattggttttttttattataaatttgttttctttatctatacttacaagtcaagttcttagatgcagtagaggtgttaattccattttaaggaattttagatgctcatctaaatttttcatcatgtatgaaaggcttttcatgtcactatccgtggttttctttgtgagaggcagcaattggttgaaaatattttgatctatatctaactatggttctctatttgattttcaatagacaagttgtttgctttctaggatcagatctgtctgcagctctaagtaaatgctctactgtcacaacttcttcatttcttacaaatcaagtgatttgtaaactttgggtttataacctcttaagagagcattgctgcatatgtattttgtaagcgttgtttcatcagtatgcctgatctttttgcatgtgtgctgataagagaaggttggaaaatgtgatatgatatttaacagtgggcagcaattttttcatttggtagctataccttaaaagctttaatgggcacccaagtcactaaatgttaatgttgcagggttctagtgacattgatcaacttgggaagatctttgctgcatttggaactccaaagtcttctcaatggccggacatggtttatcttccagattatgttgaataccaatttgtctctgcacctccacttcgctcattgtttccaatggccagtgatgatgcattggatcttctatcaagaatgtttacatatgatccaaaagcaagaattacagctcagcaggctctagaacaccggtatgcctttgttactgatcaatagaacatctgctatctatctctgttattagtacatgccatataaaaccatgtttatctttcctattaaggtactttttatcagtaccagcgccaacaaaaccatcacagcttccaaggccaccacctaagggtgattcagggaataacaagataccagacttgaacctgcaggacggccctgttgttctgtccccgccaagaaagttgcgcagggtgactgcccatgaagggatggaagtccatatgcatcgggcggatagaacagaagagcatccttcaggggcaaggcacatggatgacatgtccagccagagtttagaataccaatgtcagttgatgttggagctattttgggacacgacctgctcctagaccaacgttaaacaggtaaacgacacaaaccttgacgaatggaaatttggaactcatgtccttgtctaaatgaccaatgaacctaataatggaataaatgatgcatttaggattgggtgtgctcagctcgcccattctgtggaataattgaacatatttatttccattttgcagtgccgacaagtctcgtttaaaacggaaacttgatatggatccagaatttggatacacagagtaaatcaccattttttccatactggcttgttgatttttaaaatattctttggggagatagttccactatctaccaacaaaagaggattgtgtcgaaagccataaaaacttcactgaagggcgctgacaggatggcacagccaactatgctgttatcgtttttgactaccaaagccggctcaggaagaggaaactgaagagttacgtgttacgatgctaatttacaccaggacgtgcacatgccatttcattttggctggcatacataaatctgtaatctttattgcatagatgagtttgcttgtgtgagcatgtttcttccagtgttcgcaaagattattatgaagtttatgtctcaagttctttctggtgtcaattttcgttcacttcttgtatggacattgaattttgattgttgtttagtcggtcatcttattcttaggtacagtaattcttgtaaccaggagcggcttatattacctgagtattctgacacgtcttcctgcaatacgctgtaacaatgcatgagtgaaaaaaaaaagagaaaaataagagcaacttcttttgttcttacgatgaattattatgtgattacgatatctacggctttctaatgtgaacattttattatcctttctttagatgtcttctatactgaaatttctgtgatttatatttgtggaatgggtaaatggaatgaaaatgtttctttcggacttctggcttcaggtttgcaaattagcgcaacttctgtgaaggctcagcatttctgccgtgtagtgaaccgggtgtacaagaattgtttcattctcttttttttttcttcgaaaaacagtaaagatgctcatatacacgtgtggtagcttcaatttgcaattgattaaaaacattacatgttgggtgttcaacgcgaggatcaaaattcaaaattcattgaaccttatagagttgtttttaaatctgaaatatattagcgttaatcggcttgttacctcccaacatcaaccatgtttagacaagcattaatgttactcgggcgtcggaagtgatggcacaaacaaaatagaaatgacggtccataggacatgggtttcgaggcatctcatatgaaaagtccatacgctagaggacaagttgccatgtgaaatggacacttttgctaactttataactgctgtaataaataatgtgtgcagtatatgcatgtgaacttgtgatagtaaatggacctgactaaatggcgtgacatgtggcttgtacttgaatccatattactttatttatctattatatagaatgtggcatgtactcgaatccatataatatcgtacaatattggttatttatggtattccatgcgtatactatgttaaattactgtaataaaaatattttctaattttac

SEQ ID NO: 67923 - DNA, 3918 bp, Oryza sativa
aatgcggcagtattagcgattgtggaaccaacatagagagtcgtatgatatgataagggcaccatggtgtgaagagtggcaccgaggctgacccaaggcgtgaagcgagggtggaaatgaaggagaaaccgtacctggcgcgcggagctagggttagggtttgcgggcgagaagacggggcaggggcggagcgggtggaggtgcgatcgaggggagaaggcagggaggcgaagggatgagtgggcggcggaggagggcggggaggtgggcggtggaggggggcgggggtcgccggaggaagaggaggcgggaaggagagctgcgtgcctgtatgtatgtatagcgcgaaccaacaagaggagaagagaagagaggcgaggcgagaggaggggggagaggagagggcggccggccggcctgtgtctcgctcgactcggttcgggtcgggtcggactcacactcaggacattttggcagggctccagctcccagattcaacttatttggagctgaagtccaaccaaacggttcagatctgttcaaatctggagcggagcgcatggaatcgctaactggtgggttggagcggcattttggtcgctccttaactccaactccaaccgcgttatagaattgcccacatattttcgatgaaattacccgcaaatgccatcgccctacccctcatccctctctcccgtaccgcttcaccccgtcttccccaacctccatctcgcgggagcgaggaggcgaagcagcagacggcgcacggtggaggaggaagcagccggcggcaacgacgcaccggctggaaatagccggcgcatgggcttcccctttcagtgtcgctcccctccttcccatcccggcgcacagcggttgagggcgagcatggcggcgcatggcggttaatggggaccacaggggcgcacggtggctgagggcaagcacggtagcacaaggtggatggagacggcgcaagacgaccccaaatggcggcacggtattttctcccaaaccctaaaaatttccctcacctcttcccttcagatttggttgagtagttgttatcatgtaatgagcaaatggggaagtttcagatctgaagacttgtctagtgatgaatggtaaaaatgcaatgagcgattgggatgtgtgaaatttcagagcagtgatgaactatctagtaacttttttttgtttagtgttgtaccttgtgtttacaattatatacacacttggttggaattgagcatatcagcaaatggttatatacacacttggtttagaattctttagtataaaacctggcagtggaaagaatgtccttttatgggaggataattggattgggggcatacccctggctgagcaattgggagaaaaagaatagggaggaagctatgactttcaattctgtgatagatttgaagctatacaatatctttttatatattgtccttaattgattcatggggtgttttgcagacctcgacggaaagacaagtcacaagtgagattttcaaatcaagatttggttagagggcacctctacaaaggattcaagattgaactgccagaagtccctttttttttgccgtcatcactgttgtccttgctttcacttgttagtttttcaaatatgtgataccgagatgtttcgcaaaggttctgttggatgtaaagtagcagcacaaaacttcagtgggttatgagatgtcggtatgactgagagactaaaactattgttggtttttttgcttggagctgacctggactcttgcttgcaagcaaggccttgaacttattcatggatggatgcattttaccttgtatacggagcacggcaacagcggcggggtcggagcacggcaacgacagtggtgtgcaaggtttccagatctgtgtggaaggtatctgcatggcaacgatgggttatagcatttcattttgcaggttagcagctggtgaactgcaatctatcaagatttcacgcctgccttcagttttatctgttagctaatgacagctagtgcacctttgtgttttttctgctctgtgtattctgctggtttgtgaatagattactatgaatctcttggaaagtcattgaaaattgtctggacctttattaaaaattgtttgaacctttatcaaaaattgttgtaaattcggttcatcaatcatgttttccaagtgattatctgtgttgtgattctgcatgtagcagctgcacaaattgtgatttggtttgatatcttgcaagagagaggccaatactttcaggatgggataacacaaagcattcatgatgatctagctggtcatactgcacgatgatagaccatattatatgttattttgtggtcttttgctctatcttttgatgataatgatgctacaagttgttaaacatttatattactaaggaaaaatagcatattaatccttcatgaagtaaacgacaagaattacaagggtagtattgtccatctcctccctatcctctctttcagaaatttaggagctgaccaaatgagccaaacacttttacatcatctctagctcctacaagagctagctccagctggagttagagtttggagttaggatctgagagttggagctctaccaaacaggccctcactcttgtgactctgctcctccgtccaatcggatcgatcgcctctcgtttctgccccccaatacgaccatcagtattgggccgaaacggtattcgcttggatcgaaagagtccactttcggtcctcaccaactatgactcgggttttattaattttctgaaatcgggtacagagtatccctcactatcaaaaccctctacagtttatcctacatggcacgttgacttactctttgtccgacataacatttacgtatcagtgaaaaaatataatgggacccacatgttaacggtaactatactacaaatatttaacctacatatcagtcatattgaggggaaaaatcatctctctccctatctatctccatccaagcgagaggaattatatgcatgggaggtagaggtggatctgactatagtgatggtgggcggagacgctcgtcatcgaggttgatgaggtggtgggccctgcggagatcctggttgataaggccaatagcaatgcaagctacgccaaggatgtctctagcccaattgaaaataagaaaccggtcagaggtccccgacgccacagtgcaagtgacctttttgcattggggtgaggtgatgacgagacggagacacgaccccacagtgcaagcgcgactgctttgcaggctgcgcgtggactcgtgacggcgaaagcacttgttgctctgtgtgggggcgagatgctatgtaggggcacacagaaactcgccatgtaggcattcatctgagctggccacacgaagaaattcgccacacaagcgcaccgtgaaaggactaatgtgctcaacgtagatgaagtggttgatgcagtagggggatgacaatggcgcctaactgctggaagccgtattggcgctataagacaatcaatcttatattgaaactaatttagaaagcatatttttaatagtcttacgatttaatgtgcaccatttctttcgctattaaattaagccttccagaatcggaattctaaaagtataataaaatcttattcgttaaaaccaaatatgtatgatcagagagagggagtaattgagaaagacttgattctcatcagattgaacaacgatttcggggaatttaactatttgccacttttagattgggcaattatccaaatgccccttttaagtttgcactttttttttgcccctctttatgagatgtcatcttaactatttgccgcttttgcccacgtggcatgtcaacatggcaaggaggggagaaaccgatgtggg

SEQ ID NO: 67924 - DNA, 10395 bp, Oryza sativa
tacagtaactcatcaattgaggtcatcttattctagtgcaaaatctacacatcatgcaagtgaaacacatgcttatgaggcaagggttgaggatggtcaattggataaaggttttacctctatccatgtagatgaactagataacagtggcatcagtccagtgtgtgctgtagaatctggaacagtgtgcacaaatttggtggatccacattgtgaagaatccatagatatgactcataatcatgcagatggaaaaagtaatcaagttgatatgaaaaatgttgacgagcctcaagatctggacactagtagactttctaacaagggtatcaaggaaagtgttcagttggaaggtttcatcggttctacttctgttaaggaaaattccaatcatgtacaacctgaagtaagcaccactgttcctgttaaagatgaatcagaagcttttgacagtgcaatagttgcacagaaagatattgtctgttcgtctcctgtccacagtatgaataaagaggaaagtccaggttcaaagggaagaaacagttgtcttgggaattctaactctatccatccaattgttgtacgccctgtcttgcctaaaaattctctacctgaaaaatacagctctgatatggaaactgaaattaaaacatctggagagaaatctggaccaaatggcacaaaaggaacatgaagattctatccttaaaaaggctcatcttatagaggtatgctggtttatgtatttttctactatgatgttaatcttgttctgaaaagaaaggaaattgtgtttaataggtgaatcttaagagggctggtgaacgatctctctataatatgtctctagagaagaggacaaggggtcactgggattttgtccttgaggagatggcttgcatggcaaatgatttcatgcaggtattttctgaattggtctctgattttgtttttccttgtgctattcttagctaaagttcatccttgccaaaattcttgcgccattcttttaagagttgcttacataaactgtatactgtttgtttgtttgtatttaataggagcgcttgtggaaaaatatggctgcagctcgggtatgccattgggttgtgtctaaaggaagggcaaaatttgaggaagcaatcattcagagaaagcagaaagctgttacaagaagccttgtaaaaggtatcatgagtttttggcgttcagcagaggctttgcgaactattggtaggacagctgttattcaagaacacaactcagatatgctggatacgacaaatcatactggtttgaaagctgaaaaatctgaggtaaacaaattgtttcacataaccttttctgaagggtgatagtgtatttgtgctcatgacatcacatgtgttcacattttagtgccatatattgaaggatgttgggtacttagatgttacaaaaaaaaaatcaggagttgagtacactagtcttatctttgccattttacctgctaaaatcatgttttggcagtttaattggtatatactttgttatagcaagggcagatgattatgctgttgtctgtgaggttgacacaatcttggatttgaacagggtaacaaatcctcggaagcagaagagcctaactatcctcgccaatctcgaattcaggattatgcagttaaatttcttgaatataacagtcagacatctggttctcttgtgttggctgaagcaccaccaactcctgacaggctaaatgactttggtaccttgaaagtgtctgatctttcagaagtaaactactgtaactttgtgcagtctttttatgattgattttttttcatcacttttacttcaagatatctcgtactaacgccctgataaacactcaatagacacacttacctttgttttgacaactagaaacatgcatgaatagtgttcaacagcggttgtttctgatccttttgttgaatttcagggaagtctcttttatacagtagcacctagtgcaatgaaggtatacagggagtctgtggaatctctttctgtgcatcataaggtgaagagagttttttctaatgaacatattatgcatattatatttctggtatgcagatagtgtgttaaaatgctggatcacaagatagactggcattatatgtgtaaacaaacagaaatgataaggtcgcctgtattttcacataggactcataagaatattgttggcaatagaagtttgaaatgttcccactgctgtattaaaatatttctgggctgctggcatatgctgcatttaattatcctgttgcttttgttctgtttggatgtactgtactgcatgaacgccaaaaggaacatatgccattttatttgctttttttgccatttctttcatcattactggcgcactttgctttttccatgttcacagtgttggcactttctgttgtcaaatactatattgatagtgttggtaattgcaaaagactggttacattggtctcaaggatgactatgaggcatctgggtgtgactttgctgcaggtgatacttacctgtgccctatgttattaattcctattattatgtctttactcctcctaatgctttacattttgttctcagatttgcctcaggagaatgcttatgaggatgaaggggagacatgcacttatttaccggaagcatatgatggtggtttgttatcacagatgggccataggaaacaactagggcagcagaggattaacggtgcaagatcatatggaataagtactcatgtgccttttgaaccatatttggaaagcaaattatggaatggaaaaaggccttcatctttccttgcagttcctacgaaacgcatccgtacagctgctagacaacgaatcgtaagcccataccctgctggcattggtggaaccacccaagtcacaagtaaaactgatgtttcaagtggggacacaagctcctaccaagatgatcaaagttcgttgcatggggggtccttgccatggaaaaatacagacttcgaatcaacagttgattttgacagacaattgccatatgatggtagggaagtggtcactaaagctaacaagaagaaaaagcttaagaacccaggatataagacttctcaaaatgcagccaattcctgtgccttggcttctgcaaaggttaattctttaagcatgctttcaattattgttgttttcaatgtttgtccaagtaaatttattctcctattgcttcagggccgtatatgtgatcaacgatcccaagctgatttctttactcagtatgaccaggtttttttttctctttgttttcattttcaggttcatttaatgatgctatttagattattttgcaattttaatttgattttaataccatttatgaacattctattcagaaggactttctgaagaagaaatcagactctgaacaatttgattcaaaatggaacattggtaccttcaccccctctaattattgtgcttgtaccctgtgtcatacagcaatcgaactatttgctctatattttatttgagagaaaacattaagtagctcttaacatctcatgtattgatttttattcgtagcttcccatggtggtcaacatgctttgaagaagcttaaattgatgaggcaagggatagatatttcacaggaagcttctcctgttgcatcacagatgagtaacatggcaaattctgctaaaattataaagataatcaccaatagggatcgtgggagaaaaggcaaagcactgaaggtactatgatttctctaactactaccatgcacctttctctttatttgcataagcatcatagttttgtcagtggtcgaagatgggacctttgatctgctgtgttgcacatttttctgctctgtatacctataatcaagttagaaattaagatgattcttttgtcatgtcatgttcctctttccgtgagcaatagaccagtaagctaatttcacctagggcctgtgttgctggttggtcaagatagagagacagactcagctcaggtcaagcaagcaggtggaagtagtaaggttatagttatttcagttgtatggctggaatacagtgaataatgttgaaaagggttgctgatatccaaggaaaagctgtccataagtccagaaccttctcatttctcatccatgatctaaaagactactatctgtagtcacaaatgcatgtcgttttggacattggttcactattcagaatacaaactgtccccaccaatatggcaatattttctgcagaatatttataaccactgatctaattaaagtttggctgcacatatgttgttcttatggtcttgctttgttcctttccatttggtccttttcagtcagttgttttgctactgaatcttaacatgataaacatttcccttttaagttgagctgtcataaatcataatcatgaacatacaagcataatgttgtggacaacacatgctgtacaaacaggatatctttcctacaatttgcttattgaagttctatgcttttggtagatggcttccagcggtggatggtcaaacttcgaggatcaggtttgcatgtgcacatattttttatgcttttggtagatggctttgattgattatgtgttctttaatacgatttgtggtaatgacttaaatatcataaatttcaggctcttgttgtccttgtccacgacttgggtcaaaactgggaattagtaagcgacgcaattaatagcattgagcaattcaaggtaatttaaaatctgggatagcaactttttctatgtttgtatattcttcaaacatgtcctgcaagctctgattttatttccgttcttggttctaggcattttattttagtggtagatgccattaggagtaagttttgggttctgttgtaaactctagttgcagtgaaaaaaaatacattttatcataatctcatgggctgctgttagtgatctttccctgattaacttgagttttgcataccttgtcatgcagtctgtatataggcaacctaaagggtgcaaggagcgttataaggttctcgtggataaaaattctggtgatggtgccgatagtgcagaggactctggttcatctcaacactatcattttacgttgccaggcattccaaaggcatgttataactactcttttgatttatatatttaattgcttgccacatatgcgggtacatctcacaaaaatgtgatgttggacctatttactgtctgatactttctttctgaattcaggtgttgctttcatcagcaatattgctataagtgaagacatgttgagcatttcactgagttcctaacatgttttattcatatgaacatcagggaagtgctaggcagttattccaacgacttcaaggaccaatagaggaagaaaatctcaaggcacattttgaaaaaatgattctactcatgcggcaactgcacgccagacgtagaaaggttcatgtctctccttatgattattctggtcgctttaatttgttggtggtttataatgtataatcatgcaacttattttgttacatttataacagaggttaggtaactcttgcttttttttttgtcttgcaagaattttaggttgtaatggtgaaaccaagtattcattttctagtcttgaacttgtattagttctatacctgtgcttgtctatgtacctctttatttcaatttatgcatgtacctatgctatatttgataatatgatgtggtagcaaactcttccgttgaactatctcacttccatctgtctcaatcatctttctgaactagtaatgctgaactgataatgtattattcacattatgccagagtgctttttttactacccttcttgttgttactgggaagtatttcttatggtatgttttttcttgtgtcttgtctatagggtaatagccaggaactcaagtcgatcatacagccacatagttctcatgttgccgctctaacacaagcatgcccaaataacttatccggaggcgctttgacgtatgtaatgcttttgaatgttctttttgatatttagtttaatatttttttggtgaaaatactaagatatttcatcttcctatatgttctctagttattattattattttatggccctaacagcatccagtggtcaccttcatgttgatgtgtaatgtgtaacaggccacttgatctttgcgacgctgtaagttcaaacctagatgcaagtacgcctggtagtggttaccagagttcttatacaattgggttaacaccaccaaaccatcatggttccaatggccctacaactcccaattcaactctgaattccaggttatcagggtcacctggtacggttctgagcaacaattttttgccgccttcaacatttagtgcctcttcaaggtaaattcttaattcttcgtagcaggtattaagaagaacgcatgacaaaattcatttaaaaagttctcgtctgtgcaatttcttctatagggatgctcagaaatatggtgttcctagatgtacctctttacaaagtgatgagcaacagaagattcactataaccagattcttagtggtagaaatcttcagcagactggaggttctgttccaggagcatttcctcctggggttgatcgtggtgcacgtgtgatgcctggtacccatggtatgggcatggtgtcaggactaaatcgaggtatgcctgctgcaactgtaggctttcctaggcatagttcccctggaaagccaaatgtggtttcacctggaaatgtattagccaacagtgggcaaggagcgccaaacgcagtaaatgtccatcctggagccatgtctgcccctggaaatccaaccttacggccacataatcctatgcaggcgcttcatgtgagttaaccttttatttattatctagttaaatcttggtgctcacacagagtcagacttgagttaactgcatgttttaacttttaagctcttctccattggttatcatctctcctataaagaaaagaatgggagatttttactggtgtctttgcttgtctttccagttgcaccctccaagcaatccatgcattatttgttattgcataagtgatgccagcatacttatgtcttatataaacaaattcatgagtactgctcccacttagttgctttctatattttttattgaaccaatgttgccagcaaacttatgtaaatgagaagttgcctttatcgaaggatatcagaggcttgtgtaggatgctatgcagcttctctagtgatttgctgctcgaattttttgctgtgtcacattttctttgttttctatggacggattttatatgcttagatgtcatttgccagttaactgattacgcaaatttcaatgttccttcaggacagttaactgattggacatccacatgtttgttccttgggaaattagaaaaatatgaaatttatttttatctgaccaatctaaatagttctgtgtaactgaagcttaaaaagtttgactcaacacattctaaagcttagttgctttagactcggagggattacatttacatctgttatttatgtgacttgaattttatgaaggttaaagtacctcactgaatttataaactgttaaaaactagggatagctaatttatatttcctttcctttagcctggtcaaaatatggaagagcataggcagattgtgatgccagagttctgcatgcaggtttcacagggaaatactcaagccatcagcagcatgaatcattcactctccaatgcggcatcttcttcacctgttcagtcttttcctattcagcaacatcaacagaaacatcaaatttcaccgccatcacacatgtttggaaatccgcagcatcctcagatccaagggatgagccattcgaatccacagcagcaaacatatgctatgcgcttggctaaagaaaggaacatccaacaacgtatggtgcctcagcaacagaatgatcttcctggagcaagtgcagtacccagtgtacagaatggttcgcatggtcagcagcagaagcaatcacctgcagccttgtcagccccatcttcacaaccacagcatcagcggcagcaagctgcacaaaatccaccagatagctgtgcacatcccaatcaaccaaccaatgctacacaacataagccaaagaagagtcaacagcagcctagacagaatcagcaacaaaggaatcaaggtagtcaacaggctaagcttatgaagagcttaggacgagggaacatgctgatacctcagactacagttgacaccactccaaccaatgctgtttctgcgtcttccaaaaagcaaattactgagaacaaactgattcaacatggccaaggaactttacccggaaataaagcatcaaatccgtcaatccctcatcctggaaatcaacataaactatacagttctccattgcctcaatcaccaaaacagttgccagatattggtaaccaaggcgtattgcagggttctcctagtcaggccctcttaacttcacaacagcttccactccatcctaaatcttcactgaccacacaacagcaacaacagcatgtccattcatcgcagaatagcatccaaagaatgatgatgcaccaaaacctccaaagtaattctgattgtaggccagactcacaggtcgttcaagtccaaaacaatcagatagttccaacaccacctattcctcagagtacagagaaaggcagcgctggactttcatccataagccagcagaagcacgaggtgtcgaatgattcaaatgcagttaattcaacatctatgatgcttagctctcctcaagatacatttgctgggggtgagagactattgccatcatctagccatgatgtgctggaaaggcagatgccaggtggtttgcctatgtatggtggccagtggcaccaggagcaatctaagcagcaactgcagtccccaaaccagcagagaccagttgttcaaggcagtgtatatgctccattaaatcctgggcctggctgatgataaattaatctgggttggtcacttttacagagcaacccttttttgaaatctaaagttattgtacaggtatgcacttttaacttccttactttttgacttggtaacggatactgtctttgaattttgttatgtcaatgcagagattaagtaaacttatggaaccatttgcttttccttctgattattctaggacatcaagttgctcgtattcatcatttcttgaagtagaggtagggtgatagaattgatattcgagtcgagcagtttaaatgatccatgtctaaaagcagatgggcttttgcagtaatttaaagcttgtgctactatattctttgtagggagtatttttctgatatttttttaccttatctcacttgctaggtgtcagtgactccgtaacatggaagctgcggatgatagtgatgttaattcaacttggagctaatcgtaatcaccttagtgtcaggtagatagttgtttccgtgccattttaagtccacctttagaaggtgaaatatgttttatgcagtctagataactggatggaggtggctgttgcagcggcaaacttcgtttctttttggtggattctgacccaaatcctgggcccggctgtatattttcgatgcgaggtccatgctttctagaatcaggaggataaagtgtaaccctgtaattgcttcaactacaacttggtgaatgcaaaagtgcttatttgcattttgtaatgcgcagtttgtttgtcatttgaaacacctcgctagtgctgttttgcagcatcagtgtggaaggaggcagaggcaaaggtggattgcttcatttgggttttggtttatgtgggatgttatgattaatttgggtttgggtttgaatcatttttgtgggattttgtggtctgcactgcaagttcagctacgccagcgaaagatgtggagtacttgcattttccatatgaattgttgtgatcttgcaacagagaatgacgggcgttccctgtgttgtactagttacccagatgtaggagtatgtgccgatgtgcgtagtgctcggaaacttgcaagattgaacctgatcatcacagtcacagcagaaagaaaggagtactgtattttattgtcctaaccacccaaaggaaagaagtcaaattagtaggatttctcaacaataaagaaaaaaatcaaagtatgatactctttaacttcattcataatagttactacttaattcgtttacactctcgaataattattacaaaatcattaggttatttagctgttcactgttcaaggggaaaaaagccactcaagccattgttgtagtttttcccccattgcttgcattttattccttgtgcttg

SEQ ID NO: 67925 - DNA, 9617 bp, Oryza sativa
gaggaggaagcttagcggcggcggcgctagcggaggaggcagcggcggcggacaggcccctcatggcagcggtgttggcaaaggaggcgtagcggcaccggacaccggacgggcccctcgcagtggcgtcgccggcggaatagtggcgccggaggaggcgtagcggtggcagcgggcgtggcaccggatcggagggagagaaggagagagaggagaggctgactagtgggtcccacactggtttcacccctccattgctatgttgacctgccacgtgggcaaaagtggcaaatagttaagatggcatctcataagaggagaaaaatatgtgcaatcctaaaaggggtatttggataattgcccaatctaaaagtagcaaatagttaaatttcccgatgatttcgtcacatcatgtagttgtatattcacatgctgacatgcgttctattgatctgcccaacgatgagaaataaaaaaggaagggggagaaacttgatggacgatcagtatctgaatattcggtaaagccatgagctagtattcctaaatcaggaggaatgtctgagagagaatccatccaggttttgacatgacatgtattttcttttcttttcttctactaccacaaagaacagacaaacctggaatatcatttgcacgtgcagggcaagtcagacacacgttctatttccttctttttctttatagagcagagcagaacagaccatatgcgttcgtagtatcatttgcaagcatcagtcgagtcctattgccggctggcaactgttactgctctcacaaggaccaggccacaacagttattaaaccttcacttgtacattgacattcatccatgaagattattagcaacagaatcagtttaaaatccacccaagctatgctctactttctgctacgaacagaggaacatcatcaccagtaactaacatactcacgtctgtgacaaacagcatacataacccttcttctcatagcagttttccttgtccataagttacaagaggctggacacctctccctaatattcaaactttaaaaaagcatcccccaacttcccccaccggtcatccaattccagtttccaaagaagcacatggcatgagagccctgcatgcagaaatctctccaaatacaacaagattcaaggggcacatgtccgcgcaatgaaaacaaatgggaacctgtacaaacagcctaagcattgccatgagtccaccaaacagttgctaagggccaaagccccttagaaccaaccaaacctcttattttccggtctttagtactccacttcagcaggcgtgacccatggagtaggggctctgatgatatgcacaccgccaagattgagacatactagtactgaatcctatcatcgccatcgaaatttaggccctggatgccccgtatggtcgactcgtagttcttagcattcgatggatgcctgccagaaggcgtgcgcctgttgtcagaggagtcaaccatctgtggactccaccgcggggcccctgatctttggaatgcccccggacttgcatctgttgtacgactacgtgactggtcagcttcagtgcttggttctcggctactagagacagcaggtcgccttgaggatccgcttgaccgtcccaaaaaagtcgaactggagaactacacgccacttaaaggtcagatattacatagcaattgtgtataaagtagcacttcaggggcacacttttttgtcatggcactagcaacacaggcatcatgagaactctaagaactcaccactgcatctttagaagttgattgctcatgtccgataggggacttctgcttggctaggctgcctgcatttatagctggaggtggaacctgacgccgcatcgcatccatatctgaccagccgcttctccttccctcttcggtggctacatcatatcagtagacagttaaccaccaaacaactagcaagctttgttaattggcaagactctacatgaatcaagcagtctcaagggttgaccaaacagtagaatattagaatggacgccatctatattttatttgattaaaatataatgatctctacaaatgcaattccttctaacggtttgacccaaccaaaggctccattcctactttactgtcttactaacagatttggtaatgatcgacccgtttgtaactcactaacactaacattacccctttttccatatcttatttggggtggtaggtgatagtaacatcattttattgaatatttccatgattatgagttgatagaaactgaaaaacacctgctgtttatctaggtgaaaataacttaggagctgcagtacaattacaatccactaaagaatagatttatacctgacagcctgttattatttgctataggagccatcgccgagctttgtcctgttgcaggggcctaaaataagatacatcagcaaaagaagagtttgaacataaacccccaacgtgcacacacagtgaggaaaagaggagtggtagttgttttcaactgacaatggcacgtggtggagcactggtcatctgtgactgttgatacttcaggattgtccagtcaaaaacataatcaaactgaaatcctacatgtagaaaaaaaaatcccatcaggtgctttcaaaaggtagcattttgcagtatatacaagtcataaacactgtttagtcactgaaataaatatcgagcatgtttaaagaaaatcaaaacaataaaccaaccctctcgaataaaaaggtctctgaacaatctcttcaaatattggtagtctggcgaatcttcaaagcgcagcgagcggcaataatggaagtaagatgcaaattcagtaggatatccacgacagagggcctatagttgagaaatcacaataagaaatagttcaggaaaggtggtggatgcaatttatagaataatatttacctcagttgaagtagcaattttcctttcgctgattttctcatatttttgtttcttgttcccagcttttagaccctgccacggaaggctggcagcaataaactataagttaatacagaggacgcagttgacgcagagatacaaaagaagaaattacttgaggttatgttgaacaaccttcctctcaagaagtacatcagtacatatccaagagattccatgtcatccctccggctttgttctatggagaagcataaaaccgtattatgatgctaggaagacatacaaaaaggtcatataagcttactaggaacaaataacatcaatgtcaatcttgacactgctactggataaaggaatacatatacagtaatcagataacttaccaattccaagatgagtgtttacacttgcatatcttgctgttcccgtcaagttcttgttctccctatgattaaaagaaaaattggtgtgtttaatttggaagtaatatacagcaactgccatttcaactttcaagtagattaaaggtatccttacctatatgggatgtgctggtgtgttgatgtatccctgtacttctttgcaagtccaaaatctatgacatagacctacacagagaatgaaagcaagggttaagtacacctataattaattcatgaatacgaacagatcaattgaacataactatacctgatttgcccttttacctaggcccatgagaaaattatctggcttaatatctctatgcaagaaagacttggagtgaacaaattcgacgcgattgatctgagagatagaagatggttttggcaaaacaaatgaactgaaatcagttgagaaatgctagctttgggtaaaacaaaaactagaaaataaccaaatgaatagcaaatgggtttaaattgactgctaatagtaccatttgatcagcaagcatcaaaacagtttttagagacagcttcctgttacaaaaactgaaaagatcttcaaggcttggtcctagtaagtccattaccaaaacattgtaatcaccctcgacaccaaaccacttaacatttggaattccagctgcagaacaaaagggtcattagttgatgtgtcagtttaaggaaaacccactggataaagtaacaagcaagcatcaagcatgcattacttcctccctggagtattctgtacagcttcgactcatacagcagttgtggatgcttggtcttcacattttcctagacaaaacattggagattaacaagggtgttatctattaagacaggaagaggactggtggaaacagcagaaacaataaattattctcacaaaatacgcgcagcattacgtcagatcaagtccatgcttgcgatggacgtcaaacaaatttaatcctaatcaaccgcaactggacaagaggcatttgtcagggtataacagtagtatacccagtggtacatctatatagctcttgaaaaaaaaatcatgttttggcagagaactattaacagaacaaaaacttaagtagtaaaagttatgtttcaatagttttcctagcaacagaacacattaaaaactttaacacatactccagacaaccttttatattagaggtgccatatactatcaccaattcaactgcattaaaatatattgttaacaacaaactacattcgcatagcaaccagttgacagatttccaactcagaattcctccaatcaagtatagaacatgtcctctgcatctgagatccccacatctgaagcaatcgaatcataaatcgagtaacacaaagcaatactaggaaactcacgagcttaatagcgacctcctcgttggtctgaacattggtacctgcgagaacacacgcaaagaaaacaaaatagaagtcaccagaggctgatgggtaaagatgagaacttttgaatcaaaacgaggactttgggtagaattgcgcacgaaccaaggtagatctccccgaaggagccactccccagcttgcggccaacacggaacttgttgccgatgcgtggctccatcactgtgtgcaccaagctccccgggacaatcccttaatcacaaggagtgggccctgccagacaaggatcgaaccaattcgatcagctgctccaggggaatttggagctaggacgcataacatagcggtgaggtaaatggggatttatttcttgctctctctcctcatccatttacgtgctgctgcaggtgttgagcacgacacacacaggtgttgttggtctcagaatagaaaaatattaagaaatcgatgcatcaacggaattgggcacggcggcgcggtcggaatggttttccctctctacctgatttttccttctccaagtgatctggatctcctccatcttccctacacagtttcgatcggatccaacttgtttggggctacaaacaaactgttactacttgcttgtattaagagaggttaaggctctggaattaaggaggagaagagcttcatccagatctactccaagagaagctagggttaacgcaagcaaattccagctcccggtgggagagagatgaatcagaaagaggatgggaggtgctcaccaggtccaggataccctgctctgctctgctctgctcgcgcagatggagatcggcagccgcgactcgtcttggcgcaaggagcggagcggaggagacgacgagacgcccccgggagatttctctttcttttacgccgcgagggaatgaagggtactccacttcttcttttttttccccttttactttaaaactgcatttgagatggacaacttctcttctatgctaatatttcgaaattttcatcccaaagctatttcggacattaggacaaaattataagtactaaccaaaactaattagcaacgatggtatattatcgaagttaagcaaaatacgatgacatattgtagaacttaacaaactcaatgacatatatagaacgggaacaaagccagtgacctacatctttttcacttgataattgatatacactttattataaattctataaataaattattggatgattttaaatatttgaaaaatcagggtgtggcactcctcaaccaatggagacgcacaaagtcgctggtttgctccccaatcgaggctgatccgttgccaccatgggagagaggttgccattgtcgaggaagcgattcctcagacggtagggaatggagacccccccccccccccgagtgtgaagatccgaccagggggtttgattgtgagaggcacgaacgaactgcaaatcagaaaggattcgcggggtccgaccaccccgcgcagcaagagacacacaagaatttatacaggttcaggccactcggaggtgtaatactctactcctatgttggtttttattgtcttccctagatcagtgaagtacaaagaagcctttttaggctacaagcgagaatattgatataaagagtccaccccccattccgtatatggtccccttccttttatagttcaagaaggggctcacattattacaaatctcctcttagtcttgtcttatcagccgtcttgtccttgctggctggttcccagacacaatcttcaagaaacccattgagatttgtgtcatgtaatgccccgagctctgtctgagatagttgggttgcgccagtgtgcccaccacgtggtgagtagtgggcctggtgagacccgagctgctcgaaacagtgccacggttgcttttctgcccatctggctaaattaggtggcgcgggacatgcacaatgcgtgtccaaggcagcatcggccctcaatgactcaacattggtgtcttgtccatgtcttttcgactccaaactggctagagatcccccataaacatgtttcatttatggcggggcacaccacatcacagttggctgtggagtgcgcctaacttcctagtaggttatgaggtcgcgtcctctcgcatttaaagtagtttagttattttagtcgagcttctcggagatgtcgttgatgaatggatatttcaagatattgtatcttgtatatttcgatgctcctcgagacaaaggtacctgaaccctacaaggaccgaggtgagcccgggtcccaggataaggccggggccgaggcagacctcggttcataatcttgttggtatagcttcttatgtctccatcctccacaccttgcgaagagagtgacttatgaagactaaggtgagcccggggcccagaacaaggccgggctcgaggcataccttagttcaatctcttaagatgtagatcttatagatctctacgatcttcccgctaaaggacgtaggacttataagaactggggtgagccaggggcccagaataaggctgggccgaaggcagacctcagcttacatccttaagatatgtgttttgtacgtctcaacactcctcttttctgagtagtgtgtgacttctgcaaactaaggtgagcccggggcctagaagaaggtcgagcccaagacagacctcagctttacatccttaagatatgtgttttgtccgtcttgacactcctcttttctgagtagtgtgcgacttgtgcagactaaggtgagcccggggcctagaagaaggccgggcccgaggcagaccttggctcaatcttcttaagatatatatcttgtagggatctacgctcctcttgctgagaaccgtagagcctacaaggactaaagtgagcccgggactcaggacaagaccgtgtccgaggcagaccttaggctatattcttaagatgtatttgggtatgtttggcaccgaagccaggtcccaagatgcccttatattcaaagctttgagtcattgtacatctcatatattgcattcctccttagccaggcagagttccatatatgagaacacatgtgggcccgggactcaccagagtgggccctagctacgccaccctagggttgcctttttatttttaaagatactctaagcatgatatttatctgataatgatcattttgccaggtaaatgggtacctcgattcccatttcaccgacagccatcgccgttagcaagaggttgccattgtcgccagcgggagagggtgaggaggaaaccaccctagctcgtcctcgtcaagttccagttgactgctccccggctcgagggagaggataaggttggtgaaaaagaagatatgggctgagggtattttcgtccatacaaaaatatggtatgcagaaaacaactagcgtaagaacgtcctagacgcatatatagtaacacgattcgaattttacaaaataccagtgacattgagtcacaccgagttttcattataacatattcttaacggcatggatttaattaattgaaccaccatcttacaacatattccaggaagaaatatatattatctgcaatgggtcatccatcgttgtactttttttttcaattaagggtaaactcgatgtgagtgatcgatatatggttatagatcgatcacaaccggtatgcgctaggtgataaattttccatggcttccccggcccactctctggctctttgtcccctggatggagtagctgatggagatagataaataaataaagtagtcttaattaaaatgaagaagtttgtttgtaattaagcgatgggatacaattaataggacatatatgtacccctaatctgtatgctcaccgtgcaggacgcttatcatgtgcagattactggtggcaacgctggaataataatctgtatttagccggccgttgacagtggcagctaggcagtagtatgatgacatatatttgatttggtgatgcacattacatcgatcattgttattgcaggctgcagctagtgatggagatcaattagagatcataagtgtaacggaggaggggatggacaggccagggaggcggccttggccatggcgtggtgggggacgccggcgttgcagatgttggcgaaggagcgcatgtgctttatcccgtactgtcccagcgacccacactgatcctcgaacgtccgcaccatcgacctgaggcactcccagtcctcaaccagcgcagcccgctcccgcacaacctgctgcttgtgcttggcgccgcccaagaggaggcccccgatcatctccacgcttctgtccacgcgcgatcgccgtcccatctcctgcacaagccgctcccgagcctccaccttctctgccgtcccctcgccggctctccggtacttgcgccacaagtagagcagatcggcgtcgcgctgattcacagacacagtgtaggagtggctgcctttggcgccagcagcagctaatttgtggtcgttcgccgtcgcaggtgatgtatccatgtagtagaggtccaggctctgcggtgcgagcgccatgtcgccgtactgcatgacgtgggagccgagcgtgtaggtgccctcgtcggacgtccggttcttcaccgtcctgtactgctgccgcagcgtctcggcgaggcgcccctcctggtgcgcctccgcgtcctccatccacgccacgctgtagaggtccccgaggcaggtgtcgaactccgccgccggggcgtcgtggtcgtcgcccgggcagtaggtgccccagctgctctcctccgcgttggaggccgtggtggcgtacacggagatgtcggaaggcaggagg

SEQ ID NO: 67926 - DNA, 23111 bp, Oryza sativa
atcatttggttatttagctgttcactgttcaaggggaaaaaagccactcaagccattgttgttgtttttcccccattgcttgcattttattccttgtgcttgggttgggtggcagccattgttgtgttgtgttggcttccctttcccctccctcccactcccagtctgtctctctgtctggctgtgctgtgtactcctactatagcgagacagagagagaatctaaatccaatctcaaggacatggccaagcccaagcagccgcctcctcatgctcctcctccgccgccgcccccgcctccggtggagggcaagcccaagcctcctcctcatgcgccgccgccgccgcctccggaggccaagaagagcttcatgcgccgcatgttccccttcctcctcgccgccaacgtcttcgtcggaggtcagctcacccctttccttctctacttagcttacccgatgccgcgtccttgtcatctaccttacctctaccgctgcgctgctactcctccttgcgggatcacctccgtacccagggctgactactgttggtcgcaccagcagttggggctatatcagtattcatctcttaggcgggttggttgttgcattcactctcggctttactcacatgtctcatcactgaaagatccatccgcttcagtaaacttatattaatataagctcatcaactacacataatcttttactcacattgggggcaacttctgtctctgccttgtttgggctagactagtgcattgttgtcttagcatctgcagtgccatttactactactgtatttacgtttattctagttgttcttgtttcttctcaagtgttatgcatgtaatggtaaaccagagctgccaatcatatttgtgcattttttgtctcctcagtatatttgagcatatctattaacaggatattaatgtagtactgaagaaatatagtacatgcataaattgagcgcatatatgtatatatattctttaagttctgaaagagatccacttctgtagctcttatgtgctgttattctgcacttctgcttttcttactcaaatgctattatagttcagttattaacatccttataacaatatgcagcttatatgcttatgaggacctaccaaaaggactcgggaaagaaagataccgagaatgatcctacttcttctacgccgacctcatctcccgcggctgctgagaagcctgcagaaccaattgttgcacccataaaggtgctcacaccaatctcccaagacgatcagcgccagctgtacaaatggatgctggaggagaagcgcaagatcaagccacgcgatgctgcggagaagaagaagattaacggggagaaggcccttctcaaagagttcatacgagcaggatcccttccaagcctataagatcgccaattaactattatttggatctgtagtgctcttgtgtttgatgattgactgggaacggtgcgagtttgattgtatttacaagtccagcactgtaatcagatttccaaatgatagttgtggaaagaccctgttgagcttgatctcctgaattgaattggcttctttcataggacatgttgggtatcaagaagccgatttctgggaggcatggaagatgatgtatgaaactattatcagtgttgatttgggcttttcagctattggtgctgtgtaagttcatcagcatatattgatgtttgtggtctcttacagccttgagcctgcttgtcacattacaaatatacttatgtatagttgccagctcaactgctctgttgacctgaaatgctgccatcatcaatctatcaattactatttcgcatactattatacaaaaggttgaaaagaagccctcacatttgctccgagggcttagaaatacccatgtaaattggagtaaacgatgaatacatgttataatagtgtagattgatcgatataattgtatatgaagtatatactagaagttaagggaatgtttgaggggagaggaaatgagaagatatgcaaaaggtgagtcgttagtaaatgattaattaaatattaattgttttgaactcttggatgaatacaattttttaaagcaacttgcttgtagaagattcttctttttttttttaaaaaaaagcacagtgtttagcagcctgaaaagtatgcgtgcaaaagaaaatcaaaacaactttttatataagattattgtaaaaacacattgtttagcacttagaaaaacatgcgcgaaaaagacgagggggacaccctaagagttgtatatgatcaaattcaacatctattgtatataaaatatatctatgtattttaggagaaacatatttatgtttatagggatagaaactagtctatcactctaatccaatacaaaatacagttgtacgcgtagaaatataaagcagattagctaggagttgtagtaatatagtagcaagtctaaatcaacattttttttttgaaaaaaaataaaagggaaaccagctactccagtttgtttgacatcagattcatagaaaaggtgggcttactgggttcggcccattaaccaacccacggacgcttccacctaggagtagtagtttgggtttgggttcctctctcgtctcgtctgttttgttttcccctccgactccgactccgatcgatctccaccccgaatccctcctcctcaccgccggcgagcttccggctgcggcggagatggccacacgttattggatcgtgtctcttcccgtgcagactcctggctccaccgccaattctctctgggcgcgcctccaggactccatctcgcgccactccttcgacacgccgctctaccgggtaagcatcctccccgccttccttccttccttccttccttccgccaccaccatcctcaccctcctcctccgcctcccgcccgcagttcaacgtccccgatctccgcgtcggcacgctcgactccctcctcgccctcagcgacgatctcgtcaaggtaacccatctcttctcttctccccgatctcgatctcccttgccccccagctctcacgcgattcctattattcctgccgctgctgcagtccaacgtcttcatcgagggggtctcgcacaagatccggaggcagatcgaggagctagagcgcgccgggggtgtcgagagtggggctctcaccgttgacggcgtccccgtcgacacctacctcaccaggtcgctcgctcgctcctgcccctgctgcctctcagcttagcgattccaactcttttgctaaagctctctacctcttccttcctttgcttcttcttcttttctaggtttgtgtgggatgagggcaaatacccaacgatgtcaccgctcaaggagattgtcggcagcatccaatcacaggtctccaagattgaagatgacatgaaggtgatgacctttttcccttgcgaccacataatcactagtcaagacccaacctacatatagtgctgttaatatgtttcgaccctaatgctgtctctagtcattaattaacgacacttggtgtattcttattcttcttgtacataagacataaagttttgccgttcagcgggaattgtttgcttgctttgcaacaagtaggcaagttttgacattatctccataacgtgcaaagttcaagctagtgagctttgttctcctgccaagtgtgtttttacagggtctagcttggtttctgttttggtatgttctgttgttctagccagctatcaacacaaccatattcttgtgattaggcatccacgtctccttttttagcattgagttatcacgcacaacactacagcgtgacctgttgaatttacaacagctgagctgaatgtgttttttaccttcaggttcgaggagcggaatacaataatgtaaggagccagcttagtgcgatcaacagaaagcaaactggaaggtagattgcatgccactgagtttttggctttaagccaattctttcttgttttatttcaaaggactcagaaatgcgagggtatggtttcatcttttgttagtcaactctaattagtttgttttccttctgtatagcttagcagttcgtgatctttccaatctggtaaaaccagaggatatggtcacatcagaacatctagtgacactccttgcagttgttcctaagtactctcaaaaggattggttgtcaagctatgagtcccttgacacatttgtggtaagtatatgctcttttatagtgacatggttagtaatagactgtcatttcaactatttatatgattttcgtcctttcagcaagttgcttattttacttttgtagtttttgttcaatccaacaatgtttagtttgttaccacttgtggcgttaatagttctactagcaggagatgttacccctgtagaaaccacttaaagtaaagatctgtttgacctgtaaattctttactcagattgttttatttagcccttataaggaccttgtttttttttccagcactacatgttgatgtgattagtattcgtaattggttgttatatttgagtgcttttttccttgaactaattattgatttataggtaccgagatcgtctaaaaaactttatgaggacaatgagtatgctctctacacggtaacattgtttgctaaggttgttgacaactttaaggtccgtgcacgtgaaaaaggtttccaggtaaatttgccgtcctaactttttcatcaaaaacctttgtttacacttcacatttagcttttatccctagagccttaggagttccaaataacttgggacagaaattcagtcttgtttttctgtccccatcaatctggcaattctctgtcacccattaacttgtattacgttgaaatacaggttcgcgattttgagtatagttctgaagcacaggaaagtaggaaggaagagctggaaaagctaatgcaagaccaggaagcaatgagggcatcacttctgcaatggtgctatgccagctacagtgaggtgcatgtctttttaggcttatttaataatcctgtcaacaatgacatttctttagagaagaacttttttattcttatgaatgtcatttttgtttcatgtaagttctattaaaattactaccaattaatgtttgatgttcatttcatcattttgcaccagaatagagataaatatgttttcatctcctttagtagcctgacggtcttaattgtccttaaaagcatccaattatgcggaatctgaaccagtaagaagatattgtctggtctcagttgccacttgccagcaatagatagatgccacgctgtgttttatgtttaaattttacataaggattttagtaagttataacttcatggcatactgcaagttcttcctactgctgttattatctcactagaaccttattattcagggataaatccttgtttctgggatgtattaataagcttgtgtttattatccataattgtctattttaatttgtgcagaataccatttatgtacgtcatgctaaagtgcaaaactttgtgcttctctatgtgcgtaaaagaaaataattctgctgttgtttatctctgcttatgcagtgaattgccgtcatgaaggatttgtttactgaactgagttagttagagcctagctctataggctatagacatacttattacatattcactatgtcccaaaaaaaaaaaccaacctagtcaaggatgggatacaacctagtcatgtccagattcgttgtactaggttgtctcatcatgtcctagtcattgacggagggagtagcacatatgtttcttgattgttgggttttgtggtttgctttttctttgattcattcctcgtgaacttgtgttttcatggtgctcagttgtaattgcttacataaaactattctgcaggtattcagttcctggatgcacttctgtgctgtgcgtgtctttgtagagagcattcttagatatggtcttcccccatcattcctggtaatctattctactgttacgtagtatatgatagtcaaatttgtactttgatgcctgatctaatatcatatgctgtttatgttttcatcagtctgctgttctagcaccttctcaaaagggtgaaaagaaagtaaggagcatcctggaggaactctgtggcaatgtccataggtaattcagcgtttgagtttgtgttcattgcattgttagtcacaacatgcacctgcttttgtcattaattgagcctctgaattgcagtatttactggaaatctgaagacgatgttggtgtagctggtctgggaggtgaaaccgaggctcacccctatgtttccttcacaataaattttatctgagcacagtatgttccttgctacctgtggccaggcaaggcagtgttttggagtaattactactttggcaaacaaaaaaccagcgaatggttcggtgtatattataattgtgatacgtcaattctttcttgatttatttacccagcttatatgatcctgtagtttgaaccgatcaataatgtagctttttgggggaacctggactattttcctggcacaatagggtatctgtttggactattttatccccggcaactacaatattccaactgtttcctttagtatatctattgtgctttgagagcaccgtgtaagatgttgtggatattatgtttttgtaactttgagcagccaggttcgtaataaaagatcaatataaataattcaggtcgccgagcctgattgtaaacagtttgttgttgaattcgagctgtctccttttttctttgacgattacgactgttgcactcatatataaatagaaaggtggttgtgttttcacattcagtagggtggtgcaccgtaccccgtacatgataatactgatggtgttgtgacagaaggacaagttgggggttatgtatagaacgtcaatccttggtgacccagttcccactgatgatagtggagtagacaagacacaagaggagatgatggtcaaggtgagaggtgagggtgggtgaaattggatcagcatcaaagtctcatgatgttatcattaacatatgtgagtctgatgaattattgattcactgaagaggatcccaatggaggtgatcgcctcattttgatttgagtaggaccgcgttatgagagcggggtgaggtcggcaaggagaaggatggatcagaatagtcatagatggaaaaaaaaatgcaaggagtaattaagattaataggagtaatgtggatgaagaagaaacagctaggctaggcacataagaagatgattaatgggcaaaatcaatccaatccccctcatcgcgtcgcgtgagaagagaggaggaaatggcatcctcgagattgcattttgtcgtcgatgatccggtccattccggcgccggcgttcacattacacacccaaccaatatcctcaccagtactactattccattctgctactagtatactccttcagtagtgcagtatttttcttgtataaataatactctaggagtgtactaatactcctagagtagtcttgtttcacctacccccgttccgttccttgtatgaatccattgccttgcttctgcttgcccatttgatgatttgatttgatttgattcaatctccaaatcgatcgatttctcctcctccataggagaaggagatacacgtgatgtccaaccggcgtcgcaagcgcggcgaatccaagccccaagcccacgacgccggcgacaccacgcccatcgacaacatactcacctccctcgacgacgccccgccaccgccacctccaccgcgccacgagctccccctcctccagctcaacgaccaccaagaggcagatgacgctgacgcctcgtcgtcgtcgtcgccgcaccagcagcggcggctgtgggtgaaggaccggtcgcgcgcgtggtgggagctgtgcagcagcgccgactacccggaggccgacttccgccgcgccttccgcatgtcccgccccaccttccacttcctctgcgacgcgctcgccgccgccgtcgccaaggaggacaccgccctccgcgccgccatccccgtccgccagcgcgtcgccgtctgcgtctggcgcctcgccacgggggagccactccgcgtcgtctccaagcgcttcggcctcggcatctccacctgccacaagctcatcctcgaggtctgcgccgccatccgcaacctcctcatgccgcgcttcctccactggcccgaccaccccacctccaccgcctacaagacgcgcttcgaggccacctcgggtgtcccgggggtggtgggcgccatgtacaccacgcacatccccatcatcgcccccaaggtctccgtcgccgcctacttgaaccgccgccacacggagcgcaaccacaagacctcctactccatcaccttccagggcgtcgtcggccccgacggcaccttcaccgacgtctgcatcgggtggccggggtccatgagcgacgagcaggtgctccgcaagtcggcgctgcaccagcgggcgtcggcggcggctgggtcgatgtcgtgggtggtgggcggcgcgagctacccgctgacggagtggatgctggtcccctacgcgcagcgcaacctgacgtggacgcagcacgccttcaacgagaaggtgggcgaggtccggcgcgtggccacggaggcgttcgtccgcctcaaggggcggtgggcgtgcctgcagaagcgcacggaggtgaagctgcaggacctccccgcggtgctcgccgcctgctgcgtcctccacaacatctgcgagaccaggggggaggacatggaccccgacctccgctgcgacctcccccccgacgaggaggaggacgacaccgtgcttgtgcagtcggagtccgccaacaaggtgagggacgacatcgcgcacaacctcctccaccgcggattggccggcaccgccttcttctgatcatttcgatttccgtcccaatctgcactacaaacactgtattgaggtttccctcctcccctcctgtttgttcttgttattgctatagattagtttaggtgctccactcaacaacaacaataacacaagattgaaatgtgatgctttgccctcctcgttaataaatcactggaatacatcgcttcgtttcaaaatttgctttgctttttggactattctttatcctggtactggtaaattacacatacaagctgaatatttactcctataagtaagcacgacctacagtatttgggtaggatactagaattctgcgctttgttctattgtctgacctgaaaattttacccctcgtacaaatctcctctacatgtcaacttatcagccacatccagaattcaaactttgaatttagtggcttttattttcagcattagctttgctttaaatgaataagaataaaagttctaacgacaaattgtttttttaatttgtttcgtttatttttctatagcttatccttcattgcacgaacgattagtgtggccttgaaactttaattgtaggggatgacattgaatccaatcctaggttgagagatgccactgtaggaccatgaggcttgccgaaatttttgttctggatcttttgatatgcttgttggccaaatgtgcattgctcccccaacggtgtgctgtcaatgctaaagtagcaaaacatatacagtagcattacaacagtatacgtgctgagctttagttcctctggtgaccaaccactctgggaatactattgcttaataaatcattctgtagtctgtacctttggttagtgtttttgttacagtggggttgtgtgtcttgacttttgacatttcaaaggaaacatgttacttcttctgtcccataatataaaggattttgacattttgcttacactgtttgactattcgtctcattcaaaactttttttgaaattattattattatttttactttattatccaaattactttagtcacagcttttcgttttttatatttgcacaatttttttgaataaggccatgtttagttgttttggcaaaaaaaaaattttgacgtatacgaaaacacatttaaagtattaaatgtagactaataaaaaaattacagattccgcctgtaaactgtgagacgaatctattaagtcttattaatccgtcattagcaaatatttactgtagcatcatattatcaaatcatagcgtaattaggcttaaaagatttgtctcacattttacatgcgaactgtgcatttagtttttttcgtccacatttaatgctatatgcatgtgtccaaatatttgatgtgacgaaaaagttaaaagtttgaagggagctaaacacagtataagacgagtggtcaaacaatccaagcaaaatgtcaacgtcccagtattatggtacagagggaatagaactagacgatactactagaaactagactagtgaaaaagaaaatggaagtctgtgacatgaatggcaccagtggtctagtggtagaatagtaccctgccacggtacagacccgggttcgattcccggctggtgcattttttcttttctctctcactctctctctctctctctctctctctttttttgccttccttccatctatgtgctgatgttaaatacgttttttttcccggttttacttcagcatgaagcaccaacaaaatggccattacaggtttgcagggactttactgttagcgcaaaatgccgttgttgacttgttgtaaagagcggcttgtcagatgtttttcatttttcacaccgtgctgtaacttggaagcatgacgcggacggactgattattgttacgctgaccaattctagctctagctccgtcagggtcatcaaatgagtggttgctccatccgagaattctgcagcctcatcggttggcatatttcaaatagcatatttataagagataatccaagaaatgtgagttctaagaaatatcatcgacaagtgtaaattctaagaaatatcatcatacaaacgattttgtcctaaaaataccatcgtcattagggttctatccattttgcgccgttaaatacactgttcatcctatagaattttaatatcgtggaatgaatggaaccctaacggcgatggcatttttgggacaaagtcatttgtaagatggcatttcttggaacttatacttgtcgatggtatttctgggatttggatgcttgtcaatagcattttttgaattatctctatttataaataaacattaatttgtgaataaaacttctatacacatgttcttagcgatccaaaagtaaatgctgaaaaataaacttctatgaaaaaaaatcccataatcaagttgaaaattttaatggctgaaaccgcaatgatacaatccgtatattgttatctgagtgagccatcctaaccgtcaacgtgaaactacctctgcctcacactgtcgcacacacaaaaccttagcccacatttaacctgtttcaatcagttttatttaagaaacatgatggttcactggcacttaaagggccaaggcctcatatgttggtccagacccccacattgtcattctcacacaaaaaaaaatatgcttgtgatagtattttatttaaaaatttatccattgtaaacgtgtgtttggattggctttggtgaatgaaatggtatttggtcctcacctcatccccaaaagcatatactaccaaataggagggggaaaaaaggtaaaaatgcagtttctaaacacaccccaaataaaaaggaataatatgaattgacttctcaaaccgagctagaaattaaccgagctggtgtgtttagttcacgctaaaattgaaagtttggttgaaattgaaacgatgtgacggaaaaattggaagattgtgtgtagagaagttttgatgtgataaaaaagttagaattttaaagaaaaaatttagaataaattcggtagaggtgaaaccgagagaaccgagtagttgtacttacacatgagatgagatgagatgagatgagatgggatgggagtgcagtgtacagtaaaatatgtttggtgatgagggggtagagtggtggcagcacaccactggctgagcgcgtcgccacgtgtccacgccatttccaaggcaggcccccatcaacggcccagacgtcagcacgtggtgatgtcaacacccctacccactgtgtcactgacaggccggggcccatcctcctcttcgtcctccacccgccagccagccagcgcctcctcccctctcctccccacgcaacccgatccattcccaaatccctcctctcatcaactcgactctcggtcggcgtcaccggcgtcggaggcggaggcggaggcggcggccgcgtcggcaaggtagtgctgtgctggatcgagtcgagcagctggctgcgcgcgcggtttgtggctctctgtgtgagtccggcgctgctgcttcaattccttcttccccagggcacctcccgtgagccgccatctccctccctcacctacctctggattcgctccagatccgcccatgagtaggcccccacgcccaccgcctgctcgccatcgcgcctccactccaccacaccatgccgatccccaccacctctgacactactccgcccctccccctctctcattcccatggaggacctcgccctgcccgccgctcctcctgcccccacgcttagcttcacgctcttagccgccgccgccgccgtcgccgaggccatggaagaggctctgggcgccgcgctgccgcccctcaccgcccccgtccccgcccccggagacgactccgcctgcgggagcccgtgctccgtcgccagcgactgcagcagcgtcgccagcgccgacttcgagggcttcgccgagctaggcacttcgctcctcgcggggcccgccgtcttgttcgacgacctcaccgccgcctccgtcgccgtcgcggaggctgccgagccgagggctgtgggggccactgcgaggagcgtgttcgccatggactgcgttccgctctgggggctggagtccatttgcggccgccgcccggagatggaggacgactatgccgtggtcccgcgatttttcgaccttcctctgtggatggttgccggcgacgcggcagtcgacggcctcgaccgggcctccttccgccttccagcccatttcttcgccgtctacgatggccacggtggcgttcaggttccctttgcttttgtttttgcctcatcacagtcacagcacattaaacgaatccaacacaccgatgataaccttttctccatgctctcatctgttgcaggttgccaattactgcaggaagaggatccacgccgtactgacagaggagctgcgtagagcggaggacgacgcgtgtggctctgacttatctggccttgagtccaagaagctgtgggagaaggcgttcgtggattgcttcagtcgtgttgacgctgaggtgggaggaaatgctgcgtctggagcaccgcctgttgctccagacaccgtggggtcaactgctgtcgtcgcagtcgtttgctcgtcacatgtcatcgtagccaactgcggtgactcgcgtgctgttctctgccggggcaagcagcccctgcccctgtcactagatcataaagtaagccatggactcccattgattccatgtatgagtaattgactcgagtcctgaggataattggatacgaattgccttgttcttcttcgtgcttcagccaaatagggaagacgagtacgcgaggattgaggcgctgggtggcaaggttatccaatggaatggttatcgagttctcggtgttcttgccatgtcgcgatcaatcggtatgcattctcacccttttgacataattgaaccagtgtttgtttgtgcttcattgtttatgcttctccaactttactgatgtgactgtgctgatgatagctgattgggtaattgatgtgtcaaaggaaaagtctcttgactggttcattttgttattttgttctgaattgtgatgatatatggtgctctagggtttgtgacttttctaagtgaaaaatcactggctgattgttgctccctggtgtaatgacattgtacccccaagtttatttacaaataccttgcatcaatgcgattgtttgcaactggtagtgagtttgtacctatggtggcagagagagctcctcggctaattactttgttagtttgttcctagtcatactgttaagtgatttgcgatgctatgattcaggcatatatttctatatttgttagctatgttgccatatgcgatactggtataggcgtttggtgagtatacatgcagttcacaataggaaaatataagagaatatgagagacttagacattgagatcaccttgatggaaaaatattaagagtaatactaaatggcagaatacttcaaagtagtgatttctgtcataccaaacactaggatgagtcactaactacacgacagctgtataagccattgtttgcattcattgtgatcaaggaacagctgtactatatcgaggattgtaaggactgatgtaataatgtgccattgtgcatcaattgagctttggatgttagcttcacaccttcacccatgttgctgcacagcagtcaatcatatttgttaatttactgttgcagtcagatgaggtttcttcccattgaatcttaagggagaaagcctggcccaatatatatcacaagacttgaataactctttcatcagcatttactctgattcgcttttgctgtattgatgcttcaaactagagagagaatcataacatcatgctattcttctgttgtaccccggtttattagttccagtgttcatgtatcctgtcagtttttgttgctcttaacatgttattctgtgactggtaatttgatttcaatgtctttaatatatggcttttgttgatacttcaaagttcaaagtagataaattatgtttgatttattggtgcgcttgccaatacttctggtctgtgcattgatgtatttgcaggggacaaatacctgaagccatatataatcccggtccctgaggtcacagttgtcgctcgtgcaaaagacgatgattgccttattcttgcaagtgatggcctttgggatgtaatgtcgaacgaagaggtctgtgatgctgctcgcaagaggatattactatggcacaagaagaatgcggccaccgcatcaacgtcatcggcccaaataagcggtgattcttcagatccggctgctcaagcagctgccgactacttgtccaagcttgccctacagaaggggagcaaggacaacatcactgtcgttgtaattgacctcaaggcacataggaagttcaagagcaaagcatgacattgcctccatgaacaataacaatagtttataggaagctagaaatgtgggaaatccaagacaatttatttagctgctgcaccggtacaatttgtttagctgctgttcagtactggtgctgctgcagctgcagctgcttctttgccctcgccatttatttctgccgagggatgtactactagtatactgtatttttctacacggtacagactcccaaatctgattcagggtcgaggacataaggtggatctgggaattttggggtctctcaagacaagacagaaaacataacaaaatctgtagatgtaggtaggagtcctaggacagattgggtttctgcctctggcattaatcgtttttgttaaccggtaaagatactgctacttgcaattgctgtttcatatatactcctatatctttcttgtgccttcccttgtgatcaatacctggtgtttctcccttgttcaagacggtcaatgtacttgccgattttggagtacttgaaatacagagaaaataatgtctgaacctgaacttgtacactggtgagctgaagagaaaccggactctagttaactttagtttgcagaagtgtaggagaccaagaccagtgacgaaactaggatctgagtattaggggagtcaacttatcaaatgattatgataaaaaaatagtagtataaaaatatacgaaaatttaaaggtttttcatagataatatatcatatcaatgtaaagaaaatgataatacttaataggtatatgatacagctacaatgtatatatttatttatttcaatcatgagctgcaattaggagtccaatcacctcaagttagcatgtaagtttttagagagatatcttatacgattgctcatgcatttccaaaaaacgaacttaaaacctgactcaaatacatatctgtatttccaaaaacgaacaaacttaaaaaccgactcatacacggatacacggatgacgtaccaaagtaccggaaaaaacatcttcaatttttataatagtagatattttaaagagtaaattgcagtttgggtcatgtatttttacccttgttgcagcttggacaaggtcttagccatgatttccactttgcaccacataaccttgccatttgtttcactctgcaccacccctcatcttctccgagtcaggcagccttattatctctctcccaacctgttcttgttatgctatcaccgatcaggaggaggtagaagtacgacagttttccaaactccaatcaccctatccaatctggagggaagagtagcaaatcatcacaggttcagcaccggtacaggtgctcaagctgagatgaagtgcatggtgataatgctgaagtcattgctggtgcctgagctcgagcgtgggagcagtactacaacacttcgtcagggactagaataggcaaagtaattggggtcgagtatgcaggttgctttcaccagagagctcaatcccaaccacacatggggaagatgaagactttagtatgctaatgactaaattaaagggtgaatagccaaagtggtccttcaagttttatctgaggctcaatttagtccttgatgtttcaatctatccttattagtccttcaagtttttattttagttcaaacttatccttgaaccaacaactctcttgataaatgacacttatatccccatcattcacatatataaaacaaaaattacatgcttgattttatttatagataatgcatagtaaattatgtaaaacgaaaataaattatgtactatacgatagcaattgcttaagtttcatgtgcacatgttgaaataatgggaagtacatctgcaatgttgtttattcatcttggtttcctcttttctagtatatagtatacaaattaagggcaaaagggatattttctaatagaaatattgactagaaatagccatatggcatattaagtgggcccaaggatgatttcaagccaaaataaatatttagaggagctatgtggacaaaatgaaacgtgaaggaccaaattgagccttcggtaaaacttgagggactaaattagctattcaccctaaattaaactaatcgtatcaccttacctaacatgctagttttagtatcaataaagggaggacatggtagtgctcaagctcacgtacagtggcttcagctcaatgaagaagagaagagaggggagatggaggaaacaccggcccaatctgaaacttgtgtaaaattatttagtccaaagtgaaaatattactttgtccctagtccaatgtgtaactatggtaataaaaggtagtccaatgtgcaattcactctattttaaattatgatacagaaagatatatggttattagatatttttattttagataatacttttgccggtcaaaatttattaagaaagaaggcatcagtttataaagccacaccaacaaagctgttgctattgttgtgtgcgtgtttttttttgggggggggggatgggggaggcctcccctatccatagtccatgctagtttgctagagctctaaatttgatacaatgtcagaattttagaggtgggaaatatatctttatcctttgtatgtattttgtatagcaaatccacccatcctgttcttaaaacaatcaaaatcaagtagttcttgatttggctccaactctatggataaagatctagagcaagtaagctgtagacaagtcatgattatctaacctgatgcaagtgagattggttatggttgggcctgttcggctgtctatttgcggtggttgcagctgcggctgcgccgtgtgtgtgcggcactgttagtgccggctgcgccacaaccacagcacaggcagccaaacaggtccattattgcgtgatacgaactctaaagtctctaatacactcaaacaaagctttttttaaaaaaaagtgagttaaaaattgatgggtgaagtttatattagtatgattcatattgaaaaaaaaaattataaaaacgaagaggaagcggaggcgtagtaagaaacgtaggggtgaaaacggagcggatattatccgatccgatccgctctgaatctgtccgatgtgaggatatggtaaggatttttagatatctggccggatgcggatgcggtatgaacgatatccgacggatgcggattatccgatattttaatcggattatccgatgtactgtttggcggataatccgcaaatttcagaccacacaacaactttcaggcccacctagctagcccaatagcccaacccggcctaatctaatcctctcctcatcccccagatccgtctctggctctctctgtgtgccgtccctcagttgtcagtcgaggagtcggagagagtagcgcggcggcacggcacgacggcgaccctgcgcggtggccgctccttcccaacacgcgccaggccgatcctcctccccaacacgcgccagccgttcctcctcggctagcgccaccgccggctgcaggaggctgctagcgccgccgctcactgttgtgtgttttgtgctgtacacctgtactactactgctgtattcctgtatgcagtatgctgcgtgtagcactgcataggggtgctctactgctctatgcttgctgttgttgtatgcttgtatggcttgcctcatgccgatgacttttatttttacattttaagctatgcagtaaccggtgaactattgaactgaacacttatattatgtttttgatggatcgtggatatatcttggattattttgactagtgaactattgaaccgaacacttattacttatagttatactattgctattgaactgaacgcaatgaactaatgatgttttgccatcgtattggggcaaattgtattgccgccctcttgatgtatggattgaatacaaacttgacatccgataactttttgtccgtttctgaaccgagttcgcaccgaatccgacgtccgaaataatccgctccgcatccgcatccatacgtcatccgcatccgcttaaaaaatatggtttaggatatagtatagctattattcatccgaatccgttccgttttcaccaataaagaaacgcatcctgttttggttttggttgtattgtggagcagtacagcagtatcccgtttcgtttgggcttttggtgggggttgggtgggtttcccgtctccttccgattgctgagtagcattagcaaaggagcaaaggaaaggaacctcgatctccatctccatctccgcccccaaaccctaacacacacacgccgactctccaaaccctacacccccccaacccccaaccccgccgatccccccgctcgccgccgatgggtcgcaagaagaacgtcgccatcgatgacgatgagtactccttcccgcaggaggacgccgcccccgcccccgccgccgacaaggacaagcccatcaagaagggcggcggcaagaagggcaagaagggcgccaaggccgccctgcccgacgacgacgactacgagccccccgcgcccccgcccccgcccggggacgacgacgacgacgaggagcccatcaacctcgtcttgaccggtaagaagaagaagaagaagggcggcggcggcgccgtgagctccttcagcgccttcgacgccctcgcggccgacgaggaccagggagaagacgacgacgaggcccccgcccctgcccccgcccccgtcgagcccgatgccgccgccaaatcagacgccgaggacgacgacctcgatttcgacttcagcaaagccaagaagaagaaaaagaagaaggacaagggagctcgcccagtccctctggaacacgacgacctcgacctagataagcctgccccgccgcccccagccgccgctgctgatgaggcagacgacgacgaggctgctgcagctgcagcttccaaaaagcctcagaagaagaagaaaaagaagggcggctttactgtggacaatgaggacattgacaagctcctcgccgagatcgacgatacttctcctcccaccgaagaggctgagccggtggaagaggtgcctgcccctgatgcagatgatgccttaggaaagaaatcaaagaagaagaaaaagaagggaggctttaccgtcgatgatgaggacgtagacaagatcctcgcagagtttgaggaccagccacctcctgtcgacgatcctgagcctgagcctgaggcggtgaaagatgtgggtaatgtggccgcctcaaccagtgtggatgatgcggaaggcaagaaatcgaagaagaaaaaaaagaagagtggaaggacagctcaggaagaggaggatttggataagcttctcgctgagcttggtgagggcccaacgccagcagaaaaggagaaggaggttctgccccaggcgccacctgctgcggcaatggtgaaggaagatactgaaaccgcagaggatggtaaggctggggaaggagaggtggaatctgctgcagccaagaagaagaagaagaagaaggaaaaggagaaggagaagaaggcagcagctaaggaggcagatgctaagaaagaagaggaaaaggctgtagaagctcctaaagggaaggttgacatgaagaagctcccgaagcacgtgcgggagatgcaggaggcacttgccaggaggcaggaagctgaggaacggaagaagcgtgaggaggaagaacgattgaggaaagaggaggaggagcgattgaagaaagaggaggaggagaggaaagctgaggaagcaaagaggaggaagaaggagagagaaaaggagaagttgctgaagaagaagcaggagggtaagctcttgactgggaagcagaaggaggaagcaaagaggttagaagcaatgaggagacaattccttgagcagagtgaacttcaagtagccgatggtgctgtccctgagacaaagaagaggcctatatatgattccaagaagaaaaaaggtcaacagaagactctggagactgcaaaggtagttgaagaacaaccacaagaagttaacgaaactatcaatgacgaggaagaatatgtgttagtggatcaggaatctcagttgcaagtggaggaatctgagaaaaccgaacctgatcaggatgtcgaagaattgaaaccagaagaggaggaagatgaagatgaatgggatgcaaagagctgggatgatatagatgtcaatttgcctaagacaagtgcctttgaggaggaagaggcaaaccctgtcgccaagaaggttgctgaacctgttcagaagcaggaaaattctaaagcacaatctacagtggctactgtaaaaaaggttgcaaactccaataaaggtgaaacggaagatggcgaatccagtagtgcaaatgctaggaggaatagaggcgcttcaaagaaaggacctattaaagaggatgagactaagaatggcagtgaccttcgttcaccaatttgttgcatccttggtcatgtcgatactggtaagacaaaactgctagactgtattagacggaccaatgtacaagaaggagaagctggaggtattacccaacagattggggctacgtacttcccaactgaaaatattagagagagaacaaaagagcttaaagctgatgccacacttaaggttccaggattgcttgttattgacactcctggtcacgagtcgttcagtaatctgcgttctagaggttcaagtttgtgtgacattgctattttggttgttgacattatgcacggtcttgaacctcaaacaattgaatccctgaatctcttgaagagccgtgatgcagtttttatcgttgccttaaataaggtatattgctttggagtttttttttgccctttgacctcatcttttcttacagtctattaatgtctcaattgttttttggcttaatctctatgaaggttgatcgtctttatggctggaaaaagtgtacaaatgcccctattgggaaggctttgaggcagcaaaatgaagatgttaagagggagttcaatatgaggcttactgatgtgcgtaaatttccatcttgatttttctttaaagaaatgacttagcactagcagttgtatttatacaatcacacatatatgcagattgtgacacaattcaagatgcaaggtgtgaatactgctttgtactacaagaacaaggagatggaagatacatataacatagtgcctaccagtgcaataaggtatgatctacagctgaattaattgattcttcattcaactatgatattattggcatctttgcctcaacacatagttcacttctctcaacagtggtgaaggcattcctgatctgcttcttctgttggtgcaatgggcacaaaagacgatggaagaaagacttactttcgttgatgaagtccaggtacggtgcataaatttacttgtcattataaaagcatgcattcttatctcgtttctgtttcagtgtaccgtgctggaagtcaaggttgttgaaggtcatggtactacagttgatgttgtgttggtcaacggtatactccatgaaggagatcaaatagttgtgtgtgggatgcaggtaagagacgtttttctttataaatgcagtttttcaacaaacacagcttattgaagttgccgcctgctcttgttctatgtttatgtagggacccattgtgacaacagttagagctttgttgacaccacacccaatgagggagcttcgagttaaggtgcgtgcccataatagtg

SEQ ID NO: 67927 - DNA, 39632 bp, Oryza sativa
gccgccgctgcccaccgtcgccttagtttccgccgcccggtactgtctctgcttgtaactaaccatatactccactcgatcagatgcttcaatctccataattcctcctcttttcgcctttacatcataatatatgtgtttgttgcattccattagattggattggaaaaccattccattcgacttgtatttcttttgctgcttcattacatcaatcgatcgatcgatcgtcggttgggaattaggccatccactccatatatctatcaccatctcttctccacttgttcatccatttatgctgtctccacttcccttctcttgtacccatgcaattcaaatcatacttcattttcaagcacttctctctctctctccctctctctcttttccaaattattattattattattattattattattattattattattattattattattattttcattcattcttacctgttaagcacgcctccttaataattaaaagaggtcttgaggtacccatgtaaacttttccctttttttttaaaaaaaaaggatccttgctagcttgttatgtcggcaacgcaaagctatttcgtgtcacctcagctgcttcaaacttcaatttgcattcataccctccagtccgaccggaatatatgcaaaagcaagctgcttttcattatactgcagctgcagcattgcctttcacataatcacattgcttgcttcattgattgtattcatgcgtccaatacgcgtctaataatccaatgcggtcactacctttctcgctacagctagctagctgtcacaccaccaccaaagtctctttccgtgcgctctggcttcataccattggagtccacgtttcctgctcgcacttgataatgtgtcactgtcagatttactagtataatactggtctacatttggggtgctggcactgccaactcccattttttaaagctcaaaaaatccattcttttttctgaaataagattttcttttttttcttggtttgcattagcagtatatatgcacacacactcattcctacactaacaatcttactacatcatatcattaacacttgcaggcctgtctagagggcagccatggccactgtttctgacatcggcctctccgcggctatcaacgtctcgatggccgttgcattcttgctggtctttgcttttctacgattacagcccatcaacgatagggtttactttccaaaatggtacctcagaggaatgagagacagccctgtttcctctggtgctgcagtgcaaaaggttgtcaatttaaacatgagatcatacttgaaatttttaagttggatgccggctgctctcaagatgccagaggatgagttgatcaatcatgcaggccttgattccgctgtctatctacggatatacctaacagggtctgttcctttccatcttttatgtttctgctcttctcaattgttccttgttgccatctcattttttgttccaagtcatacttgtggaaataatgccaattagttaatgatacagtgagcatttaatccaatgggtaaaggcctgcggcttcactttgttattgtttctaaacaataagagatgctaatgaagaaatgatgagcaaatttatcactctgcatttttcccatgttaatttaaacctgagaatatgaatcgtatcattgttgtcaaaatctatttgtgcctaacttcaattatgcctgtgtattgatatacctgtattgaccttttacaggatcaagatattcgttccaatatcaattttagcttcgcttgttctgttccctgtgaactggacaaatgacaccctagacagcatgaaggtagtccacagtaaaattgacaaactttcaatatcaaacataccttatgggtcaaacaggtaagcctccataaatcatttgatatctggatgcggtgtattttgatgagttgtgtagagataaatgtttctttttttggtctggttcaatataaattgtacgtaaaacatcaataagattgcccattggtccaccaattacacaaacaaaatctgtatagtgattcattttacatgcagattcaacctttttaagttttgggcggcacctgaaatccaaccacttttacttatcttcatgctgattatgcacatgtacttggtacaatttttaggagcattatcatcttatggttttgggtgatttgataaatatgccacttgcctgtgtgactgtctaatttagtaaggtacaagcactctattttggcctgtgtgcttgggacttagcagctgccctgccaagttcaatattgggtggcagttgctctggttgaaaataaattcatccacactgaacttctaggtttcatttattaatttctgttgatgctagcacatgtctttgctgttcatgatgaacattccatctgttttacaggtttgttactcacttggttatggcttatgctgtcacgttttggacctgctatgtactgttccgagagtatgagataattacaacgatgagattgcggtttcttgcttcagagaaacggcgaccagaccagtttacagtatgatcttgtcaactttgcaaatcccctctctatttagtaccaacatgtttacattggatccacaagaagggtaaaaaattgtaatattaatggactgaaactattcaccactggaaatagtctaagagattgtggctaagcattttgtctctgagcaccctgatactcactttgcactgacttggtttatattatctaaagcaatgttgtagacgggaatggtttcatatctcaattgaataaacacgatgagttaatttccttctggttggtttgttgaatgcacctcaaatgatttattttaggttcttgtgcggaatatacctccagatcctgatgaatcaattagtgagctcgtggagcatttcttccttgttaatcatcctgatcattatctaagacaccaggtaatctttggtaaaaatttgtggataactaagtcagatgtagttctgttgcttttctcttctgggggtttcaacaggtcatcatctgcttaggtaggagctgtgtttctagttatgctgattggcctaatgcaaatagattttttttctactcaacagaacccccttcatatattatccttttcccacaaattattgatggtttcaaatgaacctaatattaatgtttgctagtttcatgttgagattttttcccccagattctgagaatagtccacataatagcctacccacagattatttggatattaatacataaatattttggttttgccaagtaacaggaaagttatgatctcttggttatctagattttcatttaaataatcatattcatatgttaaagggtctaaaaactgtctctctgtgctaacacttcacagtgctaattgctgaatgagatttagaagggtcatatccaaatttgtgtatcatatgcacttgggttttctaccctgacttcattgatttttttattcttccttatactaattactgtatttattccgtcctttttctggccgattgtctatatctataggtggtttacaatgcaaataaacttgctgatctggttgagaagaagaagaaactgcaaaattggcttgattactaccagctcaagtatgaaagaaatccatcaaaaaggcccaccactaaggttagtctgccatatggaccttgatcaatttatttttcatttcaattataatattacattaggatcttttttctttttaattctctgtccccctgttggatttttgttccagactggctttcttggctgttttggttccgaggtggatgccattgaatactacaaagcagagattgagaagattgggaaagaagtaagttgtactccctccgtaccgtaatataagggattttgactttttgcttgcactgtttgaccactcgtcttattcaaaaaatttgtgcaaatataaaaaacgaaaagttgtgcttaaagtactttggataataaagcaagtcacaaataaaataaataataattccaatttttttttaataagacgagtggcatttttgtctattaattccaaataaataataatcccttatattacgggacggagggagtagtatttttgtctatataatcattggaccattcggcattgtccattttttctgattgagttgtatcattctatgaacatgggtttgcacaatcgattcttttttaggattagtattatgtctaagcatcacacattcacaccttgtgggagtttaatttgtttacagctaacagtcagataacaataaattcatgtgtaacaacatgcaggaagctgatgagcgtcaaaagatcatgaaggatccccagtcagctgttccagcagcctttgtttcatttcgttcacggtggggggctgctgtttgtgctcagacacagcaaaccagtaatccaacagtctggataactgaatgggctccagaacctcgtgatgtctactggaataatctatccattccatttgtgtccctcacagttaggaggctgatagttgctgtggcattcttcttcctcaactttttttatgtcattccaatagcattcgtgcaatctcttgcaagccttgaaggaatagaaaaggcgcttccatttctgaaacccttaatcaaaatgtaagtgtttcttcatgtgttgattatttatactattattgcatttccatgatttattcagcgtgtaattaatttgggtacattagacatatggttatcttctgctattcttttgaaatgccctgataaatcttgttgactattgtgcagtgatgtcatcaaatcattcatccaaggttttcttccaggaattgctttgaaggtcttccttatattgcttccaactatactgatgtttatgtctaagtttgaaggattaatatcacagtcatcactggagcgaagatctgcatctaaatattatatcttcttgttcttcaatgtatttttgggaagcatcgttacaggatctgctttagatcagcttaaggcatacattcatcagtcggcaaatgagtaagtactcctatgccgccaactctaccgacttgaaagtttagagattatatacatgcttggttgttcatttgagtcttcccatcttttaataggatgcagtttatttttcctgcttcgcggatctctgtttgttgacaattgtatttttagcaattaattatgggagaacacagaaaaatctggttcttgtcggagatcactttgttcatgccggctgtcaaatagataccaagttcttaattctgttttgattagtactgtggattatatattcaggagctacactttgtttgaatatttagacacataggctaaatcaaatatgaaaaaatgggaccaatctaggaaggactagattgattttgaattaaggagggggtgaggctcgaacccggaccggctagctcgcagcttgcgttgctagccgggaaggccccgggcctttctccttaatcaaatatgtcaagcagtgaattatgatatacattcttattaaataaaacatgtgctggtggttcaaataacatcatgaactcgtgatatattggttcttaagctatcttagaaatagataaattcttttggttacagtgagttagacataaatagcaacataatgatgcttaataggcaaaaggggggccatttgttgataggctaactctgtagatgcagagattttggcatcaaggcaaacgccaaagcatgggcctcagatacttacctcgtggaaactcagatcgtatttatgctttcacgtaccgatatttatgtcctgctatttgtctgtttattttacaactcattcttcacattctctgattgaaaccaaatgatcattacaatttgcagcaagtctaaattagttcttttgcagaataccgagaaccatcggtgtagccattccaatgagggcgacttttttcataacatatgtaatggttgacggttggactggtgtagctggtgaaatattgagattgagggcacttataatcttccatttgaaaaactttttcttggtgaagactgaaaaggacagagaagaggcaatggatcctggtagtatctgttttgattggtgtgaaccacgtatacagctatatttcttacttggccttgtctatgctgtggtgacaccgttattgcttcctttcatattggtattcttcgggctggcatatgttgtctaccgccaccaggtaaggaccactgcagctacttgcgagaattttattgtgttaagttttaagtgattatgatgaactactaaattagcttgctttgtatgactatttagaccatttttccctggtttattggaaataaacttcattactgatcggcacaaacagtttccactcatgatcagtgttgctatgctgttgtgcatgtgttaagggtatgtaataatggctaagatttactaagaatatgtgcttggatatattgttttgagttcgccaacacaagggagtatgctattgtgatagatggacagttatgctagctaaaagttacatgcaataaatctatcagaatggtcatgcaactaaggggctgttcagctgcctgggatgtgcaagaacagttccccaagcacgaaaatagcagcgggcagcagcttggcctgccgaacagcccgctaagatacttccattatcatcaactgcaaagcaatttatatgaaactgcagtgatgcaattaatctacatatgattcctaattttgcgatattaattttatgatttagttgtgtatatagtgttttggtatgcttacttggttgcacatttctttgaagataataaatgtctacaatcaacaatacgagagtggtgcacagttttggccgagtgtgcacgggcgcataatcattgcattgatcgtatcacagctacttcttattggactgttgagtacaaaaggtttcgaggagacgacaccagttcttgttgttcttcctgtgttgacgttttggttttacaagtactgcaagaaccggtttgagcctgcatttgtgaggaacccactacaggtaatgtgtgacaggaagttttgtatactgaaatgtttgttttggtttggtggtaagagtgaaatttgttggatgtgcaggaagcgatgaggaaagacaccctggaacgggcaagggagccaaccttcgatctgaaagcgtacctggccaatgcgtacctgcacccggtgttcaaaggcagggaggaggaggacaatatgtcaatatccgaggatgtcgggatggaggaggtgatcgtgccgaccaagcgtcaatctcgccggaacactcccgcccagagcaagtacgaaggctccgacacgctctctcttcctgaaactgtacacgaacgatagagctacgggaatatcagggtgactactagcttgttgaattctttatagtctgtacagatagattgatacatacctactcctacggggatgttggcagatagctttgctgtacactttacagcacgagaggtatatggagggattgttcaacacccacagactgatgattggattgccaatattatgatttctttgttggtttccaactgcaactagctgtagtagtaaattagtactaccactgtaataatataaaccagctagctagtagcaagtttttgtcagtgcaagtgtgcaaccgcgcaaggttgttaacagtaaaaggagtcaagccggggaagggacgggagatgcatgaacggctttgctttgcaagccaagaatattcattccccactgactgcctgctttgttgggaacatcatgcatctctcattattatatcttcatatctcctctgctatcttctaaattctaaattccgaagtgcgtgtgcgctcatatctggtgtcatttcgagagctctcctctcctctcctctccagaaaagcacaaccaaaacccttcatatgtaggactgctacctgcactgcatttcatcctgctgctgcttgcaatggcggtacaaaagcgatggtgatgcatgtcaccatctccgagtcatcaccacactactgtcgtgcaagtaaccatcaatctccatatcttcctcagtagccgcaaatatatatactccaaaaatacataaattatgtccttggccccaaaacaacatagattcccaattttcattagcattaactttgggtcattggcattatactccttccaaagttttaggtccaataaatgctgagtcttatagttttcagtccaatcacacaagtattgttttcggcccaaaatcacatgtatattgatcttggtatcaaattttcatgcttattaaacatgagccccccaaaagtatctgattgtatttttcagctcgtaatttcagtagtgtcaacctcgagccaaaaaattcataaaacaatagcctttgcttcaaattttcatgaataacttgagcccaaaacgcttgaatatttgcatttcggctagaaaatgaacggcgtttagcttttagccaaaaatttcatgagtggtaacattgaggaaaaaacacatgaatattagcctcctacccaaaattttcatgataattaaccctgggcccaaaaaattgtgtgaattttagcctccggcctaattttttttttgagtattaaacttggggggtttgaaaacacatgaatactagccttcttccgaaaatgcaatggaattcaaattctagtggctatgaacattatgcacacacacggatgcaatttttatggggtttcatgaagctagtgatttgccatggtcttcgtctctttgagaatctattaggggcaaatttgtgagtgtgtgtgcatgtgtagtagtgcatgtatcttccgtgtaatccaaaaaaattctccattattaaccttggcaccaagatacacttgactggcaagggtatgtggtttcaacctcaacaggtaacatgctcatattattttcttaaaaggtaattggagaaacgtctctctaaatctcgttttttaaatcttggcaccaacagtgcataaattctctcttttggcccgaaacacatgaatattagattttgattcaagatttcaggagtactaacttctgaccaaaattgaatgaattttagcctttgccccaaagcacatgagtattgtccttaggcttaacattgcatgagtattatccttggataaaaaaggaatgaaggaattttagctttcggtcctaaatttcataaatacttaccttggcacgaaaatgcatgaatattagtaaatacttttgccccaaatcttatgagtactaatgtgggccgaaacacatgaacaacggcgtccaacaacgacaacgacaggatcgaagcttttcccgtcaacgatgacgagggcgagcatcttcttcatcagtacagatgctaccaacgatgctttggacgacgaaaaagaagcagcaagaggcaaagctgtttgggaatcgccaacttccgcgagcatcttgctcaggattctaccatcatacatgcagagcagagaagaatgagatcgatcatctgtacttgaactgggaggagcagtgcgcagacgtacgcccaacccagctgatcgatcagccgatccatccatccattatatgacgacgacgcccaagtacacttaacaatggtccagtacctttaatactctactgagcatacaccagtgcaaaataggctagaccaccgtatcctccctgtatacacataacagcacaggcagtgcagaataaagccagcttcaaaatgtctatgccacctatcaagcatctataatcagatcaaatgactagaaataggcctgtgcgtgccaacataagtccagtcccgctttgtgtttcatcaagttttcaaaccaaaccattttgacattaactctcatccatgggatcatttccaccgcctctctgggactctgaatccttgtctccagctcctgaagcttttgccacggagtcttcaagagcctccaggaacgaagctactgtgaatttatctgtgccacaaagacacccatcaaataagttttccgaaaacatctcactccatctccagattttacaaatactaaataaatcattttcagacttgaccaactagcatcaaggatgtttgtcgtctagcagaaaaacaacgctcatattttgggcaggggtcacctccataagccattgaaagtaaaagctagactagcaaggtaaatatcatggtcattgaggtatcagttgcagaatttgtgttttttcaatacataaataaaagtttcagccacatgcacaaattatctaccgtgtatttgcgaatgaaaaaaaaaaggagcctgctacatgctgcatttaactttactgttcagtgcaaataaacgagaaatttggttgtcaatataagtgaagatgagaaggattacatttactagggtcaactccaaattgtgctagatctatttgcccagtccgcagcacctgccatacatgcaaatatcagaataaaaataacatttgaagcattgtgtcacgattcaccaagatgttcaatagaaagatgaattactaacatgggtaaacgcttctacttgctgccgcaaaggaggactttgcaatagttcaagaatatcaccagcagtccatgggccctggaattaagcaagcacaataaaatgagtggaagagtcaattgaagtaagaaccaggatgacaaatacaaagttacaaacctctggaagatatgatgccaactgttcaatgggcaaagtttccatgagtggtaacaccaaatcaggcttcaagatgtctcctaatcctaatcctgttacagcggttaaaagtactgatacatacagcaaatcattgaagaaaagtgaatcaatagagtattgtactgtaattaccagcatcagggtctgccacagcatctgaaattacaaggcgaatgcaagtaaaataaaatgagaaggtggtcaaatggaagaacatttcaaaagtgacatgatttttcagctgatacctgatggctgtatagcactcagtattctctgcaggtcttccaaccgtactggcccagcagcagatgtcacctcaccagctaaatcagcagtcatgctctgatcaactaaattcccagctctgatgagaagaaagaaggaaacaaaggggttagaattattaaatggtcattaattcattatacccaaaactcaacacgcatgcatgaatgccatatcaggaacaaattgaggccacactttcatatatatttagcaggaaaaatatcagtgtgaaaataggaagaatgaaaggcagtgcacaataaactcagctagacatagatagtgttaacttatgcatgaaattggagtgaatatacttgtggtttataatgaacgtgcatccatctgttactctgacggccccattgaaaaataaagattgcaatgcaaacgtctaggtttttctgtgctgcacattgcatcttgcagttcgttaaaattacctggaggagatgtcatcatcagctgtgtcttcatgtgacatttcagcttcaatagaaactgcctcaccatctgcacgcccatacaacttaagacacaagaaaaatgagcgcataattaagagttgagatcccaacgttcagcatacctaatggtcggtttatgtaggcattaacttggcgacatatttgtgagtcgtcatcagcacttggctcctgcacagtaaagagcaaaacacaagtaaattttagctggtggaaggacttctgtggttttcaaacagatacacacacacacactcaactgacctgcatccagaagaagaatttcctgctatcgtgcctgaacttcaagatgtaaacccttccagaagattgtgttacctgattaagttgaattacaatcatcaatgaagcccaagaggttcactaagatggtcttgcagaagaaaataaacttgaacctatattcaataccttctcaaagacagcctcctcagggaagacaatttgatcctgtgaaaagggaatcaaggatatacaaaagtacgataatttcctaggatatacacaatggaaatcaggagaaacagacacagccaagttcaaagttcaaacatacgagtcatacaagtacagtatttgcagattaaaaaatgagtgcacgatgactactaactactatctatgctcgagaggatacaacttcaactagattctgtccacgatcaagccattgaaaatgaaccaagccttcttcaccctacaaacaagtggatatgttaactgcactgcaaatccccataaaatatgagaatgcaaatggcttataagttatactggacaaatagaagtacagaacttcaattcaagataagtatgacttttagcatgcatacccttcctatgcgaacaagacccttgcgtgtgtctgggatcactcgtgttccatcaagggacatcttacccgcacgaaactcgcacatgatatcctgacaaacacatgagagattgtttttaaatagaagctcaacaccttgttatatcatagcagagataaatgagatggcaaaaataaatatataggtcattaagattctgaataagcacaagatcttaatttgagatagatcaataagcaccatgcactgcaacagaaaattaactcagttcactgaactactgaaagctcactatacacaacctacatttcttatcagaagattttcttgctacaaattgctagctaaatattttggccttttagagtgcaggcaaagattaacagaagttctatcccagttttctgaaaagaactaaaacataaagaaacaaactgcctagtatacaaaagagacatctatgtttttttttctttttttgtatcatgtacgatgaaaaactggtccaaacatggttcaggcctttgtacatattacacacaaaacagcccattaacatggtactaccaatgccattttctgtcaggctttctttaaccagctggctcacttgtcatacactcaattacttggcaagatttgcgaatagttgagaatttgtccaccacaaaagacaacctcaattatccttttggcaaagtgttgataccaaccaaacagcccataatgtcattttagatggaacttgcagcagctaaatcatgatctcaaatcaacagcaaccgatcatcgcagttaaacactaacaggaaattcggtatttgaaaaaaccaatacttgcagaaacactagaaggcaaagtgaggagtttacctgtaggggctctgtgctctccattgattaaagagtggctaccacaaggtgcaggccctaaaacaggcagtaaaaaggacagtaaagtattggacatagaacaaaatcaagcaagtgtgaagtataataggttatcagtaactagttgtcagaagtgtactgcatgccaattgagatgaacaaaaggtactgtagtctgaaagtagtagctgcctttagaactttgtgcatatgagaatgaaaacattatgcgcatgtgttggtaaaatacagaaaaatgcacttgtgaaggattaaagaagactagatctataaatttatgtacactagagtctttgttgtgcagtatttgcatcttcaagtagcacgtaggcaactgacaaattagtatttacataaagaaattcctgcgtctgcgtgcttgtagatttgtaatttgtaaggtggtttctttgggctttataagatattattactgcattacttttgtgctgctgtagtgttatttcatagtggagaaccaacgtgacccaaaaaacggcgaagactagccaaaaaccctagcagctagcaagtcgcattaacataaaactcgtcaatgattagcttgtttgcaggggctagttccttacaggatggtgcagtgttttatgtttgtttatttttttttcttacatgtagatgtaagcaaggagagcaaaataggtgggtgatctataagattttgctggtaaggacccaagaaaaacatgagcaataaaatcgattggagcagccgtcctagaaagagagatttggattggagagaggaacaggtagggcaagggagaagaaaatatcttagaaacaatggagcaagagttggtcaccactcagtcactcaccaacaagtgggggattacggaggagggctggacgtcgtcgtcgtcgtcggcggcggcggcgggacgggaggagagggattctccgacgcgatgtgatgtgatttggggaggcgatgacgacgggagggggagcagagaaggatctctcatggtgggctgggcttctcttagctgggctggagaggcccgcccacgcatttgatggcccatataaaagcccgctcggcaactccaaagacgaagttgagctagggttttcaatctctttcttctctccaaaacacaaatcgtcgccgcatcccctcaactccggcgatccccttggcggcggcggcggcttccccaatcaccccactccacctgaactacaggatggcgtccgccggcccggggctcgaatcgctcgtcgaccgtgagttcatccctcttttttttttatctcatctcacccagctacccaagattctcctcctcctactattactagtgatagatgatgttttttttttctctccagagatcatatccgtcatcacaaacgatggccgcaacattgtggtgagccccttgtttgatctactcgtacaccttttttgttttttttggctctcgctaatactcactcgaattgccctgcctccgcttcgtcaggggacactcagaggattcgatcaagccaccaacatcatcctcgatgagtcccatgagagggtctattctaccagggtagggttgctcccaactctttctacgcttctttcatgctatcttgcaaaccttcaattaattttacagcaatatcaatatttcactaagctagtactatatgccctgataatccggcaacacacactttacttccatcttcataaagttatgtttacaaggcggtcatacttacagttagttactctgctaaatttttctgcgtttagaatctctaccacagtctgtttggcattttccatagagttgcctgtttgctaaggctacaagttcagccacacaatttttttttgttattccagtatgtccttgttaattgtgaccttctccctggtttgctgtcaaatgctctcattggttcactagtgcagaattctgcaatcagcaataagtttctctcatggtgcttgaaagttagttgccaacatgtattacacagtaccctttatggctaaacacagattgttttcaaagatggctctctttcatgatggttataaatgtcatcatgaagtaatgagttcatattgttgactgttcgtatctatcatcatgtctactgtcagtatgaactgaagttcgtttcctgcaaaataatgagtttatactgtaacatgttttagctgaatttgtcataacagcacctttttcttcaaggattggttcgattaattctaccttgtgcacgttcaatttttcagaagtcatattattttttgtcttcaatagttaggtattggaatgtctttgttctttatggtgcagagttgttgttctaacaatttgcaggcaatgttgactatgaatagttatatgtctcgtatcatgcacctctctattgaatatgggatatgccttcttaaggactaggggccaatgcctttaaattgtcatgcttttagtttgtggcatgtgctgttagtagtacagttgaaattttgagtagtgatgagagaaatgtgttgtacctgcaggagggagtgcaacagcttgttcttgggttgtacatcataaggggcgacaacatgtaagctatttcctcaattgtcgtttgagctgtttattgcttattaattacctgcatggaggtcgtttatggatgtgttattttgtttggtggtgtgcctaactgaagttgaatccgtgggtgatgcatatttacagcagcgtggtgggggaggtggatgaagaactggatgcgaggctggatctatcgaatctgagagcgcacccgctgaagcccgtgatccactaatggaaacgaatgaatgatgtactactactagtagtaagctaaacctaaatgtagtgttgtcccagaagttgtgaagaagtgggtgctagtgttgccgatgagtgaacttctttaacgtacgcgaggaagtccagcaagcggatgagcgagcatgaagaagaatgttatggttttatgtggtggtggatgggtgatgcatgtttgttgaacacgaacacagacacagtgactcagtgagtgaagatttggtttccattgtattgtattgtttgtgcagctgtatcaatgtacatgaatgaggaaggcaggcaggtcagttgttgaagagaagaagagcatattaggagtaggtgggaggggtagccggctggtgctgctcgtctttgaagtagttgcaggtgatgaagacgccgccgttgaagcactcggcgcgggcgcagccgatcctggtgaagttgggcctgaccatgaaggcgaagtggccgcactcgtggaagtcgacgccggcggtgcatttgccggtgtccctgtcgtagaggtgctcctcgtcgccccagcatcggacggcgtcggaagccctggcgttccagccgttcctcccgatgtagaggctctcggcgaagctgttgccggtggagtggcggatctggcagtcgccgcgcatggcgtcggaccaccgccgcgcctgcctcgccagcttgttatcccacctcatcggctgcagcccgtagcgcgcgcgcagctggttgtggccgtccacgaactcccgcggcatccccttgtaccaacccatcccattggtccacgacaccaaccaccccgctggtgccgatgctgatgcgtcgtcgttgaaccaacacatcgcgtcgcccacagacagcagcagaaaccaacacaatagcaatagtaatgggaggatcatcgcggcggcggccattgtctgccgtcgtcccgacgaggacgaggccgcccgccgatccgatccaatccaatagtgctaatgggcttcttatatcctagctcatcttttgccatttgcttttcttggatttgcctctcgctcttccaaccataaacaacgaactaataatgccaatgccaagtttaggcagtttttcttttcttctctgcatcgatcatatcatcatatcgcacggccactctgtccaaacaacaaagcctaacctccccgggcactggcagggcagctggctgggctctggctctaccagcttgctgcctgcctgccgtgtctcgtctgcttctacaactacggagcacctgtttgcaacggccaacggacggaaggaatgttttttttttttgtttggcttggattccatccatcctctccggcctgttcgtgtgtacgccttgtgctaggctaggctccacacacctggacattctactctcgatcgttcgcggtcgcggggccctcttctgttctgttgcgttaattgcggccgctttgctttcaattacttaatatctgttttaatttcttcgccacttgacatggttatgagtatgacagattaatatatgctatcttttttgtaagaaaaaccgttaatatatgctagctacgactgcatatatatgacagattatatacgtagtatatacttgtggttcgcaataacgaccagctagcttagctagcggatcaatcatacgacgttacgttacattatactagtacgtgatgatcaaagaatcatgcatgtcaagctcatatgtgctttgtatctactaccttacacttgctctgcttctttaaccggaaaagctgtatggctgctgaatgatttttgctcggaaaactaactatgccttacgctttcccttgctctgcttctttaattgggtcggagtgtgtgtacgtatatatgccgatatatatgatcgatatgatgcatccagccgcgcgctgtagaccaaactagctcgatcggattcaccctccgatcgggcgattgatcatgcaccaacagctaattataaggaaacaaaacagagataattagttatatactactccctccttcccaaaatgtttaacgttgactttttttaaatatgtttgactgttcgtattattaaaaacttttatgaaatgtgtaaaactatttgtatacataaaagtatatttaacaataaatcaaataatataaaaagaattaataattacttaaattttttaataagacaaacagtcaaatatttttaaaaaatagttaacggcgccaaatattttgggacagagagtagtatttagttactcctacctatacgttgttgttgatttcgagaggcgccgaccagccgctgatcgatcgagctacgtagctatctaggaattaatatacgacgaaagacaagttaccccatactgtatatgattatatatgaaatcaaatcaatcaattaactaattaattaaatgaagatgatgtgtatataaagacctacgtgtccggatgtatatataagtattccagtaagcaacatgcatgcatatcatccatataatgaaatcatgaatgaagatgtgtgcccctggcaccgtccatacgtaatactcgtacaattaacatagggtagtagcagtacatgcagtagcttatcttgtttattatctggacacacgatcgagtcatatatatatgtgcatccgaatgcgtgtggataacagctacctccaaatcccaatcacagtcacaatcagaatcgcatgtctttgatcgagtaggatcgatcacaacgaatggatatgtacgcatgcatcacctccatcccctgtctctcccgctctctttgaccattgcatatatatatatatcttcttcttttcttacatacatatataaataaaagaataaagattatatatatatatatatatagtaaatttgtttggtgctccatggtgtccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttaaaaattttgaaaaatttgagtgatttgtacattagataccatggtgcccgggcaccatggagcaccaaacaaatttaatatatatatatatatatatatatatatatatatatatatatatatatatatatatatatatatatatatatatatatatatatggagagagtgcatgcttgactgtcaacctagctatctagctacggatattatttagcctttgattgatatgatatataagaaaagccatatctagagtatttacactcgatcgagtatgtagctagggccgagtttagttacaaaatttttctttaaacttttaacttttctattacattaaaatttttctacacacacaaaattttaacttttccgtcacatcatttcaattttaatcaaacttttaattttaacgtaaactaaacaaatcctaacatcctagatagcgagccttgccaaatgacgtgtgtgcgcgcgggtggaattagctactgggggcggggcggggccggccgtcatacgaacgtggaagcgccagctagcacttgaattgcttgcttcctttaatttgtttgttttgttttgttttaggagcagaggaagttgaagtattttgtttgtttaattatggtgagagttaattttactttgggccatgatttattattaaagtttcactttagactaccctttgtccaatctttttactttaaactagataactttatctttattgcacaataaaccaccccaagcaacatcttcaatacttcaatgacttcaaggaaattgttacctacgtgccaacaaattttcatatatatatacataccatatatttgtcgaaagagacgctagacatcactagcgaaaagagttagggtggtccattatgtaataaagaaaaagttacctaatccaaagtaaaaagattatgtacagggtggttcaaagtaaaactttaacaataaaacatggcccaaagtgcaaatcactctgatgataatgactcttactatagtggaatggactaccgataccgaaagctaccagcacaacgtaggagtgcgtggtgtgcatcgcggccattaattatgtaagctatttagagtatgaccaattgttaccttcaattctaaatccaacccttttgacataggaggtcagcaccaaccttttagcgctcatctcaagcacaccttaacaaaataatatagacgttgttctctcattttcgtaatcttaagatatctcaagcataccttaataaatttgtagttgtctatattagaatatgtcacatctatattagagttgtatttatattaaaacgaaggaaatccatatattatagtagcagaccaataagatggtctagtggtttggggtagctgggcaactttattataggtcaagggtttgacaagggtagcaagagaaacattaattttataccactgtaatacaacaactactttcaaccttaatggaacaagtagatatatagtactccctccggtttcattttaattgttgttttagacaatgatacggtctacaaaatatacctttaacattatttttctattataatatacacaataaataaatgcatgtttatttttattatagtattttgaaagacaaatctatatatgttgttctactttctttaaactatatatttttgagacccggagggagtattaattaactaattaacacatggcgttgacctcctgctgacttagaaaatgtgcgagctcgatcggtacatatacgaagtatatatctcatgctggtattacgtacgtggcgttgatatatagtagtgccatcggacatgcatgatacggtcgtggtttattttgaaataagtttattatttagttttgaagatggcaatttggcgaaagctagttccggggagtaactactgtacatgaatttgggggcagacacatgttaggatagagataggaaggaaaaggaatagagcacgcacgcggcaggaggtgattgggagtgcaacgtcgtggtcggcgcgcggcgtctgcagggtcaaaaggcctggatgatgaagccgcgcgcaacgtgtacccgtacgcacgcgccatgcgggagcgggacgacgactcgatcgaatgacggacgttatgcttattccggtgaaagaaatgcgtgtcacacgcattccggtgacttgattttaagcaagcaatcaagctagctagcgccaccccgcggagtcaaccgtacgtggatccatgcatccatcgattcatgcttaattatatatatgctcctgcgtgcgagggccttaaagcgcatcaaatcaaatgactagctaatgcggtaatgccttcaacttcaaatggagtacctgcctatttacgtacgttgcacaatcaagcaaccacatccactttaattttctctatctctcttgagcctctgtttccttcctttacttgctgtcaaaaaagtggcatcacccccacctcacaatgcaagcaatgctgctgtaacatgatcaacgacagcatatatattgcgctacttgctgttaacgttaatgattcgactctacatagtaacgatggaagtacaggcggggaaacgaattagacacagttttcgtgttccttccccccggcggggtgggtgtcccttaattaaataacacgatgcaagtactacaagcgtaacacaacacacttgagcctaacgaatcaatttaattatctccatgtgtttacaaaaagagccacacagttcgctcttaatttactcccttttgttgaaggggaagttaatttacttggtgagatttgagcaaatccacaaacttgaaggtggttggcagccgaataatatgcgtttagttgttataggggctgtttagattgatgctattttcagccatacaaagttgacaaaaatttgttaccaaatttggtaaatatataaaaaatgctgtcaaaattttggcaatattgccaacttgatagggtttattttggctgcaatctgaacaggcctatggaaggaaggtaaaagaaagagggaccgacgatatatagatttcttaatagaagtggtgagtaggagtaataaacaatggagtgataatctctatctctatctctactattataaaaattgaaatgtttatgcggtccatcatccgtgtttgaggttcgtcatccgtatttgaagtcggttttctttggttttaatctatatctcttctctactattacaaaaactgaagatgtttttgcgggtattttgatacatcatccgtgtttgagtcgggtttttaaattcatttgcttttggaaatacaaaaggaatcatataaaaatctctttaaacaaacttgtatgctaacttgagatgaatgtcgaactcctaattgcagctcatgtttttctagaaaaaaaatccaagcgaattcccacggtggattaacagttataagattaaaatagcattcatccgttgcaacgcacggacattttcgttcacttttggtaatatagaagaaatcatataagaaatctatttaaaaaactcgcatgctagtcgtgggaagaaaactcgtgaaggaaggagaagattttgcaaagagataagaattgggcgtacacgtgggcggggcagatcgatcttagatacatacagattgaaaaagaaaaaaaagaaaagaagaaggagaggttgagggagggaaggaagctaggaaaaagggaaatactcctaaggaacgcggcggccgtttcccgaaccgtcgcgggcgttccctagttggactgggcggttccatcccagacgcaacgcgcagcggtcgtaggagtaggtgttttttttttgttttgcagttgccttctctcgaggccggggggctcggctatatatcctcctcctccccctcagttccgcacaaacacaaattaacctcctcctcttcttcttcttccgctctctagctttgctttgcttgcttcatcaaaccccacacacgcacacaacaacaacaagagtaatcaaagtagaagaagatggtttcggccttgttgcggacgatcctggtgacgggcggcgccggctacatcggcagccacaccgtcctccagcttctccaactcggcttccgcgttgtcgtcctcgacaacctcgacaacgcctccgagctcgccatcctccgcgtcagggaactcgccggacacaacgccaacaacctcgacttccgcaaggtcttccttccttccttccttccttacttaattctctctctctctctctctacattagattctgattttgcggttccttttattaatttaacaaaacaaaacaaccattcccatctcgataagcggcgcgcggcgatatatcataacttgtctttttgattagattgaaatgaaatcaattggattggattaatcatctcatctagtcaacatattactagttacttatatctgtattcgggcgacacaaatccaaatagtaactactcctcttcctccttagtaatggaaagttagagttcctacaaatatttttgtttgaattggagttgtagtcgttcgttttcatggggaggcggtcaattgaattgaattgaattgagttggtggagtagtagtggaaatgggaaaaaaaaacccaaggagggagggagggaggcgttggaaggcgccggacgcgttgttcccgcccccctgcttcatttctgttttgatttttcatggccaagcacacaacgcatgcaccacccaccccacatacgttccttctactttctttccacccatatataaaaagatcctttacaatccacatctcaatctcaaatataaataggattattaatactaataagctcattcccctggtgcattgcatactcataaaatttcttgcttaaaggactcaaaatctatcttagactaatataacatataaattattatgcaggttgacctccgcgacaagcaagcgttggaccaaatcttctcctctcaaaggttggttagtcttccttgctccttcaatttgcacttaagtacctacctttaatttgttttcatttttggttagcagcgtgacaccgtaaatttcagcataatatatatacaaactatagctattaaactatttcagcataatttcatcggtcggtcggtcggtcggtcgtttattccatgaatcaaatcaaatcgatcattgtcaaaataattactcctcatcatgtattacaagtattctggacctagctagctgctcagccagcctgccaggtcaagaatctggtgcttggccagtttaatttgcagccgtctatcacgcacggtagctgtcacgctcatagtaccaaccaacgaaccgaaccttccttgtggaattaatgcattactatatatcacaggtgacagtccatcccttttgtacccaaccgcgtagtatactggagtactaataagcaatactatgatgaatgaaatgaagagtagtagtaggtattattatctgttttggcgaagatttgagacggacggacgctggtctgcttggctgcaggtttgaggctgtcatccattttgccgggctgaaagctgttggcgagagcgtgcagaagcccctgctttactacgacaacaacctcatcggcaccatcactctcctgcaggtcatggccgcacatggctgcaccaaggtacagcccccgcaccatttcatttatttttctcccattgttttgctttgcctatatgtatatgcgtgcctcttgctggctttattggttggctggcctggctcttctttgcattgctgggggtcacaggatataccttatgcctttttgcattgctggggaacacaggaacatataccacagattacctacctatcacaaccactctgtgtctgtgtgtgttgtttgccatgcatgatgcacgggaatataaccctcccctcttaaaattgctgcctgcctggtcccactcccagccaagatttttttttttgttctcttcctactgccctctgatttttcttcttcctttcatcttgttttggttggttggttggttctgagcttactctggaggcggcatcgcaacagatttatacttacttaatccactaaaagtaaacatatatgctttagtttttaataatggacataatcataagctattttgctccggccagctggtgttctcatcatccgcaactgtctacgggtggcccaaggaggtgccctgcactgaagaatccccactttgtgcaatgaacccctacggcagaacaaaggtactccagttttttctcttctgttatactatattcagttcaatcatcatgcctaggatcaatcaatcaataaatcctaattaagccaaacaacatatatatgatatgatatgattgcagctggtaatcgaagacatgtgccgggatctgcatgcctcagacccaaactggaagatcatactgctccgatacttcaaccctgttggagctcacccaagcgggtacattggtgaggacccctgcggcatcccaaacaacctcatgcccttcgtccagcaggtcgctgttggcaggaggccggcccttaccgtctatggaaccgactacaacaccaaggatggaactggggtatgtatatgcattattcattcattctcaacaatcagtcgtatatgatttactaattaattttattccttgccggcaggttcgtgactatatccatgttgttgatctagcggatggtcatatcgccgcgttaaggaagctctatgaagattctgatagaataggtatatatgaaccctctcttgttgtgcatccatccacgggacgggacacatgaaaacatcatcatctcataaattaataatttatgtggctatattcttccaggatgtgaggtgtacaatctgggcactggaaaggggacatctgtgctggaaatggttgcagcattcgagaaagcttctggaaaggtaaactaacaggacaagtgtacttcctcttaattactataataatcattaattcccaacttgtcctttgcttttgttgatcatatgatgtcgtcctaacaataataatgccaacttgaacagaaaatcccgcttgtatttgctggacgaaggcctggagatgccgagatcgtttacgctcaaactgccaaagctgagaaggaactgaaatggaagtaagtatcaggatatatatatatatatagcatctcacatcatttcatctgtactgtaatgaaatgaaatattaaaatcatcatgtactctcttcacaccagggcaaaatacggggtagaggagatgtgcagggacctgtggaattgggcgagcaagaacccctacgggtatggatcgccggacagtagcaactgatccagctgaatataggcgtccaatcctccagtagcagcagcagcagcatgacttctatacatatatatatataatcataaagaatgaagaaacaaagaattcggacttgttgagttactactactactactactaatcccatctgatggaccgcattgtatagggggcttgtaggggtccagcagcttcatcatcagtctccttaggaggcctctaatataatctccatatttatggtagaaataaattttgcccaccgtggaagaactatataatagaatcatgatgatttgttgattcattgtcgcgtcgattcgtgcaaagacgtgtatgtatgtgcacgcccatcttcttcaagtcacattgcacaagttgaattgggccttaaaagtacctaaagttgatcttgggtgtttttccgtcaggacatacctttatgatttccgtatccatcccaacaagataaacgggccagccagaccatctccgaatcttcgatccgtttgtgtctctgcaggcccatgtaaaatacaaagcttgcgatataagttcactttaggtcactcctgttgacgttgaatctgaattccatccttgacctactacaccagaagatatagagtacccaaactatttttttctggtgccatgtcagctaaagcagcctataatactatcttaggactatatatgtaccggttttaaaaaatgagtgatgtactatatctagtatggtggttcaaggatgtgattcaaactgaacgtcaagataagagacctaaagtgaacttattccaaaccttacttacagggcttgctacagacacaataggcccaactttactacatttgcaacatacatgacaactagccacaaaactgtaaagtgataagtgaagcacaaacaaaaccacaaataccggtcatactcatatcacgatcttaccagataccttgtggtccgatcaccattagagatgataatgctatggaatacgttgtctatagagtagatatatatgatctgaatttaagaggaggggatccctattaagcgaaaatggagggtggtctagggactacttggaccaccccccttggaattgcctatgggtatggttagctattggctgagctaattagttgcacataaaacgaaatgggtaattgatgcatgattaattgaatgttaactataaataataaattcatttgattgtttcaataaatttttattatagatccaagtttttgcactctagtggtttaaagaaacgtgctcctaaaaatgaaaaggtagcccgaaccgaatagttatttggaactcagccttggctcatgtagataacctttcgaaccggctatgagacggagattatacccgcgtcaatctgaattattggccttgaggcaacttttgccattcatatcatcactaaagttaggagcataaatatgtacatcatctacttagttaatttgtgatttgggatgaatgatcttgtacaacttttacatcgtatctatacacgggaggttcgatcggtggcaacgaacgtgttgatcgataaagaagggcgccttgtgtgttgtgtgtaatcttctctctaaaaacaagctactaaaacagtaaaaagaaattgcactgtataaataaataaataaataaataaataaataaataaaattcaaactcaatattgtttttaacaaattaagaaacatatatatgcaaaagaaaaaaaactgaaatacgtatatatatgctactccagaaggaaattaaaagtaaatcgatctggcactagctagaaagaaatgaagaaatgacaggtagctagctagtgtgcaggaacgcgtgtgggtggaggaatggaatggaatgggttaggttagcggcacctctcccttccagttgcccggcgggtcgtaggagcaggtgatgaagacgccgccggcgacgcactcggagcggccgcagccgacgagcttggtgtcgttccagacgatctgggtgaagtggccgcacatctgccccgggttgcagctctgcccgcgccagtcgtagacggaggactcgccggcccagctcttgacggcgtccgtggcgcgccagccccacccggtcccccagaacacgttctccccgtacggcgactccggcgagtgcatcatcacgcagtcgaaccgcctcgccgccgaccaccgccgcgcgtacctggccagcttgttgctccacttcagcggctgcagcccgtactgggcgcgcaccttgttgtgagcatccaggaactcgtgcgccatgtacttgtacgtcccgcgcccgccggtgaacgactgccccggccccaccggcgccgccgcctccggaccctcctcctgatcatcgccgccctccccctcgccctcatcgtaattgttgttgttattgctatcatcatagtacggcttctgattctggttctggttctggtcctggttctgattctggttgccgatgccgatgccgccgccgatacccacgccgacgttgacgcgaaatgacgcagccggccggatcaacaagatgaggtacaccaccaccaccagcgccaccaccacgacgcctggacctgcagatgcggccatcatgtatgtactctcctctcctctcctctcctcagctcagcttcctaattacatacacatatatatatgcaatcagcagcaaccaattagctagctaggaatattatgtgttattagctagctagctagtatgcacagattatgcattccattcatcatcgatcttctagcttgtctacccagcctgcaaccttaatttggccggctatctgctattattaatctgcaaggacatcggaactccgatcgatcatatccatcgcttactcccatccacgcatgcatctttatttctcaccccacgcgcccgggaaatgagctccgtcgatcatcgtctaaactctatttcttaccattcaatttcctccaccattgagggctagctatagctactagctagcgagcggctgcagcggacgagacgatcgaacaagttaactagaagaatacggagtagagtaatacctacctagctagctgttgtactcattttcttttggggaactaacctaataattaattcaactgtgtgttgtgtagagtgtcaccaatcactttgatatggcaagttactaaccaagatggtaacaagataaaagctggttgcctctagtctagaccaagttagataatttgggaataaatagccaaaaaaaaggattttcgagacaaacatatacaaataactttgtgtgaaggtgtacgatttatagtgcaaattgataaacatggataaactaggacacaaactaggtgaaagataaagcggaacacatctatatacctatatataattagaaaaatacgtaaggattccgcacattttttttatccatcccttcctccctcgtgcacgtcgccctccctcccgacatccccccatctctttcatccctccctcccaccctcccactcgcctccgcttccacctccctccctctcggcaccccctctctccctcgctgcatgcgctccccctcctcccgtggcccctctcctccctagcacccctcctccccatcaccccgtcctcccagcgtccctcttctcccaatgatccctccctcctacgctttcaagaaaaaaacataacccccttgtccaggaacacgtttgacgcactcacctcgccatattcaccacaagagctcgccattactgtttctctctctgtccggaccacgtcgtcgttgggtgtgctcccgctgttctggttttcttcgttgccaactgccagcatccatggacgtgccacattgtgggacaagtccgaccaccttactcgtcgatgtttggtaaacgaagcaccgtcgctcatcttctcttttgtttcttgtttggctagggaagacgatgaatagtgttagtcattttttcttcatttttctttctttcaatgcgttcaaagaaaatggaatcccctcatctgagaatgcattttgacacactcatccgatcatgttcaccactagagctcgccgttgttgtttctctctgtcggaaccacgtcgttgtcggtcgcgtttctgttgttctggttttctttattgccaacctccatcatatatggatgagtcatattgtgcaagatgtcctaccaccttccttagcatcatttggtcgcccgagcaccaacgcctatcttccctactcttttgtttctcgcctttgggaagggaagacgatgacctattggccactatttcttcttggtctagctcaaccatgctcttggacgactcacgtaatattgagactatatgaatatgaataggaccggaaaaattctaatttatgtctatgaaacaagcacctgttttgttgttcagaattattggatcggattttcatctaagaactgaaataagttttttttttcaattctagctaatttaagttgtttttccatttaggatattagttttagcactatttaattcattaaaaaatattgtaacctatatttttcctttgtattaaattatttatagccaaatgaaaaaaatggagatttagttacattttttttgagttattgttccggtcaaacctatgtgtagtttgatgttattatttttatgattatatttcctttcgttatttataccaaattgtgatatagggtttataattttaatttatgttatttagaatccgttgtaacacatggacattatgatagtgattaaaatacgactcaaacggttgattatagggggtatccaattgaatcggtaaaagtccttataaaaaggttgctattacataaaccgtgtctttccacatcttattagctaggcttaagttgtgttttagagaaggcaaagaagaagattgagaaaatacgtgaaacaaggtgagtcattctcgtatgactaattgggtattaattatttaaactttaaaaagtagattgatatgatttttaaaacattttttctatatttttttttcagaaaatgcaccatttaaaggttcaaaatgggtgtgcgtgcaagacgatagattttttctcccctttatggttgtctcaaatccaacctatcagttattctctccatcctaaagtaaacttatttttcacctatcccacgtataccaatataaaatccaaagactagagtacttctgctttatcaaattccaatacaactattgtctactttatccactcccagtgtatttatcctttactttcacaaacttcgacacgatgattacttagaaatgaatttattttaggaaaattttcaaaaaaaattattttaggaaaaactggaagagccaaaaaaaattattctgagatggaaggagcagctagactagaaataccttaggcctaaggacaaaaatccgtttataatgtactccctggttgttgggttgcatcaccattatctgtccacattttactggccaagtggtcagctttgcatgctttctgttgcactacacagccaacgatgggtccgtccatcatctagccatagacgatagttgcatcacgcacatgatcgatagtactattcgtcctcatcttcattgtctcatctttcagtagtggactggtatactcgctctgagtgcatgtagtatatgtatctcatcgatcaaaacgacacgacgactgcatgtacatgtgcaagtctgccctagatctgcactattatggccctgcttgacctactttgggtttatatatagggttaattagttccacgccattataaattcttcagcttagaaatatgccactaaaatttatttatttgtagcgataccattacaattttatagcaaattggtatatgccactacttacctcttcattgcattcataaacatatttagaccattttgccctcctttttcatctccctgtcttctttcccctctctcatgtcctaatcaggggtgggcagaaaaagaccaaaccgaaaagactgagaccgagattgaaaagaccgagactaataaattcggtcataggcagtgaaagaccgaattttgttcggtcaattcggttagtctcctcggttaaccgaatagaccgaaaaaaccgaattatcaaaaaaatgtctaaatgcaacctacaatccactatgtttaatagaattaaactctaattttcacatccctacttcttataggcatacaacctaataagagtctttactcataagtgcttacgaattttttttgtgatttttgtgttgaaaatttccatagtttgtttgcatatatgaaaacgttgttgaatttcagtaatgaccgagaccgaatttatcggtcctaacatttttcgctaaaattcggtcttcacttttcaaataccgaaagaccgaagaccgagaccgaaattttcagttagactgaatgcccacctctagtcctaatgtccagtgaacctcggacctccaccggcctcaaacacttcctctaggcgtttctttaccctgtcgccgaggaagacgagcagacgcttgcccgccggagtaggccgccatgctggagctccttcgtgggccaccggagcagctgtgcctgagccgtcgtgcgtggatccgtcgaggccgtgtccgggcgtcgccctcatgccgtcgtgttttgtcctctgctcgtcctcatcgtcgtttgcttgttgtcctcacgctgaatcctctgctcgtcctcctcggcacgcgggcgagcgggcaaatgagcacttgaagggaggatagaggccggaggaggaggagctccggtggagacatgggcttcactggacatgagagagagaagatatgggaaggaagaaaggggaagaggaagaagatgagggcagaatggtccaaaatttttcgtgaatgcactaatctcaaattacatcaaaattataatggcatcgttacaaatagacgaattataatgatatatttttaaactagagaatttataatggcatggatctaattaaccctatatacaattatacatacgataatccatcgatcatcatgcgttaaaaaagagagaacatgtcctaatatgatcgtgtaaataattagcatctactcctagctagcgagttagctatctcgctcttgcatgtatatttatatatagtagtagtagtatttatatatcatggaagtgctcgtgtacaaattaaattaacgagctttttcgaagaaataagacaaataattccaaaaggagaacaaaacaagatagaagaaagaagaaggcgacttacacgccggagaaggagaattgctagctggcgaacagtcaacaggtcgcggtccaaaacgaacaaattaataagctgtaaagagatggagaccagctagctagcaatcagcttcccagccacggatattaatttatcgcaggtgtattagctttctacgcgatttaatgttatatattttgactatttaaatctattataaacaactacataactaatactttcagatacaaatataatgaaactatatatgcatggcaataagtgccactattgatagttcaattgttaatgaaaaattaaatgtcgattttcttaaaaacgaaggaactatatacataccatacatcctaagaaaaagacaaatagtaagacatgcccacaaattatcattcttaaatttctttccagagtaaatttcataaaatcctaccttttatcattcaaattacacaaaaccacagagattttgacatgtgacatataacaccaggtattatagccttaaagttttcacaaaaccaccttgttaaccaaaattgccatattcctatattaaatttttttaaaaaactttatttacatttatatgatggataaataactcacaaatttgataggtgattgtagaactgaaaagtatagacgctcaaagtcaaaacaattaatagtgttgtttttgtgaatgataaggacatcctccactattacccgctaacaaagacacaaaagtcgggcggcgactatgtgagcctttgaataatcccaccttgcttagcttgggaggaggaaaccaccttaaaagggagagccacctgtcaggattatggataccatatacctaatagtagttgactaaatctcggtaagacccaccacataccatgtcttatacgaaaactgacctcggatatggagggagttccggataaggaaagacaaccggagttctacatggaaacgacaaggattactcgaagataaggattactcggattgtattcatattggtttccctagttctactctgacaaggggacacctatgggtataaatataagatcccctaggaggagaggagagacgaaacaatagatcaacatacaagccaacatacgccaagacaagccgccggatatcaacatcggagataggcctagtagtccccatacggtacctaagatacgactaccgtcaggaggatctagtgttgtctctgatctcgtcgggcacggattcgaggaggaagactactctgttgtcgactacgggatggttttatggctgccaagtcgacaacagatagataggctaccccaaatattgtactggtgtgattatggtaaataagagcaacgaccggcttcggccaacaggagtagggctattacctgacaattcaggggcctgaacctgtataaaaatcatcgtccccatctcttttacctcaatctcgcatatatcctagtaccaacgatccccatactatgcaaataccatagtcgtgacatcaaacgtcgacaccacccttcccctcttggactagtcttttagggagattaggcctttccccgagtgggtgtgcctaagaactgttggggtccgggcaaccttaagttattgggcctcggttgaccccacctgggccagattgttatgatgaggacatcctccactattacccgctggcaaagacacaaaagtcgggcggcgaccgtgtgagcctctctgaataatcccaacttgcttagcttgggaggaggaagctaccttaaaaggggagagccactcttcccctattggaccagtctttttgggagattgggtctttccctaagtgggtgtgcctaagaatcctccactattacccgccggcaaagacgcaaaagtccaagtgggtgtgcctaagaatcctccactattattcgctggcaaagacgcaaaagtccgagtgggttgtgcctaagaatcctccactattacccgctggcaaagacgcaaaagtcgggcggcgaccgtgtgagccactgaataatcccgccttgcttagcttgggaggaggaagcccttcccctattggactagtcttttagggagattgggcctttccccgagtgggtgtgcctaacaatcctccactattacccactggcaaagacgcaaaagtcgagcggcgaccatgtgagcctctgaataatcccaccttgtttagcttgggagaaggaagccaccttaaaagggagagccacccttccctattggattagtcttttagggagattggacctttcctcaaatgggtgtgcctaagaactgtttgggtccaagcaaccttaaattattaggtctcagccgaccccacctagaccggattgttattagtgaatcataatacatagagttaggtgtcatgtgtcatagggttatgtgtcaagtgtcagaatttctatgtgttttgtgtcatgtgtcagaatttctatgtgtttttacaacttactctctctatcccataaaaaacaaacctaatacgtgatatgaaacatcctagtactacaaaatctggacatacttatatactaatatatcacatcccgtaataggtttatttttacgtagggttaggtgaaatttactcttgtttttgaaatagtagtaattaattatttgtgctttatagggggtgtgaatggtcaaactctaaattttacacacatttataagtataaatacaaaataatagaaagtctagcgtagtaattaagttaagtggaatgtggatggcagttttaatttctcgcagagccgggtttcatactttcatgtgaatgatgatcgagttgttttttgaggcagtaatccgctatttattgccgtgtgggagaagagaaaggagagatggacggacaaaagtcccgtttaccgtaggagaggaccgtaaaaccgacgttgatgcgagcaattcacgttggttttttcctgacgtggagaagagagatcgaagagaaaagtagtcctgcgtactactccagctccggacatcagtgacggaaaaacacgactcgtcaaatatgagtcatctccaataaaccaaaaatatcctgattaatatatggctactggatagaacccataaccgatcacagttgatatatgatgagacataaccatggctataacatgtcacgtgtgacatatagtattatgaaccatcatatatagatgagaccactcatctttgacgggtctttaactaccacacgtgacacatcacagataaagttatctctgacgggtgctagttatgatccgtcagtgatgagtgaaaatttaaattttaaattttgcaaaaaatctcgagttgggacatgctctataaaagttgtagctctcgacgagatatatacaactttataactaacaacatttccattataattttgagttttttcaaagagtggtgctcttgtgaaaatgatttgaaccattcgttattaaggttaaagtagtaatttactaatatgtgattagggctaactttttcatttagtttttctctggctaaattgatctatggtcattccatgtgttgacaccactcatattccataaaaaaaggaaaaagtttggtcaatgctaaatgacaattataactctctgcacctaattgttttaacaaaaatacccctccatgtttctaatattgctaaccatggtgatagtacaattagatctgaatcttcgatcaaataagatcaatgatttagattgtcttctactactaagtagagagcacggtaatgggactctttttcaaatgacctggatgaaaacatgctttatatcaaagatatagagctcaaccaaatttacaatattataattgacaatattttcatttacaatattataattgacaatattttcatttgagatagtttacatactcaaatatccattataaggtgagatctattttgaaaaaaaataattctttaaacaacatcggatgaagatattctttacgtaaaagctgaacatgttgagaactataaatgtttagttgataatattttcatttaaagtcatttagagtattaaatatatgttaaatgatttggacacaaatagaaaaaaaataataacactgattgagtagtcaacatgtgatgaggatgagatttggtaagggtgctctttgtggaggcggaggtcttgagtttgaaactcataatacgcatgcatgtctatattacacaaaaaaatgtggatatgtaggttgtgatgtgtgaccttgtataggatggctagtaaaatctaaaatatttttttttactttttgttgctttaaaattaagagattgtcattcttgctttgtcggtgatgagtcgtaagagatgagtcattagcaacaggcggaagttacgacgacacgccactaatgacttatctgtgacggatgataagttatgacctgttacagatgacttaaatacccgtcagagatgagttatctgcaacaaatgttcactcgtcaccagtgatattttgtctttgctggaactagatccaaaaacttgcaaggggttgttgtattcttgctttctcttctataatgaaattggtagagctcctgccctttccttaaaaaaaagattttgtcatcactaaccatttatctatgatggggtttggacctgccagtgatgacctaatctgatgtagtgacgttaaattgttgtcgacagtaagaaaggaaaccgaggagttacggacgacgacttgtagctaagttttgataaacacacacacgccatgtatgctctaaattgtgtttgtgtcggtcacaacgtatatacatgtaccccattttgttccaagttccaacatcacgagttcatgacggattagtcacccttgttggtggatcaatataatctcgactgtacatgatatttcatacttttcttagaattaatcaattttagtctcatatgtctctaagagtattttggatatttttctctatctcttctctatctctactattataaaattgaagatgtttccactgtcggtcacttgtgtttgagtcggttttaattttatgttttggttttaatttatatatcttctctatctctactactataaaaattaaaaaaattttgctggtattttggtacgttatctgtgtatgagtcgatttttaagttcgtttgcttttgataatacagaaggaatcatataagaaatctgttaaaaaaacttgcatgctaaactgagacgatcagactcctaactgcagctcatgattatataaaaatatatgtgcg

SEQ ID NO: 67928 - DNA, 10625 bp, Oryza sativa
gggcgtgagagggagttacgcgcgcgagagagagggtgccaaggtgggctcggggaggagcgcggagggaaggggggactcatctgggccactcgattatttgtagatgaatactgatagttggatttgatgaatgagtaatgtaggtgtaagaatgagttggtgcaataaagttttgttttgtttaagaggaattttactatccttgaggagtctcaaggtaccaccaggtatctacctccttaatcaattgatatccaccgttaattcacaaaggttaatttagggacaaaatttattattaacaaggatagcttagtaattgaccaatcaccggttctccatccactgccaagcgttcacgatttcctttccacgatttcagtgcttaaccataatcaattccaatcccaattgaacgagctcggaggcaaggagcaggggctgcgcgcgcgacggcggcgaccagcaagcacgtgcgaggcggcgaccggctagcgcgagcaatggctatgaccagcgtgcggcggcggtgatgtcgactggctgccgcatacgtcggctacgatgggcgggcgagacgggcgcgtgcggcggcggagacggcgaccgactgccgcgttagtttgctgtgactggagggcgcataattcagcagcgacctcagcgtgtgtgcagcggctgagaccggtgggcgcgtgcggcctcggtgagcggcgggcgcgtacggcggtgacaagacatatcggtaaaagtattacataaacgtttaactacataaagaagcacaacgttcttcctcctctgctgcatgaatgcagcttatcttgaaacggataggagtaggatacagatctaaaaaaaagacgattttgtccttagccatacaaatcaattataaaactcaattaccattttaacctttcaccttacatactttgcccactcttttaatacctttcttctagtaacttctctcttggagcgttagatcattagagatcaacgatcctaattaattccaagtatagaagaagatctcaccatttaaatataaccgtctatttaaaaagggtaggattggaatatgtaattgccagctcctgcttgcaacaccatcgtctcaaatcattcgctatatgttgcgccacagttatagatggccaaatgagccacccagcccgacacggcccaataggggtcggggcaccatgctgagccagtccgaaggcacggacagcccatcgtgctttctttaaaataaatctatttcccctccctcttttttgggttgtgacatatatatatatatatatgtatatatatatatataattttctaataatctactcgaacgcccatgtgttctccttgcggatttcctcctcctccggcgtgaagtcgttcttgatcccaaactccttcctgatctgctccggcgacttgcctttgatcaggttcgccgtgtgctggcagcacaaatccagcaagctcttgatgttcaggaaattggacgccaggagcaagccgtacagcatgttcttgtccacgtcgatcatgaactcggcgtcgaagctcttcagctccttctcctcgtcctccgcggcggcggcgtgcttgacgcagtattcgatgaccttggcgaggaccttggaggcgacgttggggagaggcaccccgttcgtcgtgcagtcgttctcgatcatgttggagacgagctgcgacaggctcgccgccgccgacggcacgttaaagtgctcgccgtcggagctgattaagaggatcgtgtcgtcggcaacctccttcttgtctgccgccattgatctcgctactttgaaacacggacggacgaaactcgcggattgcaaagctcaactgtttcttgtctttcttggaacgtaaacgttgggtgtgcttggatcatggcgagagaggaggtggtgtgtttttattgcgtgaaaccgcgcaaaaacaactcggattcggtcatgtggagtcgaaatccaatccgaattcaattgattttcggtgatttccgcgttagtttggtgtacgtacgtcgtcgagactcgagagatttttaactggactgatcttcggaaccttcttccatagtctaattagactccttttggaaacgagtactctaattatttctcgatattaattaatttacaattattacagtagtaaaatgagattaaaatacgactcctactcggagtttaattatctcacgctgctttatgcaataaatacaatcacgccgcgaggttctatctgattaacaccaaactttccaagccatcgaccaaataatactacttcaggattagattatcgtcagaagttcatcaacaatggcggcagcagcagcggaggccacgaccgatggcggcggcaagatgatcatcctgatcagcgccgacgggaaacgcttcgaggtgacggaggcggtggcgagccaatcgcagctgatatccaacatgatcgaggacgattgcacggagaacggggtgcgtctccccaacgtcgacggcgacatcctcaccatggtcgtcgactactgcaacatgcacgccggcgacgccgccgccgccggcgacaccatgaaagcatcaagcacggaggaggagctgaagaagttcgacgccgagttggtgcaagccctcgagaatccggtgctgttcaagctgatcttggcggccaatttcttgaacatcaagagcttgctggacatgacgtgccagcgcgtggcggacatgatgtccggcaagacgccggagcagatgagggagacgttttcgatcgagaacgacttcacgccggaggaggaggcggcgattcgccaggagaacgcctgggccttcgacgactagctgtagctgcctacatcatcaaatttaatctaagcagaatttaggcatatatatatatgagattttcttagttttatgatttaggtgttttatgctaagtaattaatcgcttagatgttttgcttattatagtactgagacttcctccggtgcttgggagttatggtgtccgttgattacttgccagttgccatctaacggtctgtgataaaaggtatgtctcagaaggtataattaaaaaaatgagcaaggtattaacttgatgattaggtggaaggttagattgataactttagtttcatacagattagagggtggggctttaatcagtaaaagaattaggatcgataagccctgcttgctgataagaacagctttcttcagcaagtaccatacggacgaaacgccaccaccactgatgatccacaatgaccatgaattttgtatacatacacagattcaacaaactggttgatcgagccatacttgtctttgtgtatggacgaaagaggattatatttgtttctttggagtctaaatttagatgaggacctgaagaatcaattagggaaaggggattttggacaagtgttaggatttatgatctcatgtactaaaacgcaaaaaaaaattgaattacctagaaacgatgcgaacgacagaatcggagataagtaataacttgatgcaaaaaaagagatagacggttacatgtaaaaggagttaattatcggtgtttattaatgttttctattcctaagttgcccttaacagatcaacggtgggtgattaagtagtaagggaggtaccagaaagtagtaagggaggtacctctggtacctctcaagcaccttaaaagctctctatagtactatgtacatttgtaatcttttcgaatcctaatttatagagatcttcttctgtgcttggaattaattaggatcgtttatcactaatgatctaacgctctaagagagaagtatcaggaaaaatgtattaaaagtgtggaccaggtatggaaggtgaaaggttaaaatggtaattgagtattataattgatttttacggttaagggccaaaacgtctaattttcaataggcaaaatttgcctcagaacactcaaaaaacgtgtaattggctgggagacaccacgaaaacgtgacacggctgatagacactacaaaaaatgtgtaattagctctaggacaccggtcgcattattttattatttctgggtcaaaagaggtgagatatttttctaaattcctggattgccccttctctttccttccttttctcccactctttccttcttttcaccttcttgttgatttcgccgagaacggcatagcagcctcaaagccgcggtggggcgaggtcggcgcggcgtggtgcggcaacatcggcggccagggcggtcgatggcatggcacgaccatggaggcgcggtgtccagctagatcgatggcgggtaggcgacgacagtgccggtgtagcggggcgcggctgagcggcagcaccaagcgcaggcggggaggctacgatgggtcttggcatcacgacttgggtcccggcgtcaccactgctcaccggagaaagcggaatcgaccatggcgatggcggcgggttcagatcggcgccgatgaagaaggggtgtgatctccttctccggcgcaccatttttcggggtccttgaggggagatagagaggaggatgaggcggagatgctggcgcgacagcttggcccggcttggtccagataagcgggaacggcgatgatgtcgctgcggcggtgcacagagcgcgctccagagctctggtgggcacgacagcgttcccgtcgattggctgcacgaatcgagaggttgtcaaagcgagatttgatcggcatggagagaagataatagaacatgaattagataggaatggagacagctcgttggtgatcggcggcgccctccttctcggcggtcgacaacaaaagagagatagagagggagagctggagctctcttcctcggatggcgatgcagcagggacgagatggcgatgcgtcgaactcagccggcgccgatctctctctcggctgtctctggtcgatctctctcccgtcgcacgcccaacacgacgagatgaggaggctattctccaggttcggcaagatctagagggagaagaagataagggcaaaactgtcattttacgttgtttctctctcatcaattgaacaaatattatactataatgtgtccagtgtcctgcagcaaattaccacatttttttagtgtcctcgggcaaattcttgttttcgtggtgtcccatagctaattacatattttttgagtgtcctgtagcaaattttgccttcaatatatgtatatccttcctatatatgttctgttctgtattccatccattcgtatcgctgcttggttcgaggcgtcggtggaggtgacttaggcgctgaggcatagggggagagacggaggcagacgggcaccccttacagcgtcgacgaccgtgagctcggctcacaggatcgctagctcgcggcagccgcccgcgccatcgccgctttggagctctcctcgtcgaagccggacgcacccaccgatcgcagccgctgcacgcgccctggggttgccgccgccgtacacgccctacggtcacagctgactaatgtggcagccggtcgccatcgcagccgccgcacgcgcccgtagcgcccgccagtccaagccgacacacacggcagccggtcatcgtcgcgccgccgcatgcacctgttgcgcccgctggtctccattaccgccaccgcatgcgcttgttgcgcccatagcgcccgcccgtcgccgactcgccgtcaccaccgccacacgcgcccatcacgcccgctggtcacagccgccgcgcacgctcccgccggtcgacgccgtcacacaagctgccactgccactaattaagatacccctgttaatataattttttttcctaaattaccctttatgaattaacggtagatatcaattgattaaggaggtacctaaggtaccttccaagtaccgtaaaagatctctaatttataatatgcaacaaagttagttttgttttgtttgagaggagttaccatccttgaggaggtaccagaatgtgtaattgccagttcgtgctcacaacaccatcgtctcaaatcattctctctgcgttgcgccacaattatagttggccaaatggcccgcccggcccggcatggcctaggccaagatttgtcgggctggcacggttcgacctacacaccaggtcgtaccgtgccggcccacgtgctccacctatggcccaggcacccaataagggtcgggccgtgctgggccggcccgaaggcacgggcagcccatcgtgctttctttgaaataagtctatttccctccctcctctttgggttgtgacatatatatagctaaaataagtctattttacgtccctactctttgagtcgtgccatataatacgtcgatttgtcttcctattctctgtgccctgtcttacatatggtcgaaagtaagtctatttcacctccttgaacttcatgtcgtgctaggccggcccaccatgatgaggcataggcccaggcacagcccaacagctgggccgtgccggcacgggcctgacagcaatcgggccttgccgtgcctggtccgtgccatcgagtcaaaacctcgtgccttgggccaaaggtgggtaaattgaactattttgatatttagagagtgttggatacccggttttagagtttgctatgaattttagacctagacaggacttgaagggtgtaaaatggattcatccctatttttttattacatatatatagaaatattaataaatatataattttatttatgctatttttagactaaaactaatatagttctccttatttctaacacatactttacatcatgatattcatagtccaagtctttaaaactttgacaatagtctttgttcaagatgacaagtattatgaacccctctagaagtacaaatttattgatactctttcttcctaccttctactcatttgttttctgcgagtaaacttcccgaatggctagatgtacaacacgttttttcgcaaaaaaaaatagtaaaattaattttaaaaaaatcatattaattcatttttatgtttttctttaggaccaattgcatatttgccactcgattgaaccggtattgtgaatatgccattaaaaaaattgcaattgcaaatttgccactaaaaatgatttgaaccctacctacctgccattggattgacggcatgagctaacatcgttaaaaggtataaacattatagcatctgaggcaacaaacaaaagacaagaaacatttggctaaggctccatagcatatcaaatggatgctaactgaatttaattctccttcccattccctctaatgctaacttaagtggcaaatttgcaattcatgtttttctaatggctattccgagttagggggtggaaagtagtgatatatttgcaattctcccttttctttaagctaagacttaattattcatgcgctaatgagccaccttgttttacgtgcgcgggaaagaagcttccagcccctaccactaaacacacggcctaatactggcaccttccatcatggtttactagcctgtgatgtcgcgcattcgcgtgactctatgcctcctgttacatggtacttaggagtggcaatatgtttttatgggtttctcatcgctcgtaaaaaatataggtcagaatgactaatattatgctcatacaatagatagcttaatatttattacaaattttgtatctgagtgagtcattgttttataggttttcacgttgcatgaccccttattttgaataagcgcacactatttatagcctatgctgaaatattttgtaggtttttaaggaatgaatttgatttcattttatattcatgtgaaaaacattaaacctatattcgggcgatatgattgtgcatgttcttgcagcaatttttgcctcaaatatgttaacaattaattgttagaaacaaaattaatcgtatgaacgcacatttgtatatgttcttaaatagctgaatcttgacatgtgaatatttaattaggatgagggtttatttgtaaaataatttattttattacatgagcaattcataaattatttgcatcctatgcctattctctagcttttttccccttccctctttctttcctcttctagtagctttatctccggaagcctctttaattattatttttatcatccatctaatccaacggtccagattcatttattctcaattcatcaaatgatgtcactcatcctcaattcattttgagtttcacttttcattagttaagatatcgatagctttagtgttggcatcttcttgcttgatgcaacaatactactattacttaagtaatcatgcacatgcaacacatgtaataaccactatgatttaaaacaagcatattgcccatgtaatgcaagatttccgtcatattttatgtaattcagaatccataataaaaaaggtaaatcattcatgatactatattgaaatttaatgtaccaacaatacacataagtctctatataaaaatacatacaacatacaaaaggatgaggatcaatggtctccgaactagcactttacacattgttgatgcaaaaaaaaaataaaaccctggcctaagagatttgcttaactctagtgaaaaagcttgccttcagacctaaggcgtgccaattggtttaatactgcaaccaacaagaaacaagataaacagttaaatttataaacgatagccaatcggctggagggctgatgacatatcgtctttaacctagccgatgcaacctggtttgaatcagctgtaaggtgtagcaataaaattaagaccctaaattcatgtcatcagctgtaaagattaacattacataatctatgaatcatcattacttgaaataacagtgattgggatagatagaacttaatcgagacagtataaatcacttgtatccgaagttatatgaaataaagattatacgagttcatgtcatagctgatgaaagaatttaagcatgtatcggctatagcttcaatacaaccttatactggaatattactctaatataaatatattgaacaaatatcaatctaatgttttttttgcggggaaatatcaatctaatgttagattaattataacaagaccgatgataagcataatatatttagatgattaagattccaatataagggcagatataacttgtaaagcaatacaaagcaaagcaaaacaattatatcatgtaagatcggtggaaactccgattctatccttaattacaatcataaagtagcctagagattatggttctaaacatgacttagtaggtcgaacccaattgatgcaacactaagtgtatagagaaacataatatctagacaatcaagatgatgattgtttttcaggatggtggatatgttatactaatctaagccaacaaagtaatctagccgttatcgggaaaaccctagaaagtgatcgaccaatataagtacaaagtattgtcaatctagattatataacatatatgataactcgacattttacatgagcaagattagagtgtcataatgatgtaagcacaaatcccgaaaatgctaaccaccataacaagttttacctcttgtcgaagatcgtaatcgatgcagcccaactcaaaagcaagaactcgtcgaaaagtaaagtaatgaaaaggtggcgatgcgccgagagtatatatttatacccaaatacataactcatccataacggacacgactcacacttcctattacaactctaaccgacgaacaagtcccttaggtggactcttaataaggaaaatacttaatatcctaattaatggatacaatttcctatctcggactctatccttgcccagcaatatcattgatgctcttcattcaaatccgacattgattatgagaccaatcttgccaatatcggttgtatcgactcaccgtgttcaactcgatatcagcctatacagacttccagccgatgcaaactctgcttccagaaatatcgcatctcttccaaatctaattcagtgtttatctccaaatccaatccatatattaccaaatttggtcgttaactcatatcttccaaactatgttgatgatggccatagaaatcgctaagtggggaacaaaaatcttcatttaccggcccaccaccgtcatttgactttttcatattataagtaatttgactttttcctagtcaagtttgactaagcttatagaacaaaatagcaacatctaaaatatcgaatttgtttcatttaatgtaatattgaatatattttgacaatatgtttttttgttgaaaatactaatatatttttctattaacttggtcaaacttagattgtgttttcgagacaagaagttttttggtagagtcttggaaaattctataggtcacatatttcatctatttgagtttaacttttctatggttggttcttgtgggctcctaagtgtgaaaaaaatatcaaaaacataaaataaaaataaaaaagttgcacgtctctcttctacactagagaggagaggaaaaatatggcatgggtagagggtgggggggggggcggcgccagcctcattggcg

SEQ ID NO: 67929 - DNA, 5114 bp, Oryza sativa
  unsure (1)..(5114): unsure at all n locations
tgaattgctgattggcatctgtcaactgcttgaaaagcgatgcgttttcgccccggagctggtcaacctgatgaacgagcacacgaattttgaaatctgaataaacccatagaccatcactcaaaattacagtaccaattggcacaatattttgttactcaatctgatatatggatggcgctgtttgaatttttaacattagcaaaggcgcaacgggtacaaatcaactcagtttacctgcgtctcgagatcagctaagtgagcttgctttctcttccttgatcgacgagcagactcccggttggaaaccatcctgtaatttgaagccagcaaccgtttcatgcaagttctttgtcaaatattccttctgaaaagtaatgtttacttctactactagcgaatacgcccataattttcatgccgtgacagacataatgcttgacataatcgctgatgttcttggtgtaccttctcattctcttaacgtccagtgggtttgtgctttgttcgcatggaccgccctctatatccaacagcgactcactgtcagaatctgaaccacttgtgcctcccagagtttggctctccttcatgttcagagtggtagctgacgtgggacttgctgctgctgatcacagaaaattgaacaaatagtgagcaagaacaattaaagaactgagcattgtttgtgcctcatcattaaatgcaattttgatgcagtaacagcacttgtactgtactactgtccatgcatgtccattgctgaaatctccatgtgttgaaaactccaggttgcatgtgttttttcagtgtgcagtacagtagcaaatcattacatacatggatgagtgactgtttttggtgtgcaaactgcagtcttattaactgatgaaaattgtggaagaggacgtgtgttaggccataccacagattgatgattgcgactcaattgtgtagactgcaggatgccgtgcgttgaggctctgggactggggccatatgtgattgggaatgaccccagtgatggtgctctgcttgaaagaaaaacaaaagcataattaatcgagtaatcaatcatgcatatcaagaatcaagtacaatttaagataagcaaccaaagcttgtatgtatatgctgctacttataattagttgtcagtatgtactagtactaacaatcatcttcattacctaaataaattacttatcatcaattctcaataacaagtttttttttttcgaggatgttctcgataacaacttaatcaaccctgtcatgtaaactctcctgttaggctgttaacctgaaaaatgatttctcctcttcccttcccatgcttagaattcaggactccctcttatcatgctattcaaatattttttcgtgaaacatgaaacatcgtttgtttgaagtttgaagactaaaattgtgtgtggtgtgtgagcgtgtgtctcttctatatgatctaaaagaaacatccttcattttttttcctctctttttttttcttgttctctgctttcccgctgtatttactcccctccaacttaatacaatgatacgcaaaagcttatgcttattcgcgccaaaaaaaaaagagttttgaactagcaaaaaaaactggcaaacagtcttcaatttgaaaggtgttgcaggaggtgaacagtagcgattaaaaatttgcaggcaacaaattctagtcaagcataatatggaccgtgctactaccaatagaacaagaatcttagccgctctttaattaagtacacgaattaataatactccacccgttttgaaatgtttgacaccgttgactttttagcacattttgcccgttcgtcttattcaaaaacttctgtaatatataaaactataggcctacatgaaaaatatatttaaaaataaatcagataataggaaacgaattaataattacttaaatttattttttaaataaaacgaacggttaaacatgtgntaaaaagtcaacggcgtcaaacatttcgaaacggagggagcaagtagtactccactcttttaatcaagcacaagcatgatcaacaaaataatcactcaccgtcaccgagtccgcgaagccgaagctggagaggtcggcggcggagaacatggcgaacggcggcgggtgcgggccgccgccgggcttctggtcggcggcggcgtcggcgtcgtcctcccccctctcgccgtggaagaacgcctcgaagttcagctccgacgggcacttcttcatctcctcgtgtggcctctgctgctgctgctgattctttcagcggtggtgaactggtggtggtggcgtcggagtcggatgcttttagagatgccccagcgaggcagatcaccgagggaggagaaggagaagaaggagaagggaaagctcctctttttcgccccccacaaagctgagctgcccacccgtgcgcggctggagcggtgtcagtccggcgtggaaagaggctagagtatcatccttgcccctctttcccccgcatatttaccaccccctgccattgggggtccttctccacgtgtactccactcgcaagcggtacttgttaggaaggtacgctgtaggtggtctcttcctacctccccggcggccggctccggtgccggccgtcagatctccgatgccgcacacgacagggaggaggcggcggcagcacgaccactgccacatgaggaggaggaggaggatgatttggcggctgtgacgtgcggcaccgaccattgcaacgaggagagactgcgtgcaaccgtgcgaggaggtagcggaagcgtgctccgcgagggagccacgtggattctaagatttattgaatcataattcacatattcaacagagaaatattagtaaaattttacagattgctaatattttaaatctgcttcgcgattgctctagtgagcttcttcaacaactcgtgcggccttgttgaataacaacaaataacgagcaatcatgcctctgagattaataaaaaaggcagcagcagcaagcttccaggatcgatcaatcagttggcaagacagcgaacgacggcggcgtcctggttctgggcttggaaccttggcaatctccttccccacctctcctcctacctccaaatcctttgcttagcttctagagtcttttagccccttgtatccttccaccttccacctcaaaaccttccactattgtaatagaaatcagtggcttcttgtattggattcgcactgctacttctgagtttgctattgttccaagcgagataactgggatcctaacaatctggtatcagagccaccattcccccaccaaattccaccatgagtgaccaagagtgcttggaggccaatcataggctagaggagaagatcgatctgattttgaagaagttgaatgagatagaagctaacaggagcaagttcttcgaggagatgagcgcctccatcaaggcgaccactactgtcctcacggctgcatcacatcctccactccaggcaccaccttcttcgacgcccaccacctgtttgatgaagtgctccaacgacgatcgtccttgggcgacgtcgagctcaggccacatcgacaaggagactgctccgacagttgccctagaccttggggatggcgaggacaaggttcatgacccctgcatcgtcaccaaggactcatccaaggtcacgcccaccatgtgttcgatgaaatgctccagccccgatactaagcccgatctcaccatggttgcggaggttacctacgccagcgcagccactgcctctatggagttggtaactgctcaggaaaccattggtgccatgtacagcgacacctctgaccattccaaggtgatgcacaccaagtgtttgacggttgtcctcgatgccattggtgacaccggtcaagctatggttgtgttccagacctggacagatgcatttaaggacgatccaacctccgttcagttcatggactttttctcatcaagtatgatggctaacatcaagtggaacacaccaatgcccactaagtgttcggtacagtgccttgggcatggcagcatggcattgatgcctacaaacccttttgatgttaatccatggccacctcctactctagaaaaatatagaagtcaagcagttgtgcatatgttgttatttgagacactattcaatgaggagctaaggttggagagaattgaattgaagccatggccacctccaacctacgatggagtaattagtggatgggattcacagcctatggctggtccaaaattcaaactctattgggcaagagtacgtcgtttgccaccttggccgccacctatcgaagtaagttgtcttgcattggtgtgtcatgacaatgtaatgattttcactgagctgaaggatattaatttgcattggggtgagctgaaaccatggcccccaccaagtcaaacaaacttcaaaaatattatggttcagcccgagcaatgcaagtattggaaaattagagtagaaatgagtatatttgctaggaaggagaagtggaatttacttaatcagaaaagttgcacaatggttgcaatatctagcttgaaggagcatgtcaatgggcaagaacagatctggtgtagaccttggaatcctagtgactacaaggtctcccctgacataattatgttgattacttcgtccgtactgcacccctatcatttggaccatattgttagccttacatatcctgaaggtttggacactctagttagtcataaggtggttcagtttgggagggctgatactgcatgcagtcatcaaaatagacatacaattgttaggacaacagggacatttgttaggcctgagcttggtactgggaatggtacacacatattacttgtttcagaggcagaagctggatatgtgtccataaggaatttgcttgaactgacaaggaatgctaggcagtggcataattccatggttgagtatttgtcatggtttgtggatgcatggatggttgccaaacatgcaagtaattttggttggtatcttagttgggcttcccaaattaaaaatatggtgaagaatttgttgcgacaggcaaatagggccagcaattttga

SEQ ID NO: 67930 - DNA, 21217 bp, Oryza sativa
  unsure (1)..(21217): unsure at all n locations
tgagtatttgtcatggtttgtggatgcatggatggttgccaaacatgcaagtaattttggttggtatcttagttgggcttcccaaattaaaaatatggtgaagaatttgttgcgacaggcaaatagggccagcaattttgacacttctatacttgagatgaacacacatgttcagaaacattcagcttatactcaagtgcatagcagagctgaggtagttactgttaaacctgaaacaaaggagctattgaacgctgaactctagtcctttgctatgcttgtcagcaacaagattgaggacaatgattttgtattgctgcttctgaaacatctcacttccttaagattgatagctaagattgcattgatcatgccatgggatctagctgaaagcgaaggacaaatttataaagcttttgggacagtacaagtgtgcaatataaatcaagagtggagctttgcaagttcaaaagtttatttgatatcgacttgcggacaagtcgaatttcaaggagaggggattgttaggatccgtgggctgtacgtgggccaattcagctgctacgcttacaaaggcccaatcatgtctatgagattaatacaaaaaaggcagcagcaacaagcttccaagatcgatcaatcagttggcaagacggcgaacggcgacagcgtcctggttctgggcttggaaccttggcgatctccttccccacctgcagctcctcctacctccaaatcctttgcttagcttctagagtcttttagccccttgtatccttccaccttctacctcaaaaccttccactattgtaatagaaatcagtggcttcttatattggattcgcactgctacttctgagtttgctattgttccaagcgagagaactgggatcctaacataatcttgaccatttagagtcctaggttagggtcataatgacaagagggtcagaaaagggggaagatagagggggggggggagtcgttggttctattgggatgactgtgggtgttggaggactgacggtgggatgcaccatcggcgccgtggggacggaggagaacgatgggtcagcgtcggtggtaagggctaaacaaagcagttggtttggagctaggtggtgacagattatgcggtggagtacttaatggagacgtgaattaggggagggggggaggggctcgccggtgttgtttgtgccttctgcccaccaatgatgcttggtggcggcatcagtgctcgaggaagtgtgcgggggcaagctcgcgtcacacttgtgctgcgtgcggctagggaagaaggagaatgggaggaaaatgataagatcatattgttacgtacgaatcttaaagcatatagttgtccaaaatacgaaagacatgagctacgattttatgtcataagatatactcatctctagctcattcagtagtatagattaatgccctccgtttcacaatgtaagactttttaacattgcccatatttatatatatgctaatgaatctagacattattatatatatagatttattagcatctatatgaatgtagataatgctaaaaagttttacactgtgaaacagaggaaagtacaattttaagctgatgatgcgttcttaattagaaaaccactagttgactagttgtaacgaggctatatataggaattgaagatggattctcgtgcagaccagatttcggcccatccacgtccaatgttaggtggtaaaagttcaattttcgtccttcaactctatatcgagttttattcgtgtcccttgtctaaaaaaaatctaccttactgagtggtttcgataatagttttatcacatatgatacagtataggtttaactggacccaggtatatgtgaaatcctccctttcttctacacctttgaatgacgcgagtgacagcaaagtgtatggatgtgacgatagtgctaccatatattgcatcctgtgtcgccattatcacacacgaacgataactatatattgcatcctgtgtcgccattatcacacacgaaccagaacgcaagtgtgacaagggctccatggtctccgtcccatgctttgccttattctatgtcctcgtcttgacactagacaaccttatcgacgagattgaccgcttggagggcctcttctcttcgcctcatcgaacaattcctctgtttgcacatttttaccacaatcagccacccagttccctgatcccctcacctattctcattgaaaataaaactaaacaaaactgacatattacatattatattcaaaacatttaatgggtagcatcaaaattccaacaaaaatatgaattattggattagtaagagcaagtctaataatacagccaattgccggtgacagtagtatccaggtcatcaaaaaccttcataagagccgtcaaatacaataacagtataataggatggtccaccatattatctaagagaataattaactctgacaaaagcacaccaaaccttctctctctaccttgtctccgtcgcgccagccaccacacaccatccatttatttctgatatcttttgtgtactctcccatcttcttccttgtttttttatgaacacaagcagcaggccaagcttgctcttgagcttatcgtgggccgtctcccgagtccttacacgtggatgctgtgtcagcccgcggcaccacctatcgccgccatggtggcatgtcctcgagctcctctagtcatcttcatgacaaccttgagcttcacgggtaagctaagaagcggtcgcaagtgagtccgcccgctggaggtctggagcaagctaagcaatggtgtgacggtagcgagcaagcaaggagatgacgacgatcccgcgacaatctttagctccttctctcctcatcaacgccttcatatgggaagttgtgctgtagtcgggtgataggatagtcgccggctcacattctctctcactccctctcccttccaacccatcaccacattcgacgtggtctccttttcgccagtccacggtgtcttattatacctgctctaatatttgataaggtaatgatgtgatttaaaaaaaaaacaaaattcagttgcaaatgcacaggcattcgtagaccaatcctaccacgccgaccaaacaccaccttccccgccactagcttatcctcctcgtcttcccttccatcccccaacccaacccaccaccgcctcgccgcggtcgccggcgagaggcgccgcgctgcgcgcgtcgagaggatcgcctcctcctcctcctcctcctccggcagccatgtcctccatccacttcttcccggccacctcccaggccgccgccccgtcgcgccgccccctcaccaaaccctccccaaaaccccccgccgccaccgccgcgtaccaccgcggcggagacaacgagccggtgctcttcccgcgcctcttcctcaggaggcgtgcccggccccgcccggcgcccgccgaggcgcccccggtggcccccgacggcagcagcagcggcggcgggggaggaggaggggagggngggcggggcggaggggaccacnaggaggatgaggggacgaggaaggggcttgtgccggagtggctcaacgtcacgaacgacgacgccaagacggtgctggccgccatcgccatctcgctcgctttccgcttctttgtcgccgagccgcgcttcatcccctcgctctccatggttttccccccccccccaccttcgacgtcggcgaccgcattgtcgccgagaaggtccgtctgctcttccttgacttctttcctttttgtttttgtcaacagaggattcagattttacttaaatgtgctgattactgagttccgggtgcacacatttgcctaatgtttctgataaaatgtgtgccttttgaatttcgacttgggtaagtaatcaatacagcacaatcgtagaaatttgttcacgtacttgttacttgttggtttgcttcctggttgcgtagcatatgatgatcactgccaaattttgtttagacgataacctggtataagcattggtaaaacaaaatccccaacatactagaattccgcattgacatcagcaaataggcatatggacacatgacacatgttcacattatcatgctcacctctgcaggcaatggctgatcttttgcatattgttttgtccagccatcagtcaaacagtcatatatagcttgagttagctataaaaattatgaatgagctgttttaaatgggtttcacagcacttctaagtgtaacagggaagcaggcgtagacagtccgattgttggttaacattttaggacatattttttttttcatttttgtgttaaattataagaaatgatcatcgtctagttagatagcatgccttaatatgttctatgcctcctgttggcagtaaaaagttctgaaatgaggctatttattttgtaaaaaactgccttcacaagacttgttcataatctcaatagactttgatcatattggggatatttggagtaatatacgataacctacataagtatagaaaacaatgacaatattccacataaaaaagagagcatgacaatatgcaccctttgaattgcattaatctttctacataatccttagtccaaagtatgtgcttgttgtcattaacagaactagcacggtggcccgcgcagattgcgcggctagcatcactatattttctctcatataatagcatatatgttttctcattatattatttaaatatattaaaatgacaacataattttaaattttgcagtaactttacaaaactaataatgtgtaatattcatattgtattttatatacgtgttagttattaattatttttaatatcaaattttagttatttgtaaattatatatattcctatatggactctagacttgtcttttaatatttcttttttttttaattctgaattttctgtaaattgtatttctatatagactctatgctcttcttccaatattatttattttatttctgaatttttattatttctaattgtatttctatgtggactctaaactcatctttcaatattctttaatttttaatttcgaatttcagttacttctaaattgtattcctatattgactttaaactcttcttcccatgtttttcttaatttcgaattttagttatttgtaaattgtatttttatacggactctaaactctacttttaattttattatgtttatttcaaattttagtttgttttaaattcctatatggactctatactctacttctaatattccttaattttaattccgaatttcagttatttcctaattgtatttttatatggactctatactctacttttaatattccttaattttaattcggaatttcagttatttcctaattgtatttttatatggactctatactctacttttaatattccttatttttaattccgaattttagttatttcctaattgtatttctatatggactctagtctcctcttctaatatttcttattttttaattcctttcaactatttctaaattgtatttataaatggactctagtctcctcttctaatattccttatttttttaatttcgaatttcagctatttctaaattgtatttctatatggactctgccttttctttttctccgattaatgtgagaatttctaggccatgagagcgagtgtggaggctcctttttctattcctttaataatataatagatgtcacaattctctcaaacagttcctagtacatcttgggcacagggtttgacctatcggaacactgatttgtatcgggggtcaccgaagttctgaaatttcggaaatattgcggaaattttggacgatttttttttaaaaaaatgaattcaaatttaaaaattgtgggcgaaatttccaaaaaaagaacaaaaacagatagcaacactcgctctgtttggcagccatacaagcagcagcagctgcatcacaaatttgcggcaattcttaactactgcagctgtggcaaccaagctggaaaaataccaagctgaaaatgcacaaggaaatataccaatctcgtcctagaaccaataagcccaaccattcttccatcaacttctagaatatgagatgcacatgaacagaactagctggttgttgaagaatatactgagaacaaacaaatgtgaagaagagggataaccaagctggttgttgagcaccatcaccttcaccggcaggttctcgacgtggatcatggcgagcnnnnnnnnnnnnnnnnnnnnnnnnnnnnnnnnntcgatgtcgaccaccgcggcaccggcggcggccggcaggccgaagcccattgcgcctagcctggcggatgagagccactgcctgggtctcctgtaggtctagtactatgtcgcccacatctggtgctgcccgacgcccggctggagcggctgcaggcgacggctaggggcgccggtggtgggctgcgtcggggcggcgaggcggcgaccggcgtcgaggcggcgcctggcgacttggcgagatggtgatttttttcgatctgggtgtggtgtggcgcaatgaggggaggcggagggggggagagaacggcgatttagggttaggggagaaaatcgcgtcaaattttttttggccgaaatatttgaccagagctcacttacaatcgggacccaccgaaacgcccgaaatttccgaaatttcggttccaaaatttccaacgccgcttcggcataatactgctttgttttatccaactaccttttctagttgtgatgattgattagtccattattaatattttaactacgatgaatcaggataccaaattcattgtggttgttgcttattttcatttgctgaattccaacctttagtgtctttataagttccaaaatttgtttaaatttgcaagatggtatgatggaccactattaaaggtcacctgcatgggtgtataacttcaccctatatattgttattcatgttgagtttgtttatatttctgtcaaaagatgtctttttatatcttactaagcaatgtattcacatcatatcataaatttaccatatgaatgcttttcaggttacatactactttagaaagccatgtataaatgacatagtaatcttcaaaagtccaccagtgctgcaggtacttgcatattagctaaaagtgtggtgttttgggaatttggatgatgtttgctgtttttcttgatatcactgtgaatgtttctgttcaggaggtcggttatactgacaatgatgttttcatcaaacgaattgttgccagggagggagatgttgttgaggttgctttcaaactgagaaacttctttttcatgtgtataactatatcttgtaatcttcacttaattagtttctttttctgtctatgaattccttcctgcagtctttgtgtgtgttaatttcaacaccatgaaattctttgaaattttttaggtagtccaaggagtgtactaaaattgggaaacgtttactccatactgtttaagcattggagaaatcattatgtctattatgtgatcacaaaatagatttgtgatctttccatcttcctgtgctcactttgtgccatgagctgcttcatggtctcttccacatggcatgatactccacgtcagctgcaccaggctcaaaggcaaggcccgctatggcaactcctcagccacatggcagttctactttggggatggtggcgtcagtcttgcaggaacggcattgatgtttgagatgctgagtgtggatgtgaatgctggaacagtctcactcccacttgcagtggctagggcggtgatgctgtcactgatgatgagtcttgatatcttgttcttgtatgttagcctacaatgagtctgaggtcttatattcttctatgttagcctcctcgctgccactttctgccctcttctcctgcattgttgttcttcagcactgttcttccagatcagttgttttgagctagaatttgcgacaggatgacatgtctcatggaactttagtacttgtgaagtataacataagcaatagaaaaatccttaccctatgaattgtttggagtgacctacttactgtgctcaagtattaatttaggttctttctttctttctttcttttgaaacactgtgacatcctcaaacaacaaaatacttaattttcttttcatcttattgcaggttcataaaggaaaactagttgtcaatggtgaagttagaaatgaagagttcattcttgagccaccttcttatgacatgaacccagtggtaagatattactgagccacccatgaatgatacatgagctcaataatgtaacaaccaaccaaatatagtttgaaccacattccccagttaaggctgatgagcaataagaggattaagaaaacacaaatggtttattagttttgattcactgacactacatatgtggatgtgtcagtggaatgaatggagacatttgaagaaacaatcttgattagatcccttactgttactgatttttaaatactttatctgcattaataatcagacgtatatcatgacgaattacatataaaaacttgcattttgcgtgtggtatacctccaagtaagctgaagacataaaatttctatagaatctattgaatagtgctcactagccacacctaggtggatatagatatggttaccactatttatagatacattattgtgtatggtttcttgtgttgtgtgctgtgtgcatattctgtacatatgcatgaacatgaagttgtcaacaacacttcatacttgatttatgtttcaatccttgtagaagaaaaatgaacatgattcttttctgggttatatttttgtgtttgttgatactatgtttttcatgacagcaagtacctgagaactcagtttttgtaatgggagataaccgaaacaacagttatgattcacatgtgtggtaatactctctgctgattttcccatgttacttactattaacttgttttgtatcttaattgaattggcctgtacaatactgctattattttcctcaggggccctcttccttctaagaacatattggggagatccattttccggtattggcctcctggccgaatagggagcactactactgattgcctcatccctgagacaaatccaagctcgcttattgatgtcaaactggcaaagtagaagttcaggcattgattattgcagtgtgaagtttgcgcttcatgtaagctcctattctttaatattccctctctcctggaaattcggaggaatatttgacagcaggccacgtagaaattagaaaggagaacacatttggttctccttgatgtcacaaagaatgctagcaactagcatgagcatagaaaccattttgtttcaaggtttctgcgactctcgctctttgttgtatattaagactgtaaggatgttgccttagtgattcgcatcaaatgattcttcttgtacatcacgttttgtagcaccacgtgtgtatcatcctcatacagtgcttgacaaaagatgtgtaacgcgttgagccggcagttcacttcattgccttacatgttgctaatgctgacagattcttcagaattcaagttactgccatccttttggtctgtatgaacaattgctcccccgtgtcggtgtactcatggatggcatataaatatttaggtttaaagaagtggattgaaaaatatatattggttatcaacaatacaatttcccaaactatatatgatgattctatgagcagggatcctgcatatttttcagacgggagaaatctgaaatctgtgcaacctatatatatatcaatccatccacgcggcacgtcccttcaatatcaacacggtggcgtgcacaatacacagtcgcacagaagaataacaaacaaattggtgggtgttagtttccctctactgactgaaatcgcttgcttgctttagtttagtcgcgttggcatggaagtaaaacccatatttagtcagattagattccctcctcacgcagcaattggcaaatgcttggttggttcgcaaacgcactactaagagtgaataaacagtcactgcaacatggcccagcagcaaattaagcaggataaggccatcatttcgatccaaaccggccaaccaagcaagaaaaccagcaacacgtctcgatgtcatcacatgtacatgatctccagcgatatagagcgcgcgcggcgacgagtcacgactgcaatttgcgacgcaagaaacctcctccctttagatcgcggcaacacatacgttatctctgacaaacaaccgtgaaaagaataatggccgtttcggtagatcgatctccaattgacgatcgaattgggaagaagcacctctaaccttactgctccctctgatgtggtgttcactgatatatagactcacaagctatggaaccgatatgccaaccactcaaaaacagagaaaagtaaattagagattcatgagctgtgaaaaataattaagggccgttttctagctgtcctattcatggatatgatcaattggtaagtgcctgcaggcacctagccagagactatcccgccgtattatttcgaccaaattctccaagcaaacatgggaagatagatacgtactcctacgcgtgtgccgtggccgtacgtacgtgtgcctgcatcttcaccgcaagtcatgcacatgcgcatgtgcttcatcctagcctacgttgctgttcccgctcgccacacactttcgcctttctgacttacacgcgcgtatatatacacgcagcacgtctgcaccggccgtttcaccattcctcgaacaccatcatccacaaacacacaagtacatctcgatcgaagctagctagactagagcacgcacacgtacgatctcgtccatggcgggcgtcgctcgcatgctcgcggccgtggtctgcgcgatcatgccggcggcggcgatggcggccggcggcgtgggcgcgctggagccgagcgggtgggtgagggcgcacgcgacgttctacggcggcgcggacgcgtcgggaaccatgggcggggcgtgcgggtacggcaacctgtacgcgcaggggtacggcacgaggacggcggcgctcagcacggcgctgttcaacgacggcctcgcctgcgggcagtgctacaagctcgtctgcgaccgcaagacggaccggacgtggtgcaagccgggcgtctccgtcaccatcaccgccaccaacttctgcccgcccaactgggacctccccagcgacagcggcggctggtgcaacccgccgcgcccccacttcgacatggcccagcccgcctgggagaagatcggcatctaccgcggcggcatcatccccgtcatctaccaaaggtaaacaacacaatcacatatgtctagtggtcgttgcagtgacctgaatagcactctaaggttctaagttcagatcttcataggagtgaatttcagattatgttgtttgagggactgagtttccgattcaagacgatttgagaggctggataaaaaataccattctctaaaaaaaaattatcaccttcgacatcgcaacatcgatcaagcattgatgattgattctactgggtggcggagtcaaaaaaaaaaacattcacatataaggctgagctaatgaaagttcaaatattttcacaaccacatagtattttttaagattataatgagagctatggatctaggcattaggctcgagtcctggctgccccatgcctgatgcggcctcaaatttgtactaccaccgtaaaaatcactttatttttgatgtttttgtgtagggttccttgcatgaagaagggcggggtgcggttcaccatcaacgggcacgactacttccagctggtgctgctgaccaacgtcggggcggccggctcgatcaaggccatggacgtgaagggctccaagtcgccggactggatggccatggcgcacaactggggcgcccagtggcactcgctggcctacctcaccggccagggcctctccttccgggtcaccatcaccgatggccagacgctcgtcttccccaacgtcgttcgccccggatggaggttcggccaaacgttcgcgagcaacatacagttcaagtgagccacctgatcgatcgaagcttctatataggcgcagctagcatcgtcgtgcatatgcgtgaaggatttaatttggcgtccaaactttatatatacttcttttccaaaatgatcgatcactctctcaatttggatgctgatgggggttgatttactatggtattgtgtaattaattaccagcctgaaaccaacattttcattgggcttttgtatgtatgtgcgatgtacataaagagttcgatctaaatgattcttatggaagtatgattatcacgcgatttgagtaaactccaaatttggtgtttagttgagtagaccataagttggattcccttgaggagataattacaaggttcttaattagtgtgttaaatttgtaacaccttctggtatatagctattttggttcaaaatccgtaaaaagatctcagataataaaattgtcgaacgatcaacttgttggaaagtttttgtaggcagtggcgagttacattggggtccagtagatcgtgtatagtagttgtgcttgcttgttaatactacctccgtctaaaaaaataaataaatcaaatttaacttacgaatatggactgatgcttattgagattcacagcgaaagaaatcaattttaacttatggatatgttacaaccgtgcgcgtaagtaaggtcgatctacacgcgatgactatactttgtttaagatattcgcaacgggaaatataatcttgaagctagctaccttgtgcgaaagattattagtcaaaacggtgaagtacatttgtgggtttccagcgtcaatgcacctagctagaggcagctatatgtatatagcttgaacagtaagcgttagactctgcagctaattcaagcaatggcgttgagaattcgttccccacaacatccctcacatgcatatgaagctactacgtacttgggatttcgtactaacggttcagttttctctcgttgaccttcctggcgtacaaaatttgtcctcgctttgcgtcaatataatccgcctcgacgaatgcaagacgagaagcccacgtccgtgcgcgctgtcagcccagcccaatttgccttatcccttttcctcttcttgccggcccagtccacttcctcttccgttgaaaaacgagatttgaaggaagagacgtctctctattgtgttgaggattgaacatgggactttagtattactactacactataaagtgtatctggcttcgtcttccatttgtcttatcgcgataaccgaattgagctagatcgagcgtaggcgatcgaggtgcccggttccggcaaacgatcaagcttggggaccaacatgatggatgggagttgggtaacgagaagactcgctgtcgccgatactgaaacccgctacggcggcgccaccgtgcgtcgtcgacttggctaattgcaacatccacaagaagcaacctgtcacaacaagtactacaagtctctacctgatgagcccggcaaggtgcaccgctgcagctacctcctggtgctccgcgcgcgcggcgagctgctgctgtccagcgtcctacaagctacaggacgccggctgcaccggccacgagcgcccctctcggtgtcggtgcacgtacgctttccattgcgacacagccttgcacgcgctcgatcacgatccggacgacgacgaggcgccgccgccgagcatgcatgggagagaggagagacgacatgctcggtgaccacgtcctcttcctgggttacccgtgcagcttctaactaaacgttaggcaataaacgataaaagaataatagatcaatcataaaagacacaagatttaacgtggaaaacccttccaaagcaggagagaaaaaaccacgagcgccagccaacaaaatatcttcactatatcggggtgagattacaacaccgaacgacggcttaaaagaggtatatatatgatggtggaaccctaaaagggatgacgatccgcttcgctctggctcaagcctccggcgacaggcctccgctgcgctccagcagaagctagcctttattatgtgtaaatgaatttggaccacaactcaacagcttcgccgcggacgccgtgcggtttggctgggacgcgcgcccaacggcagcgttgacttcgttgttaggtcggagttagtgtaggaagaaatagaaggggtttaaataaactagataaactacttccccttcccatttacatatagtaaaagattttagtaggggcttcatgagagctctcatggtcctcgccccagtattagaggctcgagaccctgccacattcatgctagatccgcccttgggtcagaccgtcggagccttgccgtgtgtataggtacaacttcacgtggatgcatggcggcagtggcggcacgtgacactggtggacatgctgcccgccgaatggaacgacaagagatgcacgtggttctttgctgagcccgacattaatgcgaagaagaagaagaagaagaagaagaagaagaagaagaagaagaagaagctccagcaagccggcaacgccgagacctgtggatctacgttgtcgatctatccccgaaggtggatacgaaaagcacaaaataaatttcctaagaggctaggactaccttaggcaactctcgcaatttcctaagactaaccacaaaataaattacttttaattgaaaaaccatatcatatcatttgtgtgtagcactagcaacttttgttcgaatggtcagaccgttgctgacgttttatataaaaaaaagggtatcctattttaaggagaaaacgagaccaaactttacaatgcatagttgggaaaaagtgaaattaaaccacaactacaacaaactctccaactacgacggcaacaaaaagggacagccaaacacaacactcaacaaacgttgctcaacatgtgaacaacaaggggccaatcaacaagctagaacaaaacaaaactcctacactggtcggcgtcagatgcggccctagaagtgaaggcatgttggatctggggcatccacaccttggtccggcaactcaccggctcggctggtgatgatggcggctccatttattggaggatgtcgacaactgtggtgcaagaaagtaggccacctccatacgctgtgatgggctagggcggctccaaacacacctgcgagcgagcgcaaccgatagtgggattgctctaacatttgtagctcggtgaagaccaaggtgaaaacttgaacgatgatgcctgtgggcgtcgtttctttcttggaagcattttatgtgtctccccgtccagttgtgttttgattctctgggttaaaatctagcacaattcttgaatcggcgatgaagacgcattctggcatcatgtccttcttgaagtcatcatggaaagaaatccatggtagtccctagttttaccttgcattgcatgaagaatggcatttgggaagtctgagctgcaatgttgaggcattcgacgagcttggcaacgatgactcgaagctttgcttggtttcattcagggtttgtctgttgtcctttgggaagtcagtgctgctgcgcgattgcaagcttggcaacaatgacccacatcagaccacgtcagtcgtgtttcgctcttgtgtggggtagcaagcttttcagtttgcatggcttgtcggtcttgctcacccgtgcacaagcaagactggtgatcgtgaagtcggagctacgacatcgacgaggtgcgacgtgtgacaacgatgacatgagtccttttgagttatgcttcggcatgggtcgaggcgttgtcctgacttgttcttgacgaaggtgttggagtcacctgatcacgtgggtgatggtgtaatgacgagcactagcagcttaaacctgccatacttgagccacacacatgtgacatatggtattcgtaccccatcacagaccaagtcatttgtgaagggcaataaaacacaataggtgagtcatgtgaggttggaatttccacccggttgatcataggggttaactcttagggaccctgtttagatgggactaaaacttttaagtccctatcacatcggatgtttggacactaattataaatattaaacgtaaactattaataaaacccatctataatcttggactaattcgtgagacgaatctattgagcctaattaatccatgattagtctatgtgatgctacagtaaacattctctaattatggtttaattaggcttaaaaaatctatctcgcgaattagttttcatttatgtaattagttttggaagtagtctatatttaatactctaaattagtgtttaaatacagagactaaagttaagtccctagatcaaaacaccacctcataaattcttgcggaatgtgacattggatctataaattttctttttaacataaaaaatttcactatgatttgtgataggtattttatacggaccatcattgtcatatatcactgatgggtctcacctctattacgattactaggatcctaccatcacactccctccgtttaaaaaaaggcaaactctggctgtgtagatatgatgcatgtccagatacatagttagagtatactttttttttttttgacagagagagtacaattgtcgtagtgcctattaaagccttagagggtaataaatagcgtttttcgcatcgagcaggcccatgcatgatgcttgtagagtcgtagttgagtctgagcccgactttgcgatgaggctggccatgtgcacccatatcacccggttctccctaatcagatttatcgattacgagtttattatagactagaaaaagtgcccatgcgttgcaaagggaagaaaattaaggaaaatctccttggcggatccgaccgtttggagcagagggacgcaagctgccgtctgtctcgaaggcccgtccatctcgaaggtggagcaaggagagcggagccgataggtggcactaaagatgacatatgtttttatgatctcgggtgtgttaggtcttggatacgactcatatgttccgcttgttattgtgctcttttttgaggatttttgttctgtcacaccctcattttcgtttaagggatttgtaaattatttctaaaatttatattaaatttcattaatttacaagtgaagtttaatgtgagaaataaaatttcctaattaaaacatgtctatatttaatcatttttaaattatatatccatgattaattatactcttaggaattttcctattattaattttaataatacaaagaacattttagtaattatttaaacaattactccttccatctatttttgatagttatatttcatcttggcacaatgatcaaggataagtaattctacttatcatccatttaaacatgccactagttattcctctttttttttcgaacacgcaaaaggattacacgttaatatattagaggaatagagtttttgttacacaacgcaatcggccaaaccggcctatgccagagaaggaagaaaacaaagccaaaaacaaggaagaaaaagaaaaattcgtacgacgggtaacgctactccaaacaacgagagggggcagagccacgctacactcccaacaagtccccaaaggaagcaacgcccgctaatgaccacgcagccgaccctccgaaaggactctagaactactgagaccgaagagagcgcagagtcaaacatcctagagttacgttccttccacagctgccaagagaccaggaggaccagggggtcgaagctggcacggaggtgatcaggtaaacaagccctagaagatggctaccagtcctggagccagctgccacggggttgggggggggggagagcaatccacccaagaggtgacagcacccgtaactagactcgacgagcgaacacgcagtcgaggaggatgtggtttgccgtctcaagctcttgagcgcaaaaggggcaagccgagtggctattgatgccacgcttctagaggagatcagccgttcaacagcactgctgaaatgcaaaccagaggaagaatttgtatttagtagggcccttcacgtgccagagaagattgacacaagcaaagaagtgctggccaaggaagaatgcctggtacaccgaacgcgccgagtagtgctggtcactcgtccaacaccagacaagacgattcccgacacccgacgaaagctgaatgtgaagcaccatgtcccagacaagaagaaactaggagatgaccgggacagtgagggcgctgtggatgtcaaaaatccaagtgttgttcgccaggccagaagcaactgtgcacgaaccacacggccactgatctggagctaaggaggcaaccgagcggccattgatccagtgggcagaccagaaaagaatcgactcaccatcaccctgcacgaagaaggtggatgcctgaaacatgtcagaaacggcttgcttggctggggcctttaggccgtcctagtaaggatgccctgagcgctggagccaaagccaacaaactcgcagggcaaaccctaccaacctgaggtcagcaattcctaacccaccgaaagctttgggatgatagacattcgttctagacactcggcactgcccaccatgaaccgagtccgtgcccgtccacaagaaggtgcaacgcttcttgtcaatggccttgatcacccaggttggaagaccgatcgccatggacacatggactggtaaggaggagagaacagactggaccagcacagagcggccagccagagtggcgagtcgtcccttccagggtggaagacgatgggaaactttatccacaagcggttgcagggttgccttcggcaacttgtgaacggacagcggaatgctgaaataggagcagggaaaaaccgaatcttgtgtggaagaatgaagagtcgtgcattaaatcctcataaacaagcgattcattgatatttacatttctcgatgcgcatgtagccaatcttgtgtggaagaatggagagtcacgtattaaatccgagaaagtcattaatatgatacgtggttggattgaaatatgtctatcaaaagtaaattttttagatttggaaatatgcctatcaaaaatagatggaagggagtattaatgattaaatggtctagataaatattttgttaaatactttgagtgtccaattattttcatgttttttttgaaattatttaagcattggaagtgtttttgaaaattcaaagatcatttcagtgattaacattgacgacgggtgaggagacgcgatggcgcatgtcgaaaagagctacgtccacgtacgctagctctctggagaatcgagggtccagagtcggactgcttgcacgtatccatgccccagccgcaagcaatataatcggacaaatactactacgtctctatctctatttctactattaagatgtttttactggtggtttagtaagtcatccgtatccgaatctaattgccatatgctatcttcgattcaaaaactactgacgtgatccgtgggaagcagtgccatgtccacgtccgattcccacgtacatcgccatcgaatccaaatatgctcccgttgcctttttttttttcttaagcatgtccaaagcaccccctccgattcggttttaccattgccacgagcccacgatcaagcgagatggacttggctctgtactccgtatagattggagagatgtgcgcctggttagattggaaggaaataccgatggtgatggcctgcatgtgcatggctgcatagttgcttttttgcctaatctataactaatataaatattcgtattttttcgtttgtcacatctaattttcgtccgtgttttcgtccatacacaatccgattcggttagcaatagccacggaaaaaaactacaaaaaaaatcggtcgtcgccgaaccgccgtcgccgccgcagggacgcctagccgccggcggatcccctcctgctggatccggcggagggaagagcgccgccgctgctaggacgccgacgggccaccgccgcctcccctcccgctcgatccgccgccggtggtgggggagggcgccaccgccgctgccggtggtggggaagggcgccgccaccgctcgtgggaggaggggcgccgtcgccgctgctcggggggaagggcgccgccgccaccgccactcggggaaaggtcgagagagagggagagagcatcgggagcgcggaggggagggtggcgaaaagagagaagggagggaaggaaatgggctagggttttttcggcggctgaggagagggaggggggtttgattccccgatctcgacgctcggctgtccgatcaaaaccctagagatcggacggccggcgtcggccgggctgaaattggccctgagggatcgagagcgaggccacttttctggcccaagcctaggttgcggcctggagaggggaagtgcgcccgcgtgtttgcaaaagccatgggccgactagcaagggctggaaagaagtctattttaggtccctcgggccgaagaaaaagagaagttcattttagtacttttttttccagaagcatttacgattatagttattgaatgtgtttatttctgagcaaacctaaaaggaaggattttctttctttttccaattaaataattgttaaataatatttgtattattaaaattagcaattaagctctgaaaattccaaagagcgtaactaattctagagaatttaataaaattaaatttaactatgtcattttatttctcaacttgctttacttgtaaatttatttaattatacacttacctaattaacaataccaaatatttcagcgaatttgtagtttaattaattgcatatttttttatctgtacgcttcccgttgcaacgcacgggcacttttgctagtccctcataaagtataatttatactactaggatactacagggaaacggttttaacagctcgtggatgtccactagtttattgcatatcatttaaatagttatgaaaaaaattaaaaaaatatgaataagatagatcaata

SEQ ID NO: 67931 - DNA, 1290 bp, Oryza sativa
tcggtgacttgaatcgggattggaaatttgaggtggaggatttcgatttcgatgagagggaacaacgggatttgaattgagatattggcacaacttagactcgcacacaaagaacgaaaattttcgcaattaggattttgccgaattagtttttaacgcctcacgaaaagcggagcgttacagactatatgtaacggaattgctaactttggacataaaatccgtaaaataaaatttggaggaaggcacactatattattctctttaccgaaattctgtaacaagagtgcttgacacagggtcagtaaacatgtccttttatactattccctccgtttcaggttaacattttgactttgataaatttgatcaagtttatagaaaaagtagtaacattttcaacccaagaaaaaatattatgaaaatatattcaattattgatttgatgaaactaatttaatattataaatattattatatttgtctataaattttattaaatttgaaacagtttgactttgaccagtcaaagtcttataaactgaaatggatagagtactactctaatcggtgtctaagcaaaagagtggcacctacgggcacggccatggctgtgcaatattgtgatgtccaagatcgtttgattaaccaggaatattcgtcttaatttagctactcttcatatctgccttaatgatgagtcaactctaaaaattagtttccatccaattaaccactacacgccgttggtcgagcgcgattgatgttgctggccaggtgcagtatcacctgtaagtttcaaggaacagatgacatcgtttcttagacaagggagtaccccgaacattgaatactttctgcaaattaataattgagccgtccatttcaccattagaagtaaagcaaaccaagagaggtatcttctgaaattaaatcaattttatgccaagcagatcagtagtttggacaatacgtgtcttttttctaagataatggacaatacgtgtctgcgtgttcgtaacttcatttacaaatcttccgattaacccataagccatgctgcggctgcacgggcacatgcacgcatggcgatccttgtagaattaatccgaacaggctatatatatctagaccaatcatcccacgaatcatctcacaatcatcagaaccaaattcacagctaaatcgcacgcacaccacagtctacagcatctctgctttgcagctgcagcttaatttcagagctagcgagctacaactttcagcaaacgcctactgaccacgacgaca

SEQ ID NO: 67932 - DNA, 558 bp, Oryza sativa
gaattttcctattattaattttaataatacaaagaacattttagtaattatttaaacaattactccttccatctatttttgatagttatatttcatcttggcacaatgatcaaggataagtaattctacttatcatccatttaaacatgccactagttattcctctttttttttcgaacacgcaaaaggattacacgttaatatattagaggaatagagtttttgttacacaacgcaatcggccaaaccggcctatgccagagaaggaagaaaacaaagccaaaaacaaggaagaaaaagaaaaattcgtacgacgggtaacgctactccaaacaacgagagggggcagagccacgctacactcccaacaagtccccaaaggaagcaacgcccgctaatgaccacgcagccgaccctccgaaaggactctagaactactgagaccgaagagagcgcagagtcaaacattctagagttacgttccttccacagctgccaagagaccaggaggaccaggggggtcgaagctggcacggaggtgatcaggtaaacaagccc

SEQ ID NO: 67933 - DNA, 7189 bp, Oryza sativa
agaggggaggagatcgagaggagatggcgcgcggctctcggggtagtctttactcccgttggtataaacaaccgggacactaagaagtcccggttgtttataccaaccgggagtaaaaataatcgtgatctgtcttgaacccgacaactttttgaaccgggactaaaaatgatttttagttccggttggtattatcaaccgggactaaagatcaaaagtacccctcaacttttcaacgggactaaagatgctttttagtcccggtttttattagaaccagaactattgtagaatttggctgaccgaccaaagatggtttctccaccagtgtaaccaaccctgtacatatgtgtgccacgtacgtactgcaccgagttagccatcatggacagctcaaccacccaggcaagttcctgtgcacggatcgagttggccgccatcgccacgatttaattactccaatttgtaactgttaaaatacatttttagatacgtaccacaaagtatttcattattcggatcctaaattgccatgacacccctccaagattctacgtgacgtttatgtgacatatataccatatgaacgataaagtaacatgccacgtaaacatcctagtcctaaattttctttttcttctatttcctcccctctgcattttccttgtcttgttttttttttctctggccgagctgtcgacgaggaggggggcccgccacgcggtgagacgcgagggacgaagcagtgcgagcgtaccggaagtggatcgcttgcagaggagaagcgacgaggacaaggttggcggctgatctcgtgaacggggaatctcgacgtacgacacaacggcgggagatcgggaggctagcttagctgtggcagcgcgggagacgcgggagcttgacgaggcaacgccgccgccatgcgtggagctcggcctccatatatatatatatatgccgctcgattcgggcgtcacgtacgtacgccgatgacgccgcggagaggaacgcgaatgcatgcgcatgctgcaggagcaaattaacgttgcgtacgctcgcgtacatgcatgcgccgcccgcgcccgcccggccggatcggaccgcgtctgccaagagggactgagggagtgcgccgctcagaaagattacaagtagcaagttgaatatatgccttgattctccaagatttctcttggagatttcttgtccgccaaactttttcttctttacttctttgtcgccgatgccagcgcaagcaatccaaattggcgcatgattgcgatcgattgttgccgcgcggaaatatacatttccattaatttttatcgtaaaatatattgaaggcgcttctccatctgtctattagccaatcacgggcgttccccggccttttcctaggtttgaagaaagaagaaatgagaaagctcattaccatataattaattaagtattaactattataaaattagaaaatggattttttttaaaaaacaacttttatatataaaaaagcttcgcaaaagacacaccatttaatatttaaaaaaacatgctaacagagaaaagagcatgttaaagaaaataacaggaccacaattatctatcatttaatttatctgcctacttctcatataaatcaataacactaattttatttcagttctttaatttactttatagaaaaactccagaaaatgcttatattttggtttagtactcctatatttttgtttatgttcatgtgcaaccaatttttgtatatcggtaaaattcagacatggaaccaatatttccactcttccttcttcttcatctcctctaacttccatagaggtgaggaagaaattatggaggaaaacaatggcagatgggatccataagttgatttggccagccaatggggtcaaagctgcattaaaagtaagacggaatcgcctcccaaaccactaaaggaggaacaaacgtacaatggtcaaagctgcacttaattagacgtatggctaattaagtacggacaaacgtacaatgctcgctggttgtgtctctgcttacctggatcgaccgatcgagctaacatcgccgatggacactggttaagaatgataccaggtgaaacggtaaatgcgtcaatccgatccagcagacatggtcaacgtcaacccagcacagacagacagacttggtatatatcctcgaccatcttgaaatccctatagagaactcgtcatcgtcctcacataaaccgatctgttggcgagttcgatcatccgagatcttcatctcactttttggaaaagaccgaaatttcatgattcttagagctttcttgcaggaattatttaaacttataactgaatctgaataaataattttgaccaaattcacagaaaattagaaaaattcgagaacttcttttaacacttaacttgagatagtggctagattgcccggggtgggttttgatactgatctcaccttcttttatcacttaacttgtgacaaatttaactatcatatattctatgaaaggtttatcaaattattatcatatatcatctattctgtggaatctattctatggaaggtttactaaattattgtcatatataatctgtagcacggctgcctacctacttttactttttttttccctccaattattctaggacgtcacgactatagttggccataaggcccgaggcccgacggcctagcccagggcatgagattttgacccagcccacgcaccgcatggcccaatccctgttgggcccgtgtcagcacgacccggctattgggtcgtgccgaggcctatgccttggcacagtgggtcggcccggcacagcacaaagtttagggaggtgaaatagacttattttcagccatatgtatagagggcacacagaatagggaggacaaatagatgtattatatgcatggcacagcccaaagagtagggacgtaaaatagacatattttagctatatatatgtcacaacccaaagatgagggaggggaaatagacttatttcaaagaaagcacgatgagctgcctgtgccttggccgtgcctgggccataggtggagcacgtgggccggcacggcacggcacggctcggcgtgtaggtcgggccgtgccgcgcggcctgacaaatcttggcccgagcatgatcaggcctaggccgtgttgggccgggcagcccatttggccatttatagtcacgactcacaaccagacattttcaatcctgaactttcttaaccggacgaattaccctctcgtttaacaacaaggttgttttagtccttggtgacgcagatgaggcaatgtattaaccatgtgaaaatcagtcaacaacttaataacataaatattcttaaaattagggtggcctagctgtcatactcacagccccgtttcttccgcctctctctctctctcaacctcaacctcaacagaagtaggtaggatgtaacgataacctccacgagatacggaaggaatgtcgcaacgccctccagagttggccaaggaaggtggcagccatgtcctctaggagtcggaacagaaaggtggcagtaccactaccacccgtgacgcgccgcattgagttaggggaggagaggatatcgatggggtagaaggggcggcgctatgtgagatggtggcaggagggggttgaggtggtggtctataggaggaaggcgaaggcggcaacgaggggctaccaacgccgtggtgttggcgataaaaattatgtagaagcaaggtggtggggggaggcgcgcgccgatggggaggaagcgcatgatagtgctattgacctaccaaccggtgttgtttgtctacgggctcccattttctcactatttttccgttcgatgcaaattcaacgctacagaatgggctgaaaaattcaaatttattatttataaaaaaatgatacgcttacacactactggatacgtttacacactagctagacagtacaatactacatctttattttagatatataatagatagggcatcatgacatgcagatatctatcgcgttagtagggcctttcgttcttcatgttaccacgcgggaagtagttgcaagcgatgatggtgccgatgccgttggtattgcaggcgacgcgggcgcagccgacgtacgccgtgcgcctccacaccacctgcgtgtagtgcgtgcagccgagctcgcccgccgagcagtagttgctgtcgtagtagtactttgccttctcggcgagccagtagctcatggcgtcggccggcgtcccggtggtgccggcgccgtagctccaccacaggttctcgccgtagggccccgggatgtgctgcgtctggcagtagcgcgcgtgctgcagggcctgcgccgccagcgcgtcgttccacgccacccgcccgacgcccaccgccgcgcgggcgctgttgtggaggttgacgaaggccgccttctcgtcttccgagaattgttgcgccgtcgtggtcgtggccatgataatcatggcgaaagccgccatgaccaccaccatcatctttgctgatgctgatctctccattcagtttttcagctcctcgctgattcacgaattgttgctgcaacaagctattaagctatatacctctcgctagctagctagactccagtatgagattaacgcatgcaattaggcagtatttataggcggatcgatatgatacacagggtgatctcaacacgtacggctaataattaagtactataacatatgatgctctctggtacgtagtctctcagcaaaaatacctcgagctgacatggaccgatgcacactggttaggaatatgatgatataccaggtgaaacggtaaacgcgcgcgtcaatccgatccagccagcagacaaggtaattaaacgtcaattctcagcagacagacttggtatatatcctcggccattttgaaatccctatgtgtagaactcgtcatcgtcctcacatacaccgatccgtgttgccgacttggatcatccgatcggatgatcgttggtcacccacggtttacacgtacttttcagagaaagaacgaaatttggtcagcaaaatttcgtaattttcgggattttcataacatttttcacgaaattctttcctttaattgaatttaaataaattttgatcaaattaaaaaaaatagtgatttctgcagaccttttcgtgcatgcgggcccgccaaccgcatggtaaaactggttctagccgtatgcaaaaaccttctattgtatgaaagttttattaaattattaccatatatcatctattctgtggaatatattctatgaaaggattaataaattatttatatatataatcgatagcacggctgcctacctatttttgcttttttttccctccaattattctgggacgtcacaactcacaaccaaacgttttcaaccatgaactttcttaactagacgaattacctccacgttcaacaacaaggttgttttagtccttgttgacacagatgtgatgatgtattaaccatgtgaaaatcggtcaacaacttaattacataaatatttctaaaattagggtggcctagctgtcatactcatagccccgtttcttccgtctctctctctctctcaacaacagtaggtaggatggggaaactattctaatccctcgaggggatgttcctcatttgcttaaaaaccatctaaacggttatgaaaaattctgaaaaaatttgacaacattcatacaacacatatagacaactacacaaaatcttaagtgcaaacttaactcacacgtcgagatataaaaaaattcaaattcagcgtatgaatagtagcatactgtttatatctaaatttgtcttttttgtttctcgatgtgtagatcaaatttgaacttgaattttgatggactaataggtatcattatactctacattgtcatttttctttcagaatttttcacaactatttgcattgaatttagaagaaaaatgtatacgaggggatatccccctcgagggattagaatccacttctggtaggatgtgacggtaacctccacgagctaggggaggaatgccacagcgccctccagagttggttgaggaaggcggcggccatgtcctctaggagtcggtacaggaaggtggtagcaccactaccacccgtgatacgccgcattgagctagggaaggagagtaaatcgatagggttagaggggtggcgccttgtgaggtgggggaggagtgggtggtcgagtgcggcagcagcgacggcaagaggggtttgaggtggtggtctgggaggtaggcgaggggtgcaatgaggggctacaaccgtccacctctgtggtgtcggcgacagcggattctgcatgagcaagagggacgcgccgatggggaggaagcggatcgatgatagtgctacgggtccatcaattggtgctatttgtctacgggctcccattttcccatcattttgtcgtttgatgcaaaataaacgctccacagaatggaccgaaggattcaaaattttcaagcaattacttttaacttcaacatgcacttttcctgggcaattaatttagcaaatccgtacttatttatttattatttatgtaaaaaaatacatacgtttacacactactggatacacacacgtagagaatactacatcattattttacataatagatagggcaacatgacatgtgcagatatctatctatctagtagggcctctcgttgtatatgttgccacccgggtagtagttgcaagcgatgatggtgccgatgccgttgttggtgttgcaggcgacgcgggcgcagccgacgtacgccgtgcgcctccacaccacctgcgtgtagtggcggcactcgcggccgccgcagctgttgctgctgtagtcgtagtacggcttctcccccacccagtagctcatcgcgtcggccggcgtcccggtggtgccggcgccgtagctccaccacaggttctcgccgtagggccccgggatgtgctgcgtctggcagtagcgcgcgtgctgcagggcctgcgccgccagcgcgtcgttccacgccaccggcccgacgcccaccgccgcccgggcgttgttgtggagctggacgaagaccgccttctcgtttgccgagaattcttgggccgtcgtggtg

SEQ ID NO: 67934 - DNA, 17908 bp, Oryza sativa
ctaataattaagtactatacaaacatatgatgctctctggtagtctctccatctgcaaaaacctcgagctgacatcgaccgatgcacactggttaggaatatgatgataccaggtgaaacggtcaatccgatccagcagacaaggtaaactaacgtcaattcagcagacagacttgcatggtatatatcctcggccattttgaaatctctatgtatcgtacgtacgtcatcgtcctgacataaaccaatctgcttatgttgccaagttggatatgatcatcgattcgatcggatgatcaccgaatttcggtggtcacccacggtttacacttttcatgaaagaccgcattttggtggtcaccaaaagttcatgatttttgggattttcataacatctttcacgaaattctttgaaattttaactgaatttcaattaattttgaccaaattcacaagaaaatccaataaattcaggctagatagttgcttgccgagcgattcgaaattacaaaaggtctgaaccgaaacctaaataactgaaatcaccctgttttaacacttgtggcaaatttaattactatcatcgatgaaaggtttatttttgtacaagattacaaatctctttagttttcagtataacagatatctggtaaccttgagctcgtaagtgccagatctagacaccgagagggcttatactggtctgcaacaggttttggcaaaatgtggggtagtgatggcaacgggtactgcccaatattctgttcaggtgaagataactatcgatttttaacttgacacacacgatccgagccctgcaatcgctgcaccaagtatcatttggttatcaaccgtaccgaaactcgattaacctcgccgagaaggctaatccctgcacgcgaatcgaataacacaagtaaaaacaagaaagacaatagttcaattgcagataaatgattaatcaagaactcgaagttgaggttccacaaaccgatgaacggcgaaattgtaatggccgaaataatctaagcaaaaccacactctaaactatgattgtgttaacaccaaaatttgatacggttctttagagaattcagttaaggaaagaaatcgattggtagatggaagtttctcaagatcaagctgaattcgagaaatcatgaagaccatggtaaggcagtttcatatagttaatatatctcttaaataggcaaaattagttattttccttttcttgttaggagtcttgtctcatgtctgatctcttgtatcaactcaagggtataaatatatacacccgggtctttgtaaattatccacaaaacaatacaattatatttcgctgcatcgtcaaccattcgatgagttcttttttccgagtagggctgcattggttaaattcgatctccagcgagaaagtaaatttcgcttgtataataagcgaggaagaaaaaaatgcacctttgtttgatgaatatatgttgtaaccatggtcatattcctggtggtgatgatgacctcatcaggtagtacaacattgacggacacaatgcataagcgaactctccaaacaaaaacctttttgatcagactccagtagaaacacttcagaaaatcaggcatcccacatatggaatccaaactatgtatgaagtggtccatgtatatatatggcacgtgattttaattacgtattaacttttaaagttaatttgtttacggctggatggattgtcaaacccaatacactgtctagctaattaatctcttgtaagacaaactgcctagctagttaattactatgggcaccaggactatataactgtaatcttcaatgtttccgatgaatgacgttggaggttgaaattatcaaatgggatacacacgttctcttttggaacctgcagtggttagcaggttatatgatctgctatttttctttctgaaagtgatgtatcaatcaagttgcaattactttcgggttattcaactactctgatatatatataaaacaataaagtacacatcgatcggtgggcggtaattaatcaaaagaatgtgaaaatcaaatctgaagtcatggtgtattgcgtgtgagtagataaagggatgcgttgcattgttcaaatttgagacttcagattgatccaccgaatgacgattttaggtggccggcccattttatcatagaaagtgagtcgatcggtacaagagaagagataaaaaggagatggatttttatctctcgagaatatttcctcgtttcttacatccataaaaaccacaaaacatttttaaaaaactggcaatacatgctagctcgttcaaattcttagaagttgaatttgaacatgttttttctaagagttatatatctcatattaatatatcttgttatttttttaatcttttatgactattgaggtgacatgcaataatcccctcgagggatcaacaaattaagctggaagcggtattgttctataaagcctctacgaaaataggattgtcctcggtgatttcttaagacgtctatctgagataatttatcaaagctttattcgtttctcgattgtggttccttgaaaggaccacatatatgttagaatgattttctctaggctgcccatagacacatgtggaaatccggccctaagtaacaagtgggtttcgtacgattgtgtaaatagggcaccattcacatgcaaaaatagttgtgtacaattgcaagtagggtagagaaggaagatacaaaataatctattaagaaggtatataatgtctcgatacaaaacaatgttgtattataattttatctaccatatactctaacacggtgtttaacactgtataacttgcttgatatattattgcatggcttgagttcgaaaataaaaatcatgcaaagcagtagaaggaaattccaatatcataaatactattgcccgggatacagtctagggacaggataccttaatagtgaaccattatattccatcgatgtagatccgtttatccaccgtctttctctcaaccaatcgttctgtccttctccttcctccctcctcatactcccccattcacatcgatcctttctccgatcgccggaggaccaatcactcttcctacaccagatcgagaggccctagtgagagtatggatgccgacgaggtcacacggatcaatcagaattggtgaggtcaataaagtgtgaggctattgcggtggtgaggtcactgttgtcatcgttgaggagaaagaagagggaagacacggggcggagggggacaaggtctgaggcaccggtgatacggcggaggcggtcattctaggcatggagttgacaaagcggacagggggtggtcacaaggtacttctcatcacctctttgatgctcatctgtattgtctaccggtatgccatcctcggctgatgccatgtattgggcatgatatctcggggtatcacggatgttacctgctggtattaggcttggtttctaggtaccagggtttggtacccaagtatcagctagtacacataggtaccaggtaccaaggctaccaagtttcatgtatcagttagagcaagtataatagtacttcctcaatcggtgataacaacagccacatcatccttgtattacatggagggagaaaacatgaaaacaaacggagcgagtgcttgttgaagcgtcgggtgatagcacgataatttaggcggtatgaaatattttgtatgctttgtgggcatttggttcaattcgtttcatttaattaattatgatatgcatatcgctgacactaatgtcagtctatgatataatgtttccaaccgtgtctgcacgcacgtataaagccaagttggtcatttatcaaacatattagattggtttattaaaatgcttatattttaggacagacgaaatagtaacaaaatcctttatttatcatagtaagtacgaataatttacaatatatattttacagcgacgtcgtttattccatatacatatctgatgatgcgtacatgcatatatgtagacatatataggcgcgcgcacacacacaatccggctacatagatatatatctgactaaattaagtactcacttaattatatatagttactagaaaatatatatatagtctgctagtaagggcgctgatcgggccagttgccgggcggggaatagttgcagctgatgatgacgccgccgccgttgctgcaggcggcgctcgcgcagccgatcgacgtcgtgctccgccacaccacctgcgtgtagtggccgcactccagcagcgcccccctcgtgcacgtgttgctgctgtacacgtagtccgccttctcctccatccatttgctgaccgcggccgccgccgtcgccgcgctgctgccggcggcggccgggccgtacaggttctcgccgtagcccaggtcctcgctgttggagtgcgcgaggctgcaggtggtggcggcggcgagctgcgccacgtagctctccgcgaacgcctgcagcgtcgtgctccacgccacgtcggggaggccggcgccctcgccgcgccgggcggcgttgtgggcgtcgaggaagtcctgcggcgagctctgcgccgccgccgtgctggccgccatggccagcgtcgccgccgccagcagcacgagggcaaaggctttctgcgccatgctaattaagctaagcgctatatgagtagctgctaatgtgtgtgttgtacttcgatgtgtgttgcttgctgagggtatttatagctgaatcaggagagctagcttagctcatcgattgcatcaattgcatgcaataccatggctgattgcactaccaatatactccctctgtttcaaaatatttgacaccgttgactttttagtatgtgtttgacaattcgtcttattcaaaaaaatttaggtcatatcatttgattcattgttaaatatactttcatgtacacatatagttttacacatttcatattttttttaataaggtgaacggtcaaacacgtgctaaaaagtcaacggtgtcaaacattttgaaacgggggaagagagtatatatttgggacgtggcaatgaactttccaattattttcctgatcgatctttacttttagagtagcagtgtgcccaacgtactactcacgaacatacgacgacgatatgatgctaatacgacaggggttagaaagactttgacttggtcttgcactctcacgttttgctttgattataattaattggtcaattctagcaaactggtggccatggatggatccaaattactttaataccatggcgcgcgttacctccatatactttctttagctgggcaggtgaatcaacttgatgtttacttttctgtacgtcatacatatcgatatcacactatctggaaaaaaaatcttgcatgtcaagtattgttgataatgatgggtagcaaagcacagcctttttctacacatgattccactgggaaaaaaaatcaggcaacctatgtaaatttattgaatttagtggtatatttatatagtatatacctccaatcataagttaaagaatataagttgttcaagacttcttaagatcaaaatgagaaacatctagaggtcttctggctagctccacaaggtggtgagctagctaactgacggagcgtggggctcctcaccggaagaccgcgcaggcccccctttgccggttcggccgggggcgctaagtgaagttcttaaccctcgatctgtggaatgttcgcgagagagcaaatgcacaagacacgggcgatgtagacaggttcgggccgctgagaagcgtaataccctactcctgtgttctggtggatctgtgtgtgaaggggttacagagaaccggagagcaagagagttcgaactctagaactcctcttcctttttctctcctctacgtctcaggtacattcagagtcgtctcccagtccccccctcctttggtgggcaaggtcctccttttatatctcaaggggataccacatgcaccacttctacctactcttcttttgggtggggacccaccctatcttgaccaaaacttggctcgcgccttcgcctagaagctaaatcacagcttgtccttgagtgaggcccagcgccgtcacttgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgccgatgacgtgactggcgtcagaccagtcacagaccggtcattcttgtccaccgcgtgtcagtttagcatgccgcacgtctgcccttcttcatacaatgacttccttgccatggttgcgatgaagcctggaatgaatctggctgggactgacgtgctaactccaggagttagcacgccggctccggctagggacgagtgcctggaggctctcatcattccgacgggacggggcgaggcgtgtgacaggccgcctgttgccacctaacccgcgatctgaccggtctgtgaccggtcacacaccgcgactggtcacggaccggataaatgcgcgctgcgccgcattaaatgcggcgtgatgcgctcgtccaacccgctataaatgcggttaggtgagcgccgctgtgctcacctaacccacacacgtgacgccaacaccacagggggtcggggcgccgcagccctcggggccgaaacgggagcggcccgacccctcggggagacagtgggaggggtggccacgtcaccctcgggcccgacccccccgagggggtcaggccacgtgggtgaccgcggctgcccaagcctctagtcacgatacccccggtcccatgtcaccgacactaacctatgttcgaagcctcaccccttctaattatttgatattaggtcattccctaatatttgtggtttttttgttaagatcaaaatgtcatccaaatagtcatatacacttttgacaaatttaacagcatatgtatgagtatcatttcacaaatatacaagtctaaattcaacacatattgtatgttgaaaacataacagattaaactctaaatagtataaactccaaatagtatagttgtatttcaagctagctaggtactccctccgtttcgaaatgtttgacgccgttgactttttagcacatgtttgaccgttcgtcttatttaaaaaatttaagtaattattaattctttcatatcatttgattcattgttaaatatatttttatgtacgcatataattttacatatttcacaaaagtttttataattaaaagctttcgacgccattaattaacagagaagctcgatccagcagatgagtttctcaagctaatatgtggtgtgctgagtacttgttgcttgctgaggtatttatagcagctaaatcatgagagctagtatagcttagctcgattacgagagaggatggaaagactttagacttggtcctgcactgtcacgttgcttctagtagatgttaattaattccactaaatataattaagtggtcaattgtcgcaaacttgccatgcttgtattcacactgtgccttatagtctttggcacacagctgcatactttcttcatctgggcaggtagtgaatgcaacttgatgtttatttttcttgcttatttatgtatcctatagccaatagctcaacatacaaaaaataaaggagctattggatcatttctatgcttaatcacaaccatccattttgtagcttctttcaagattaaaattagagtaaatttcacaaaactacaggtattttgcataatttatcacaaaactacggatttaagagcttgtttcacaaaactacagatttagtgtcttcgtttatcaaaaaactacaggtattttgtacaatctatcacaaaactacagatttaagaacctgtttcacacaaatatagatttagtgtattcgtttatcacagtgctacacatttaatgtcttcgtttatcacaaaactacagatttagtgtccccattctcacaaaactacacgttttaacaatgctaaaaggtgtagttttgtgagaatggggacactagatttgtagttttgtgataaataaagatattaaacctgtagttttgtgaaacaagttcttaaatctgtagttttgtgatatattattcaaagtacctgtagttttgtgataaacaaagacattaaatctgtagttttgtgaaactagttctaaaatatatagttttgtgatagattgtgcaaagtatctgtagttttatgaaatttactcttaaaattaagatcatatatcctatatatatatgcccagctgggggcacaagacatatcgttgaggacagaggcaatattaatatttggcacgttgcaatatgaactttccaatgattttcctgatctttttctctcgtgtagccgcattacctaactcacgaagacgtacgtacggtattatagtacgtacagcatgcgagagagaggttggaaagactttgacttggtcttgtactgttttatacctcttgtagttcttaatcctaactactaaatataactagagttaattataagtggtcaattgtagcaaactagccatatatgcatgcatggatccacactactttagtctagcttggcacacgttactttagtcaattagtctttagcaacttgatgtttaattttctggcctatgcatgtatccatgtcacaatattatctggaaaaagaacatcgggcatgtcaagtattgataaataatactagtaggtagcaaagcatgcacaacccttttacacacgagtgtgtccgcaagctaggacaaaaatcaggaaaattatgtattttcccatgcagcgcgtctagctctccgcatgggaaaatgatcttttcaggcggaccgcccgcgcgcccgtctgtgaagatcgctgttggggtgcaagcgaagccgtcgtcgttcgtctgggaactggaaaaatatgtttttaagtagtaatagttattgtagttacttatgtacggtgttatagtacgtacacctctgatcataaaagaatataatagtactattcgtaattctttaacagtagtatacaaaacgtttgtaagtatggtccgtaacttgttttcgcggcatttattccaaccacctgtgactatgtacaaccaagggcatgtaaaaatcaaggatttgcgcggatgaatttcgaactgcacataaaagttgattttcatagacgtctcatttaaagaacacaccgtgaaaatgaattttcagtttttattttaaaaaacccaaaaaaatattttgtattcttattgcttgtgcttggactataggaaatgttacaatatatggataggatcgtatagtacatcccatgaattttttttaacactggtggagaaggggtttttactctcagttcgtaaccccctgtagtctcggttttccaaccaggactacaaatctgaaactaaagatcgctatctttagtccgggtgaaaaaattgggagtaaaaatccatttttagtccctgttgataacaccaaccgggactaaaaagactaatctggttgctctttattattttattttcttcattgtttttaatatatattgatttcacccccatcccgtcgccaaaatcccaaatcaataattctcaaattgcctccaaatccacaatcgatcatctcaaatactcaaatacatcacaaaatctcaaaaaaaaattacatcacaacttctacaaaattatcaaatattcacatcacacacaaatcaaatacatcacacaacaatctcagatccaatcaaatacatcatacaacaatcttagattctaaaaaaaaaagaaaaaaatccgccgcctcgccggccggccggcccgctgtgccccgccgccctcgtgccggctgccgccgcctcaccgcgcgccgcgccagccgggcctccgcgcccgaccgccctcagcctgttagagagaagaaggagaggaagataaggttgtggagagaagttaaaaggagaggaggagataaggttgaggagaggagataaggttgaagagaggaggagagaggagttaaaggagagaaggagatacctcgatccgatcgcgcatgcctctccgatctccgcgtcgatcttttttcccggttggtgctatctttagtcccgattggtaacaccaaccaggagtaaagcatatgggaatcttttttcccgattggtgttaccaaccgggactaaagatagattttagtccggttggtaacatcaaccgatactaaagattgaaaagtacctggagttttcaaaccgggactaaagatgtttttaatcctggtttttaatacaaccgggactattgtgaaatctggtcgactgaccaaagataatttctccatcagtgtaagaacaatagtatcccatgtataaatatgattatttccatataatatatttataccagtccgtaagacttcatataatcgaatcaaatatatgcagtaaccttaggtgatgaaaatcaaacacccctttatttagtactccctccgttcctaaatatttgacgctattaatttttttaaacatgtttaaccattcgttttattcaaaaacttttgtgaaatatgtaaaactatatgtatacataaaagtatatttagtaatgaatcaaatgataggaaaagaattaacaattacttgatttttttaataagatgaacggttaaaaatgtttaaaaaaagtcaacggcatcaaatatttagagacggtgggagtaatttgtaataaaaatacacaccggatacatatatttgtatctgtatagatatactcaatacgcttgcatcatgatgtacttattccatccgacacacacttatatacgcatgcagatatgcatacatacatacgaacatacatatataatatagttcgcacatatatgcgcatatatatctatagatcgattacgtacaaacaatatataagtatagtagcaaaatatatataccatagcatatacgtaatacgttacgtacgtatacgtatacggtagctagtacggcctctggttttggacgttgccggcggggaagtaggtgcagatgaagaagacgcctcggttggcgttgcaggcgacggcggcgcatccgacggcggtggtgtcgcgccacacgacctgcgtgtagtggccgcacatggcgccgccgacgcagctgttgctggcgtagtcgtaggagcccttctccgccacccactggtcgacggagctcgccgccgtccacgcctgcacggaggggttccacgacaggttctcgccgtactgatagttgttgcgatcggagtgccgcagcgcgcagtcgccggcgcgctggttcgcgtagccctgcgcgtacgccgccaggttgtcgtcccacgacagcgccgggacgccgacggcgctccgggcggcgttgtggatgttgacgatgtcggtcgccgtggtctgggcctgcgccgtcgatgtggtggccagaaccaccgccatggccgccatcaccactgcaaagctcgctcctctctccattgcaagctcgcagttgatttgattggcagtgtacgttcgatcgactgcgcaattagagtagaactagagctatagctagctagtagaggtgatgattaatacatgcaatttcggcagtatttatagacgggctggctctcgatcgagccatggacttaattaagcacatggcaaagaagaaacggtaaacgttgatacggcggactggtccctaattattaagagaaagaaatgggagaagagctgaagaggtgataagaccagaaagtcatgaacaaagcactcatgggaaagtggataatatgcgtggcaaaacttgttactacagaccaaattctcttacccagaatgtctgaaaattcttcaaatcgggtgcccgcgcctccgcgccgaaaaaaatggggcaccgcgcctccgtccaccacgcgccccaccacacgcactgttgcaataaatctgccacatattacggaaacactctattaacaggaatccgtttcatttttttttcaccaataatgtttcaacaagtatattcgtattgttacactatgtatagatcaaatgttgcagagaattgaaacatcctttcgctatttgctgaaacattatttttatatgcggtgaaatagcttcaaaaaccgttgtttcatgcgctgtagcaaaatgttttatgaggtgatttggttgtatttaagctttttaaacgattggaccattttcaatcaacgtagtgaaacaattccgatcgactgcgcaattagagtacaactagagctatagctagctagcagaggtgatgattaatacatgcaatttcagcagtatttatagacggactggctctcgatcgagccatggacttaattaattaagcacatggcaaagaagaaacggtaaacgccgatacggcggactggtccctaattattaagagaaagagatgggagaagaggtgagagaagacctgaaagtcatgaacaaagcactcatgggaaacaaagtggataatgtggcaaaacttgttagtgcctctgtttcagattataagtcatttgcttcaagtttaactaagtttatgaataaaatagtaatattttcaacccaatacaaatatattatgaaaataaatttaattatcaatttaataaaactaattaatttagtgttgcacatattactatatttatctacaacttaatcaaacttaaattagtttgattttcaccaaagtcaaaacgacttataaaacggatggagtactacagaccaaatacttacatgagaaaactcttacccaaaaagtctaaaaataggagtgggatgatggagaagtttatactccgtatatctttggtggagtcgatcagctaggaaaggatgtgtcgggtgctggatacttttggcgcttcctttggacgcttttcttgttgttttgctctttgtcgttccataaacagtactatcttcgttttctctagttaaaattgtctaagtttgattaagcttatagaaaaatataataatatttttaacacaaaataaacatattatcaaaacatattcaatgatagatttaatgaacctaatttggtgttttagacgttgatgaattttacaaatttgtgattgaactctaaaaaaatttctatctttgatcactatttttttttcataaaaagtaaagttacacgtgcactggctagtagatgggtggaaccattcaaatttccaatgcatatgcgtccattggaatatgggtaaccatgctttcctgccgcgttttcttcctttctagctaccctgtgacgttcatcagcaagtacatggccggatcgacttaatttgatccgcttgattattttgattagaaatcgatttcccactgaccaattcttacacgtacgtctatctagttgagaaatcatagcatgtcgatattattttatcaaaattgcggggaaatattactttgtctcttataagggaatatgtccccaagcttgttgcttaaataataaatgtcaatccaaataataatcatatattttgttgaaaaataattaacaatatagatcaatatctggtatcacttcacaaactttcacgtttacatttgatgtatgcatactagtcaaacaaacaaattaaactctaaattgtacgtatgtactactacctccgtcctaaaataattgtaattttaggttgtttggcatatattaaggtttgagaagaaagactataatgtccatctttaaaaggtgtatagataaaagtgaaagggtggttgagggtataatagggagaaatttaaatgggaagtgattaatgagacaattactactctattgtgacaactattttaggacaaatttgaatcctagaaatacaattattataggacagaggtagtagctagtagttatttttcaaggtatatggtaatatcaagcagtaaattagtaatgagcactctaatattttacccctcggccatatagctaaagctttttttttcttagctataaaattaggttttcacttaggccccgtttaaatctgcttaaaaggatggattaaattttggattaaagtggcatacttttcaaactaataaacggtgtgtttcgtgcgaaaactttatatatgaaagttcttctaaaatatcagattaatccatttttcaagtttgtaataattaaaacttaattattacaaacttgaataccatccattttatagctactattcatcattatacctccatatactttctttagctgggcaggtgattcaacttgatgtttaattttttttctggcatatatatcgatatcacactatctggaaaaaaaaatctggcatgccaagtattgatgataataatgggtagcaaagcacacccctttcttacacatgattccactaggaaaaaaatcaaccaacctatgtacgtaaatttattgaagttagtggtatatttatatagtatacctccaatcataagttaaaagaatataatgttgttcaggacttcttaagatcaaaatatcatccaaatagtcatacacttttgaaaaatttaacaatatatgtatgatatcacttcacagagatatacaagtctaaattcatcgcatattgtatgttgaaacataataggtagattaaactccaaatagtgtagttgtatttcaagctagctaggtgtatgttaacggttttgctagagtagtgtcaacagaaattagaggaggaagctttcaaattttcaaccgccaccggatatgcatcaaagattcgtaacatgagaggagaaaaatcgtgtgttttttctctgtgcgcgtggtatgaattaatctcgagacgctcgacttgaacgatagctatgctaaccacttgtacctatgcgcttttatgataggtatatactagtataagttataatgtaattacattataattatactattgttacatttgaaaatttttcactaaaaaactttttaatggtatataagtactcccatatgttaatatcatcaaataataaattcatttccacatgtcgtagctcaagagagtggtatatatcaaaatgaatttttcaacttttgatatttgtaaagcccctgcgaacaaaatgggattatcctcaggcagatccttaagagtccgcctatgataatgtttatttggtaagccttttccccattttcacatacggtttaaatatctaaccctatgtatatgacgacgtttcttgatacattaattattgcatagctagtgatcgaggtcgagaataaaatccatacaaaagtactccctctgtttcataacgtaattaagactttttagtattctccatattcatatagatatgtctagatttattaacatctatatgaattaatgtgagtaatgccagaaagttttatatattataaaacagaggaagtagtagaaaggaatttcaacataacaaatcctttatttatcatgtactccttaagtacgaataacgtactgtattctgtatgttttacatatagatatctgatgcgcgcctaacgtacatgcatctactccagtattaattctactagctagtacgggcgctcgttggggacgttgccgggcgggaaatagttgcagctgatgaggacatcgccgttgttgcagacggcgcggccgcagccgatcgacgtcgtgctccgccacacgatctgcgtgtagtggccgcagtcgagcagcgcccctttggtgcaggtgttgctgctgtacacgtaggacgccttctcctccatccacaagccaaccgcgtccgccgccgaccacgccttcccggcggggccccagtagaggttctcgccgtagccgctgcccgacgtgtgccggagatcgcacgcgccgccggcggcggcgctcgccaccacgctctccgcgaacgcctccagggtcgcgttccacgccacgtcggggaggtccacgccctcgccgcgccgggcggcgttgtgggcgtcgaggaagtcctgcggcgagctctgcgccgccgccgttccggcctccatggcgagcgtcgccgccgccagtagcaccaggacaaagcctactttccgcgccattattgcagatcgatccaatgcagaagagtttctcaaggtagctaaagcgattgtgctgtgctagctgatcgatatgtgttgctcgctgatcaggtatttatagtcgttatatcacaagtagctcatctattagctcgaagattgcatgcaataccatggctaattaattgcactgtttgtatttggcacgtggcccaaatgaactttccaattaatttccacatctttttcaagtagcacgtacgtacgatattcgatgctactaattactccatccgtcccataatataagagattttgagtttttgtttacactgtttgactactcgtcttatttaaaaaaatttagaattatttttttacttactttattatccaaagtactttaaacataacttttcgttttttatatttgcacaaattttttgaataagacgagtggtgaaacggtgcaagaaaaactcaaaatcctatatattatgggacgaagggagtatatatctagattatgcttatgttaaacttgatcatattatagtagtataatcctgtccgtacgttttacaacgtacgcgcagcatgcgagcgagctagggaggttgaaaagactttagacttggtcttgcagtgtcacgttgcttctagtagtttttccttccaccaattgtatgtggtcaattaattgtagcaaactggccatatgcatggatccacactagtttaatattatctcccacgttacctggatatactttccttagcagctgggacaggtgaaccaacttgtttaattattctctgtcatatatatctttttttaaaaaacttctgtcatatatataccaagttttagtgaaactagttttgcatatacaccaaactagtttcgttaaaactaaactttaatctattttgataatttgtctgttatgtattgaatttttttctatatttttatataaacgtagtcaaaattaaaagaaatttgactagaatcaaaacgacttgtaatataaaacgcaggggatagctagctatgctagagacaaataaatcttcataatattgctagcttgctctccctctagatctggcaaagggagggcaccacggccaggccgcgccatgcgaccgagccgccgcctcctacctctagcacctccgccaaaccgctgagagagaggggggggggggagggagagctgagagagcggtgtgagagacgaggagataagatcgaggaagaggaggtgttggccttatcacctcgtgggttgtggggccggccaactatctgcctgaggaccggctcggtttgatttttaggtgccggttcttgactatgaactggcatctattctttttaccacaaagatgccgggtagcgcccgttccgtcgtggcgcctagcgggaaaattatctcctaaaaaccctaattgcgaaagttgtttctttgattgttgtctagtgcccgtgccatctcatgatctcaatccccgctctatcgtcgagttcaattccgaatccaatccctccaaatcaaattcctccgcaaaagtccattttgcctcccccaaggtcgatgggccgattttccctcggcccatcttc

SEQ ID NO: 67935 - DNA, 1729 bp, Oryza sativa
cttcaaatatctgataaacgatgcttggagtatgtcaaaccaaaatatgcaagttccagaaagactacatataatatctcccagaacttcatatctgtaaattttctttgccacctgaatcatgaagcctttgatcttatagaaaactgtgcattcagtaactacatgtagtaatagaatgacagtatggttttggacagaaaagaaatcaacatgaaaattctctggtcaattttcaagataaccagatggtttatagacttctacctaggacttctactccatgttatgaacaacttcagtttgtcactgttccaagccaagtcactggctgcacgatattcctatttcctagtcacctgctgtttcagttggtactgaacccgttaaaaattgtgacagactgaagcaattggctaatcactaggaagtcagacctcctaatcagttgccaggtccaaaaacaggttttactattttcaatatttgagaattgagaactatgccacgcatggcaagtactgctcttggagtttcgcatactcaccatattatagtaaatcgatatcaaagtgccaactttgatattcagctgttttccatagttagctaacaaataaaaggcatgcatgcaagggcagctaggtcatgtgtgcttcatgctgtgctaacctcatgcaattagaaggtttggagtagttcaccactacctagctttcggtagctcacgtttgatttaaaaaaacaatgcatcggattaatgaagtacttaaaaaaatagaacatattaaaattacaaaatgaaaacaaaataatgtcttttgagtggaatccttaccggtatactcaatacagcaccttgcgagttggtcaacactggtagcattcgtcttgcaggtgctggaatagatctcaggatttgaagagatttcattgctgacaattgcaaatatctagagtgctgcacgagtttagcatcctccaacttgtcacagagagcatttgaataattcttattctcttccaaagaatggatcttacaaacttcagcaaggaacaaccaatcggtatcgaacatatgcctaatagcaagacttccatcctgatttaccatacaatactggcaagtatgcttttgactgtcatgcaagcacattccattcacaacaacctccgaggttctccatgtaatcaagaacctgcccataaagtggcatgtttcaccaggccagagatttagaacttctaaataaggaaagcttgttttctccaagtactgttcttgtccatgctcttttgttgtaatgaatttttggtgttcatctgtttgcaaataattgagcttttctaatgtacaatcacctattagcttgagatcctttgccttattcagcacatcagttgaaaatttagagctcggaaaaggtgtgtttgggcagttctgtcgaaattgatcagagtatatgcgtgcttcagtgactatctggttgatctcggatactggtggtggttgctttacataggaacacttataggacatatgaacagaagatgactccatcagatcaacagaacaacagacaagtacttttgtacctttggaccttggaactgcacaaaggtaacaaccagctacactcagggcagcctgcatgagattcaagcagaactgaatgaaccatgaaggatcttattttgctaaagtacagaattacccaatagtactttt

SEQ ID NO: 67936 - DNA, 1185 bp, Oryza sativa
attgtgcctatgtgctacgtaagaattactagttcgctatcgtcatcatcagatggctatgtcgatgaatctaagagagatcaatgacttatttcaagcatagaaaaatatatgtatgtatatgtaagcatctttgatctggaaaggaagtataaaatgtccatattaattttcaattcagactttggaccagacttgggtgaactttgaacaggtccttagggcttgttttcatttcaagttgattgggcttccaatcaacaacagtaatatttaccaaaaaaattacacacaagagaaataaaaacttaaggatgtaagcagtacacatgcacatcaactagaaggaaccttgcaggggatggtacggatgtagtctatgagcaattgagcagatctaccacggagtggcctatgcctttgtgaaacaaactacaatggagaaaaaaatgaatcaatgtcccgtggcaataaggtgtctaagatcttcaaacttcagaatatttttttctcccaaaagacgtacctgtaatacatatgctaaatatcgtgaaagaaaaagatcatcaacgttatgtgggtcaagtttttccaggtcaatgacagcatatccatgctgcagaatgataaatgaattttacgggggaaaagagttagtatataaattttagtaatggcatgatataggagacatcgaattacagaaaaagggtatacctccattattgttaaagacttctttaaaaccatactgcaggcattatctataaatgctcgtgtcaaccggcacgcatagatcagtttgtgaagctctgactgaaaggtacctgtagataagcaaaatttgtcagctgaatgtgcattcgttcatcgctcatcataaggtgatagcgtttgcaaatttacaactgcagacaagctggccagagctgatgtagcttcacacataccaattggagctaggacttgccacaaataacttcggccacgaattggcaacatgtgaaacagtgaaaatgttgtcatttgctacaaattctgtgacctacttccacaagtgaatttaactaaatacaatctcttgagctagatacccatgaattctgggccactgatagtctgacacactttttatttactattaaataaatagaccttgtgtacagaccacacctagacagaaac

SEQ ID NO: 67937 - DNA, 12048 bp, Oryza sativa
ttctgttctaagtttatgaagcactaataaaatgctacaactgttttgttcatttgttgtgtcaatataggtgagaccatgttttggtagtttacataaaagatttgcccatagtagatagatctcaaagcagattcggtgccaggtataacttgtcaatgctatattttaatctcagaattattatgaagagataaagaaatgcttattatgtaaaaggaaaatatggcgtgcggcctagttccgtaataacatataaggaccgattccttggagaatcttatccaagcatcttataatgtgaccatatgaatatttgattcccctggctaggttatataacaataattgtgtgtttgtcttgggacacttgtgcaagggaggaagatagcccttgaattcctagaattggttttgggcccccccttgagtaatagcccaaagtcttgtgtatatgttgactagatgtgtatatatattgggtacattgtggatgggaaaaataggtatagacctagccaacaaaattggagaggctttaggatgttgctgggctttaacgggactagtcatagtcatttttgttgatgagcctatgtgtttatacctcctaggttctccatgtttatcttgggcttgtagggacaaagcaaaaaaatgaagatttttttaaaaaaacttttaaaatttttaattttgaaaataagtcctttcaacacataattcctagatccgaaccttttggccacgccagccgaatttgcatggcaaaaccacaagacaacactgtcacaccggtctggctagcgtggcaacgttatttggtcatactagtctagttggtgtgccattgttttttggtcacattggtctggctggcgtgtcaatgatatttggccatgccacccttgctggcatggtaggacaaaattgtcacgcccattgtgtgtggcgtgtcagtattgttttgccatgccagacggggtggcatggccaaaaggttcaagttctagtaataaattttggaagggtctatttttaaaatttaaaagtaaaaaagtttaaaacataaaaaaaatcaaaatggcatgtccggtataacaataaagatgaaaccagcagatctaacatggaaagtgtatgttccaaacttgtcaactaattgtatatatataaccgatttccatgttagaggtatatcatatatttgttacatatatgcatatagaatggtggtcagtgtgtaaaatatggcatgccccactcctaggaaacactatttcacgcatatattacctattgttgtactagaaggttatcctcaaaccggtacagcaccaaacaaataaggaataccagcctgttagcggcaaaatttagtaactactgttagtcaagatcgggtcaatggagtgactaatgatgtaattatatttgattcagttggaaagtgtatcaagtttagagttattttattttagcctccgtattaggaaacgtttctttttagcttcattttctatagatggagtcttgagccaatcaaattttgtttgaatcggacttgtttatttttctgtaaggtagccgatcaagttatgtccgagtaggacttcttctagctggaactaaaaataacaatgccacactagctagaccagcatgaccaaataacgctgccgcgctagccagactgttgtgacagtgttattttgcggttttgctaaggcaatttggctggcgtggccaaaaggttcggttcttggaattacgtgttgaaagggtttattttcataattgaaaattttaaaagtttaaaaaataaaaaaatctgcctttttttctctttatccctacaagcccaaaatgaacatggaggacctaggaggtataaacacataggctcatcgagacaaacgactacgattagtcccgttaaagcccagcaacatcctaaagcctctccaattttgttgcctaggtctatacctattttccccatccacaatgtacccaatatatatacacatctagtcaatatatatgcaagacttcgggtactcaagggggcccctaaaaaaattctaggtattcaagggctatcgtcttccttccttacacaagtgtcccagacaaacacacaactattgtcatataacttagccaggggaatcaaatattcatatggtcacattataagatgcttggataagattctccaaggaatcggtccttatatgttattacgtaactaggccacatgccatattttccttttttttaggggaaacacgccatattttccttttagataataagcatttctttttctgtttataataattccgagattaaaatatagcattaacaagttatactttgcatcaaatcttctttgagatgtatctggtatgggcaaatctttttggggcatttgcaaatttgccaccggtttttttaattttgcaaggatgccactcgaatgatagttctagtggtatttttgcaattttctagtgacagtctcgtaataacgattcaaaggagtggtaaatttggaattgccccaatctttttatgtaaactgccataacacggtctcatctatattgatagaacaaatgaatcgaggaaaattttgctataggacatcgcgactttacggttttagctgtaggacactgcacgaagtgagttttgggggaaagcactctgtaaatgtggaaattagctcgtggagaccgcgcgcattggaatattcatttttagttggataggagggagaaattgcatgaaagtactaaaatacccctgagcccacaagtcagctctttcatctctctatttgtatctctctagcactgaagggcgtcgatagtgtagagcggcatccctcctcctcccgacgcgactcctggtgagagatcgctcctgcggccgcctcgagggagtgagctagataggggtcccgatctcgtcggccgcatcggtggtggtggggtggggtccatccatggcgctggcctggatctaggcgggttgaccacggatcccgtcgagctttctccctggtagggcggcgatagtgtcttcgtcgtcggatgggtcgtcttctaaatcgtttctcatcagtgttgggaatgtcgctttggggttgtcgaattggggactgcggatcatgcatttggttcaagtgtttatgagtccacagttgattgcttagtagcggcagcccatgcaggtaatgtgattttgagtttcatggaccaggtggtcaaggtgctctgcctcctcccatccttgtgcaggcggcagacctcccggtagtacaacatgctagttgagacgcttctgtgtgagagagatagacagagagagatgcaagacttggcatttgggaccaggggtattttaatattttcatgtggtttctctcaccaattcaattaaagatgaatattcgaataggcgcgttgtccacgagctaatttccatctttacgtagtgtcttttcccaaaagtcacttcgcgtagtgtcctacagctaaaatcgcgaagtcacgatgtcctgtagcaaaaattgcatgaataaaacagttgtagcattttattagtgcttcataaacttagaacagaaccgccacaaagtttcacatacttgtggcattttatttttttttgatacacctatactatttcattagtacatcactctgaggcctcgttctccgactcatttgagaagcctaggtaggtctgttgttgatatctaggagtgaaggcaccgagctcttctcccctattattcttaaggcttcgtgcttgctccctcgatatgcggtaagcattagcgatcacatccactggcatggcacggaatattgagttcttccctgcaaggtggctcaccatggagtttgcattggtcttgaatgaaatgtattggcatccttcatgctctgctttcttcaagacaacgtagtgttgcggaatgatcagcaattgacctggacgtagaacgccattgaataccgtctttccaaggttactaacgacctgaactcgagcatgcccttgaacgatatacaccaggctatgggcattaacgttccaaaacggagagagaatagcattctgtagagagtagagaacaatattatatataaatggtggcacagataaaactatttttatagaaatataggggggagagagatggagagtgaacaaaactccactttgataaatacctggtatagatttactctagtagcactcaattgtacaaggttaagaatggggaacttctgactgttgagacgtgtgatccttccagcacgtgggttgtaagtatcagcatggctaggattttcgatgttcaaccttgccttgattgtgcagaagttctcatctaaaccgttgcaacgcgtagatggttgttgttcttcactgtactgaacttggtattgagcttgtgcttgttcctgctgttgtgcttgttcctgttgttgtgcaaaagcaggtctcaacagtttaaggccattctttacccgtatgatctctcctctttggtcgttttggccttgtagcctctttgctaccaatgcattgacgcctaaggcctcacttagtagctcattgttgaaaccgctaaatatgttttgcccagagtgttgctcgattgagcgaccatacatttgttgctccctgttgttgttacccgccaataagaactcctaaaatttttatcagtgggaatcaatgataaagttttgccacatgaactgcaacatattcatatatatgacaatgagaaacaaaaatggtgaagaaatttagttaccttctgccttggttcaagctgattagcgttgttgtttaagtcgaagacatatagagcaacaactggtgcatcgccttcattgtagaaccaatgcgcaacaccagctggcagtgcaacgatatctccttgtctaaattggtggatcttttggtgctcatccctaaatttttggctctggctttggccttcaggcaagaattgttggaattgttgttggtaggttgctgggcagccggggaaagttaatcccatagaacctctccctgaaagttagaaatgtccatgtcaggtggatataacctaaaacgacattattgtaacatggagaatcataatttgtacccatatgaacaatgtattccgctatacaaaccttggatgatgtagaccatgccaggagtattgctgtatcgaggtaccagaaggccttgaggctcaatgacacgtcggatgacaaatgtacctgtgcactggaattgttcattcttctcatcaaagtactctgtaaccccggcttctgacctcactctccgaagtggttcaaatgcttgtagtctatcaaatctacactccctaaaacctccttgccgagggttgtgccatggatttacgttcggaccaaatagctgggccatagagccatggcataggagaagaacacaaaagtagatagataaccgagagaaagctatggtcgccatagctatttgaggatgttattggaaacttgggctggttgatgtgagttcaatgacagggaagccaacttatatagtgaagaaaagaatcttcagatatgacgtagggatagagtttgttgacatgtatagataatatctagcctataatgcgaaaagtataatagaaaaaaggtagctttgcaatgttgagatatacacactatgactcatggatgacatgtcttgcgctttaggggtaatacaaacaatgcttgttggtaaatgtatatccaaagccttaagatgttcctttgccttatggataaatttccttttgtgcaataaagtttctctagtatgttatcattttgtgcggtatgtcatagatgataagttaggcgctccttaaatttgttggtttgttgtcagttttgcgtggcacactatgcttgataagttagcggaacttttaaaataagaaacttgtaagcttgttgtcattttctttgacatactatcctctcccatatgtaaagtaaacaaattgatgaaatatatggaggttagatgattttgcatatccaactagtacttccaagtttataccaaaaaatagaaaatgttggatttaatttttaaaaaagtagaagcaatggacttatgtatcttttcttttttttatcattatattttctggcgtgcatttattaggcagtttattactgtgacataaatttatttaactcgccggtaataaaatatgccatatgtttgttagtcctcactgtcgaccatatcatacaagacattaatcaaatcgtcttgtctaaaatgaccacaatgtccctgcgtggtgtggactatgatttcttttcattcatggttagaactactgccggtccatgaaaggttaaactataaaatgccatctgaaaaaaaaaaggtaaacagacaagtactcgccctcgcaattaaattgttcaataataatagaaatggaaggatttgtcgtgtgtgtgtacatatatacaagaaaatatcaggaaagcatgtatgttattttacacaccgaaagaataaacgcacaacgaaacttatatacaatcatatgtttgctaggcaaccagagatgttactcccaaaagaaacgctccggtatcaattcaggcttctcctctcacttgaactgcagcttgcttgcaaatgtctggccaaacttccatcctggtggcacgacgttggtgaagacgagcgtttggtcatctgtgttggtgaccctaaaggatagaccttgaccggtgaggtaggccagtgagtgccattgggcgccccagttacgtgccatcggcatccaatccgctgtgttggaacccataacctccatggacttgattgaccctgccgccgcgacgttggtcaccagtactagctggaagtagtcgtgaccgttaatggtgaaccgcaggccacccttcttcacgcaaggaaccctgtagaaatcatcgcaagagtaggatattttcatatggaagcagcggtcaggatatgcactgttctctccataatgtccaaaataattggagtatttgtattggtacctttgatagatgaccggtatgatgcctgcgctgtagacgccgatcttctcccaggccggctgtgccatgtcaaagtgcggccgtggtgggttgcaccagccaccattatcactgggaaggttccagttgggcgggcagaaattggtggcggtgatggtaacggtgacgccgggcttgcaccactgcggcgccctcttgcggtcgcaggcgatcttgtagcactgcccgcacgacgcgccgtcgttgaacagcgccgtgctcagcgccgcgttccgcgtgccgtacccctgcgagtacaggttgccgtatccgcacgccccgcccatggtgcccgacgcgtccgcgccgccgtagaacgtcgcgtgcgccttctgccactgggtcggcgcagccaccgggtttgtgggcgtcgtcgtcgctgtgttggccgcggccgtcgatgcactggcgactgcgagcagcaccaacacgaacgctcgagctggggccatgtctgtcgtcatgatcggataactctgtaactaggcccttgagacttgatgaccgagttaattatctggagctatctatctctgaaagcaacactgctctgttgctttgtgttgatcttctatgtgatgtctgtttgcttggtgatctcctgatgattggatgggtatatatagccatcgctcggtcattgttggattgctgcattagtggctaatgaaatcccaataatgaagtagtgtgaactctggaaagccacgggacgaagctagcgcgcggcgacgcgcatgtgcatgcatcgccggccggcgcagccgcagtactactataacttgctcgccaattaatccgaaaaattttcggtttttccctgattggcgcagaatgacgcaaaacacaagcgcggcgacgtccaggctcccgcaatcgcaagcaagcgcatgaaggcaacgttcaacggcggcgccatgaagaatggggtggcgtgtgttgtgtgtggccggcgatcgagtgaggcatctctgaagtctgaactgaagcatctcgagtgttttggactcgtttcttttcctggtgacgttatgaggtgtttttttttccggggagacgttttgatgaggtgttgatcagaattcatcaccttgttagaatgtcaacaagaacaattgacggaagaaacaaataatcgttttaaaagttgacaaaatcatcgagggaaaaaacgttttcaattagacaaaacaattgacgaaattccgttgtcaagtaaacaaaacaatccacggaaaagacaatctatctatgatatactgaaaatctattaaaattcctacaaacacactaaaaccgtcacgtgtattcctagtttcgtacaaatacttctaaactgtcacatgacactttaacaaaccagtggacctgatatttttatctattagaatttttttttaaaaaaaaccaaaacaagtagtcacgtatttgatggggcccacccttccaccgggcgtactcacgtacgtgcttcctccctccccctcctatccaatctccttttttaaattattaacatttttgaacattaacaaatcttagataaccacaattttcctatagttatttgtgttctttaacaattaaaaaaattaaaaaaattaaggtgttctttaacctataagaaatatttaatttttatcatatccaaaactttacatatcactttaaactgttatgtaaaatagggaaaatttgataatgctgattatatgatcaattcgccaaatatgcataaataaattaagttagatctattatctctattattaaaaaattgaatatgtttttgccggtactttggtacgttatccgtgcacgagtcggtttttaagtttgttctttttggaaatacggatccatatttgagtcggtttttaagttcgtttacttttgtaaatatagaacaaatcgtataataaatctctttaaaaaaactcacgtgctaactcgaactcctaattacaactcaatatatagggcttttcttacgtatcacttctatgtccacttttcttatgtatcaactagttgggtggcccgcgcaattgcgcggctagcacctaaaaaaaatcatatatttttcagtatgattttacttaaaatttattaaatagctattacgttgtcttaagactttgaaaagccaaatcttatcatccctgtatttctaattatatagttttttaaaagtcacaccagctactaccccttacttctgtcatatttcttttatttgcttgcttgatctaccactatttctattcattctccttaaaacctttaaaaatcagatcttatagtttttataatttctagaagtcccatcaaacgctgtcattatactcctctacaggtcatcaactgtcttttctctatattgtcattgggattttacaaatcgaacataattatcgttcgggttcattttttactttctaaagtcccgctaaaccgtcagcggctttgccattgttttcctttatggcacgcccgctgcctcacttctttatcgtcattgagattttaaaatcgaatatgattatcattatgttttttttacttttagaagttccaaacctttaaaaattagacctcgtagtttttagagtttatagtcttgttggtttcattttttataatttttagaagtcccgttaaacgatgtcactatactcctctatggcccatctgccgcctactctctattgtcattgggattctaaaaatcgaacataactatcgttagaatttattttttattttctagaagtcccgccaaccgtcggtggctctcctatatatcccgcccgctgcttctcctttttattatcattgagattttaaaaatcgaatatgattagcattggtttttttttttactttctagaagtcccggcaaccgccttgatcgattgcttcacggcctacccgtcgtccttcatttcaatcgttattaggattctatttggtgttttattaacagttattgcatgtcgtatcaaccaccaccactctactcctttataggcgtgttacttaattaatctcgtcatgtgttttagatggtattttctttcaatagtcttgattttttatcaccaattttagttatttataaatggtattcctagtatttttctttttttaatttcagaatttattttatttttcgtattgtgttcttttgatatttttattttttattttcaattttagttgcttccaaattgtattcctactttaactctctttttaattcgcctaatttcggattttattttattttttatctcgaattttaattaatctactattaggttgttttatgtactcttatttgcagcgctgcttatatttaatttcgaatttaagttaattttaaattgcattccgaactcttcttttgtttttttctaattttgattttttttaattttttattccgaattttaattaatcttgtattggattcttatatatactcttattttaatatttcttatttttaattccgaatttcagttatttttaaattgtattcctactcaaactccccttttttctttttataatttctaaatttattttttattcctaattttaattaatcacgtattgggttcttatatggactcctctttcaatattgcatatttttaattccgaatttcagctatttttgattttatttctatttggactcttctttttttttctccgattaatgtgggaatttctagcctctacagcaaacgtggttatgtatttttggcttggttatatatttattggcatgaaaatactgatacaattcggaaacggcagagtttgattaggattgttttgtctttcaatgtttctaaaagtggtgttaacacgcgtattcccaaaatattgtccgtttccaatatgattatgtttttcttttcttttgttttttttttgtttttgaccgattgtacattacgtttccagtagattaggttttcccttttttgtttgtttgtttcttttttttgacagattgtccgattccgtttccagtagtatgattaggttttccttttcttttttgtttttgactgattgtccgattcgagtttcttcatacgccttatttctttctttcttcagtttttaactaatcctaatctagttctattttttttcttattttttagattaatgtgagaatttctaggccatgagagcgaacgtagaggcttctttttctattattttaaagatataactagcatggtggcccgcgcagattgtgcggctagcatcattatattttctctcatattatatcatatatgttttctcattatattattcaaatatattaaaatgacaacataattttaaattttgcaataactttacaaaactactaatgtgtaatattcatattgtattttatatacgtgttagttattaattatttttaatatcaaatcctatatggactctagtctcgtcttttaatatattttttagttccgaattttctgtaaattgtatttctatatagactctatactcttgtttcaatattattctatttatttttatttctaaattttaattatttctaattgtatttctatgtggactctaaactcatctttcaatattctttaatttttaatttcgaatttcagttatctctaaattgtattcctatattgactttaaactcttcttcccatgtttttctaaatttcgaattttagttatttgtaaattgtatttttatacggactctaaactctacttttaattttattatgtttattccaaattttagttagttttaaattcctatagggactctatactctacttcaaatattgcttattttttaattccaaatttcta

SEQ ID NO: 67938 - DNA, 12256 bp, Oryza sativa
acatcatagcatgtcgatattaatttatcaaattgcggagaaatattaataactttgtctcttataggaatatgtccccagcttgttgcttaactaaatgtcaatccaaataataatcatatattttgttgaaaaataattaacaatatagatcaatatctagtatcacttcacaaactttcaaacaaacaaattgaactctaaatagtacgtacgtactagtagttatttttcaaggtatatggtaatgtcaagaagtaaattagtaatgagcactctaatattttacccctcggccatatagctaaagctatttttttcttagctacaaaattaggttttcccttactttgcatacactatgagcttccttgatgcttttattgggatcgatttacatggacaccctatagtttttttttcaccacttttctttttttttcaccatatagtttttttaagtttatatacctaaagtttatacttatagggtttacacatcttttataggtcaaaagtttatataccgattcaaatttgaatttaaatttaaatacatttaaagatgaacttgaatctgatatataaacttttgacttacaaattttaggtcaacaaactttaagtatgtaaactttagatgtgtaaacttaataggtataaacttcgggggtataaacttagtaaaacagaaaagtaaagtggtgccaaaaaaaaaataccgcgtagggcagaggaaccgatcgccccaagcaatcaatcgtgccataggagtttcgcaccctatcctcacgggcttcaagtctagcctgatgaaggcattagatgggcgtcatcgccagcccatctatgtaggcttgaaatattagctcatacatgcatgtttgtgggctgtaattcgttggaccagatgaagcctattcaaacttagccccaattggtagtttcccaccataggtcagcccagatgttcaattctttttggtagagcttaaaattgtgagaattaacagatttgttctcagttcatgagaatatgaaaaagttagttttccaaatttttgttatagttcattttctgaattatatatctactacaaattcttataatgtgaatgacaatctaaattgtttagggagagttaaagattctgagagaagttgcagctgctaaaagcttttcccaaatagacacctagggcctgtttgggggagcttccagctgctgcagcttttcccagaatcagaaactcccccccaaacagtatagcttttggtacagattctgagaagctatagttgcatggtagagctccaacttctaaatttaactccagtagttgggtctgaagtggagttgtggagctgactaaacacagctccacatctctagttcattttatgagagcgctccacccagcttcgctgctattaggtggagctgaaactgtttggctgagctccagttttaggagaggtggagctggtgatggaactatgccaaataggcccagaattcagaaaatgaacaagaaattagaagctgggaaaccaacttttacagatcctcaaaagttgtctactaaccagctgcttctaagaatcaattcttaattagtttcccctggacaggccactaggactgttccaccacagcaccacccagtctctgattgtatggtcgtcctttcaaattacatgcagacaatggaattaattttctcatttattttcttcttttattcgaacgacaacgtacatatatatataataagatccccgtaattattatttcgcacatttatatcatactccatacatagttaaagtaaatactgtattaataacttattaagcagagagagtgaggccacgctcgaaggggcgctctccctggaagttgccggcggggttgtagttgcaggtgatgaagacgccgccgttgtcgcagtccacgcgggcgcagccgatcgccgtcgtgcggctccacatcacctgcgtgtagtggaggcacgagtcccacgaccccaggcagctgttgctgtcgtagtcgtacagatccttctcccccacccagctgttgacggcgtccgctgccgtccactcgctgccggagcctccgaagaggttctcgccgtagccggccttctcccagctgccggagtggatgagcgcgcagtcgccggcgcgctccgccgcgtagttctccgcgtacgccgccacggcgtcgtcccagaccacctcgccgacgccctccacgcgtcgcgccgcgttgtggaggtccacgaagtcctgcggcgagttctgcgccaccgccggcgtggtcgccatggccagaacgacggcaatggctgccgcaagtgctactcccgatatctttggtgtctccatatgcaacactactacacaatttgctctcttaatcgattccgattgtgtgtgtgttcgttgaatgctgatgcgatattactcgcgatcgatcaaggtatatatttatagccagatgagctcccaagatgtcagcaaaataaatcgattattaatcctacaatttgcatggcaacttggcaagtagccatgatgcttggctctgctcggcgagagcggattaattaggataaaataaaactctcctggcctcactctcatttctttttattaattgattaattgttaatgattttgtgtttggtacatgcatgaatgcatgcgacgtgttctttttcttttctcctattttttttgggggttgccgtcgttgaatcgtagtcattggaggacgcagcacgttgctcatgtgctcgacggctaaggcgattatatcgatccgacgaggcatgtcttatctttgattggtggactagttccttaattgattgatcaactgatcagtttggcatataggctgtattattagtattttatatacatacaatattatttggtgcaacttgttgtgaagatatatataatttcagtgtttcaacaactaaattttaaatatttaatcagttgtaaatgatgatttttatgccatcagaaaacccaaccttaatttagtttatggaacaaaccacaatggttactgaataacatttctacatttagaaacaaagtccacctaagcattcgtgatcggatcaagggatccatccaaatcatgtggggtatgggtcaatatttggtgggaaatttctccatctccatgctgtctgaaagaattctataaggccaagtagccaactttaaataattcatgcataccagcaggtgcagagtttttcgattcctagtgggtgtgggtcaccctaggaaagaaaaacgaaagatcaatattcaagaacggaagagatatgtcagcaaattaagcacatcctcgttgcgtgtttgctaagccttcattattccaaacaaccactaggatcaatataataagagtaaattgcatattggaccacctttcctcagtatttttttataatatatattaaacctagcctttacttcaatcacagctacaacctcttattatatggttcttgacacaaagtccaaatagaatagaatgaaattttagtacggcctaccatccgcagaccgatggtcagacagaaagggtaaaccaaatcctagaagacatgctacgtgcgtgtgccctggatttcgaaggcacttgggatcgttgtttgccgtatgctgagttctcatacaacaacagctatcaggccagcattcagatgtcgccgaacgaggcaatgttcggaagaaagtgccgcactcccttatgctggaatgaggtgggcgaagcgctgatattcggtcctgacatactcaagtcagcagaagaacaagttaagctgatacgagaacgtttgaagacagcacagaaccgtcagaagaattacgctgacaatcgaaggcatgaccttgagttcgaaaaaggagatcatgtatacctgcgggtatcacccctccgtggtatgaggaggtttgggatgtccggcaagttagcaccccgctacatcggcccctacctcataaccgccagacgtggcgaagtggcttatcagcttgagttacctgaaggtctcgcagatgtgcacaacgtgttccacgtatcccagctaaagaaatgtcttcgagttccagaagagcaagtccccctgggtaatatcgagctggaaaagaatctgacgtacaaggaaagaccgatcaaggttcttgaagaggcaaaacgtcagactcgaaggaagaccatcaagttctacaaggtccaatggagcaatcattctgaagatgaggcaacctgggagcgagaagatcttctccgcgccgagttcccggagctgctcccttaggtgctgaatctcggggtcgagattcttgttaggggagttggtctgtagcgcccgttccgtcgtggcgcctagcgggaaaattatctcctaaaaaccctaattgcgaaagttgtttctttgattgttgtctagtgcccgtgccatctcatgatctcaatccccgctctatcgtcgagttcaattccgaatccaatccctccaaatcaaattcctccgtaaaagtccattttgcctcccccagggtcgatgggccgattttccctcggcccatcttcccctctcccccggcccatcttcccctctcccccggcccatctccatctctcccccggccccctctctcccgggcgctctctctctctctctctcctttcctccgctccgcccgcgcgccgcgcgcgcgtgcgcgagggtcgtgccgagcgcccctccccctccgctctgcctgcgcgcgtgagccgcccgcgccgagccgagtcttccctctctgctccctcgctgccgcttcccgcgcgccgtgttcacgtgcgcgcgcccgcgtggtttcccgcccgagccgcgtcgtctgcgccgtccgcgtcgcccggtcccgctgcccagccgcgccgcccgttgcttcccgcgcgcgcgtgccgagtggccgaccgcctggtcgccgccgccgtcaccctctgccgcgccagcccgcgcctgtcgcccgtgtcgtcgcgccgctccaaaccatcccaccgtcatcgccgtcgtcaccgcccggcccccgccactccgcgcgcaagccgccaaggaaaggaggccgcgcccctcctctctctgccgcgtcgcccccgctcccctccccctttttcccgaatcggcaaaggggcaagccccctttctccccctccttttcctcttttcctcctctttttcccctctcgccggcgtcacctcctgtcgccgctttggacgctagccggagcgccagctcgccggcttgaccgcccatgtcggttcccctctctcaaaccgacattgccgcccatttaaacccgtcttccccctcccttcctttcctctcccattcgcctcctcaccgttgccgccgctcccgtgctctgcctcgcctccgccgtccatcgccaagcgccgggagagccggtgcgttcgtggacgcggaaggggactccgggcgcgccctcttcttcctcttcctcggtccgaggccggagagatcactcccgcgccgtcggcctctcgtcactgcgccccgtcccgcacggtagtgtctctctccgttcttcctcctcgctccatctccttcccctagctttcggtagtagcttgagtagactccccgtagttagccggtgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcctctcgtgacctcgttgccgttttcctcctctcccgccgccggttgccgccgccgcaatccgccgccgtcgagcaacctccggcgaatccgagccgttggctcgtctcccctcgtcccgtgcaaccgcccggtgtgctcgcttttgcctgtatcaccgtggttcgctccgccgctcgccgccgccacccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcagaccgcgcgcatgcaccgcgtcccttccccgcccgcgcgtgtgcgtcgcgtgctctctccgcacggtgagccgagccgctgacaagcgggtcccacccgggaccgcgcgtggtaagcccggtccaccggctctctctctcctccctcccgcgcgcgtgcgagtttgggccgccttgggccggccggcccatttagctcggccggaccgctccatttctcttgggccgcgccctagccgtccgagaaaagtctatattccctccctcccttcttttctttttcttttccaaaaaggatttaattaaatccttttcctttagatcaaaaattcaataatcttagaaattcaatatcttcccaaccgtaaatccgtttgactccgttcaacttccaaaattccgcaaatctcgagatctatctaatggcccgcttagaggtcattaatagggcttaattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatttaattatgttgcttgcaaaatattatgcattgataggatcacacttaatctgtttgtcccgtctgcaaggcagattggcggacctacctaatttgtcgcatttgatccttcctttgttaattgctataccatgtccccttgtaaccacccagttgcgcctcgatactcgtgcactctgtgcaagtatcgacggtcgccctcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaaatttcatccgaacataagacaagtacgaccacatgggtggaatgggacgcccctggctgagtaaattgctaatcgggggagccttgatgccgagagacatgtggattcgccggggtggtgtcggagaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggatgatccgggttagtaatgtcatgtgggtaaagtgtaccccctctgcagaggtcattaaactgttcgaacacccgtgcccacggtcatgggcggatgtgaggtgattcctagcgtagttttgtttgactactgcttgtgaaattgctgttgtgaaaaggggttcgatgtttgaaaaatctgcagctgatgggatcagctagcccgggtggccgtttgaaaagttgttggcccgggtggccgtttgaaaagctgttggccgggtgccaaccgtgttgcaatcctaaagattgatacattgcacatactccgaccggacgagacgcattgtctcatccgtgtcgtttgagaagcacttagttgttttcagaaaagagttcaaataaaatcaattgcaaaaacagcagccttcccttgaagcctgcattaaacacttatttcccctggcttgctgagtactcccgtactcacccttgctctatataaataatctccccccagttgctgaagaagatgaagtggatcctgctgacgaggagttcttccaggagcaagtcggctacgatgagttttagggtttcggcctagttcccaagtcgtgcctgtgttgattggtccaagtcctggcttccgttttccttttgtaatgcagttgtgagctcgggatctgtccgcagcccaacatgactatacctctactctataataaagagacctctgttgctgtgatattctgtctccctatgataccagcactgttttctgggactggtatcgattaacaggttaaattggagcgtcacgggctagttccggtcgggactagttcggggcgtgacatccggttcttacaaagattctgtgtcaactactccgatgggatgggtactaaaaggtgctggatattcaataaaaactagcacctatttgaggaaaaaggtgccggtcttttgaaatttggcatgtggacggacgcgtgggtgggcacgtgagtaggaaagacgctatagctaggtgtcgattttaccacttccggtggcctttagcgccgacatctatttaatgttttgtagtagtgttcatcgaaaagaatccttctgttgaggtatctttcccttttcgtggtgtcctagatttgttggagcagggattggtcgcatggtttgtggtgattaatttgttcttttctaggtgctgtctgcgtaatgtactctctgctgatttttttttctctttcggtttggtttgttcttcgtgttgttgtttgcagcaagaatcggcggttgcacacactggtggagaaaccgtttggagtcccgattagtaaccccgtctccttgcaagaagtcggggtttctgatcctcgccccgaacatctctctactgttggagctcatttccatgtaccgttcatggaatttgtacatctgtgtcggtagggactccagctgttcaggtttgacaagcggtttaccgagttcaaacttgtatgccacttccgccttcgggattggtgcgcctccaaccaactgatccacagatagactagtgtctgcaatgaaatccgttatgccaaaatcttcgccggtcaccaacggctcgacctcttggtttggttgttctccaagctgagggactggtttggacttcttgtgataggctctctgaagtgttcggtcatagtccgatatctgtaacgcctccttgtttgttttggacattcccttgaagaagttcttcacgctcgggtcaataggtatcttcttttcagtactccgaggcttgagttgcctcttcacctccctgccgcataagcatcaagctcctcttgactgcaatcgtatggtggctccttgtttttggtggcgtcgactttcgccttcttcgttgcccttgtgcgggcaggcggtggagcttggcaagaccttgtcttgggaggtgcaggcggacacggtggaggcggaggagccggaggagatggtgcagcaggaggtggcggaggagccggaggagatggtgcaggaggacgtggcggaggaaccggaggagatggtgcaggaggagatggcggagccggaggagatggtgcacaagacgccgcttgtcgcccaggaaggatgatgtaccgcttgcgccatagtatgatggcgtggcttgtgtctcgtagatgcgtctcaccgtcccctcctgggtagtccaactcgaggtcctcgtacgcggcttccaccagctcaacttcgaccctcgagtatcctgctggaatcggcctgcagtggtaagtcccggaagggtccgttgggatggccattcccgacgccaccttcacgtgatgagaggttatctattagtaatcaacctaagcagcaacttgcggaatgtacaagtcaaaaatcatcaaactacgagcataccttgattgataagttcttgaagggaatatgcaactcacatggtgtccgctgcgtgatctcatcaacagggcaggtggttgcgtcctaggtttgcacggcgtccatgctctgtgatccgacctgccccgttgaggcgcagctgctacgattgcctgatgtgctgaccattacaggatgaatgtacggctggggatcctgggaccgatgtgcggccatacgttcatccaccttccttgccacctcctcttgcatgctgagctcgtagctcaataccctgtactcaagatctgcaatcttcgcctcggtatctctcttgctcctcatccgactcctgtacgtgtggatgtcctccttaaatccaatcttctagggaatcacgcctttccctcgtgtttgtcctggatgctcgggagtctgtagggcgagtgacagctcatccttctctctgtcgggtcggaatgtgccctgagaagaggccaccactgcgtccgttagtcgactggcagcctcgcatatctgatcgctgaagacaagggagccatcaactgggttaagcgttccaccgtgagcatagtaccagaacttcgatcgatccggccatttagcggtggccggttcgatacccccctcaagcaagctagcctccatctcctcccacttcggcttcgcgacgctatatccgcctgaccccaagtggtgatggtacttcttcttggcggcattttccttgtttctggccatcatctcttgcccttgttgccctgtcttgtaagcaacgaactcgtcccaatgatcccttagctttgggaatacgtcgaagttcggtgttagtcccttcaggatgtatttcttgtagagatctcccttgaagctctagaactgttctgccattttcttcagagtccactatttcactaagttatccgtacccgcgggtagcgtgaacgtctcgagcaatgtggtccacaacatctctttctctgagtccgggacaaagctgtcatcatccccgcgtgcccttgttctgcgccagtacaccgtgctgacaggcacgttgtccctcacaacccaaccgctgtggcgtacaaaattcctggctgcttctgccggggcactaggtcggccgtcttcgtccacctcagttatgatgtgccgaccctctatcttcttcgcggcacctcgttgtccgcgtgccctcttctgtccagcagagggttgacttccattagcctcctccgcatcgttcccctctgcatccctctccacgttaccctcctcgttccaatactggctgcttccctctgcgattgtttcgtatagtatctgttcctcatcgcgatcagccatctgtgcatacaaaaaatatttgttaggtatataggatgtatttgctaaccgtaatattgaaactctgctaattttatattaaatctctaataatcttatattaaatggctactaatctcatattaaaattgtaataatcatttatatatgctaagtctaacaatcttatattaaatctctaacaatcttatatttaatctctaataatcttatattaaaattgtaagtcatatatatatatatatgctaagtctaataatcttatattaaattgctactaatctcatattaaaattgtaataatcatttatatatgctaagtctaacaatcttatattaaatctctaacaatcttatatttaatctctaataatcttatatttgaattgtaatagtcatatatgctaagtataacaatctcatattaaatcgctactaatcttaattatattaaatcgataacaatcttatattaaaagtgtaataatcatgtatgctaagtgtaacaatcttatattaaatatctaacaatcacttaattacatcacttgcctgcgcgaattccttcgatggctagctaccacttcggcttgagggacgacgccgacgtcttctctgcaacattaccaggaaaatgtattagtctaaacgtcttctctgcaacattaccagtaaatcgtattagtagaaacgcgttcgttctcacacatttagtacaagtgcattcatgttcgtaagcgtttcgtgcacgttcgttcgcgttttgtaatcgtattgttcacgttcgttcgcgttcgttaacgtttcgttacgttcgtccgcgttcgttaacgtttcgtgcacgttcgttcgcgttcgttaacgtttcgttcacgttcgttaacgtttcgttcacgttcgttcgcgttcgttaacgtttcgttacgtttgttcgcgttcgttaacgtttcgtccacgttcgttcagcgcccgttcaaaggtcgtccacgtatcgttcacgt

SEQ ID NO: 67939 - DNA, 9089 bp, Oryza sativa
ggccgcgtcgatcgaagtcggtcgtcggccggccgtggagatcgatcagagagagagatcgagatcgagatcaagagagagagagaggcagcggcggctctcacccaagagatgcggcggcggcgtctgcggcggaggcggcgaggaccaccaagcgacggcgagaaacgacggcggtgtcggcgcggggttgccctaggcacggtggcggcgaaggagaggccgatcaagatcgaaaaacggctaagtgttggtggagaagacgagggcgcaccgggaatatatatacccccggatctttagtcccggttgttctcaggaaccgggactaaagatcttttcccgctatttccaaattctttttaaacccggttagggttaggaaccgggaataaagataatagcagttgtgtcttcaatttcattgcatatgtgtttctaaaatagtaaataatgcattacaattatttaaagtcgaacaattaatgataaaaccttcgaaaaattattgttgtacgtagtagaatacgtggataatatataataagcacatgaatgatttaaaattgttaaaaattctaattaacataatagcacatgcatgatttaaaattaatacaaaatctaatatcatatataactagcatatcatgatattaaattgataaaaattctaattaacatatgtaaataccacatgcatgatttaaaacctttagaaattctaataatcatatatatgtagcatatggatgattttaatttgattaaaattctaataatcatacataattaacaaaaaatctaataatcatatataactagcatatggatgatttcaatttgataaaaattctaataatcatacgtattttacatatgccatacaacaattgattagtatagatattcggtacatccaacatagtttacatcgtgtacagaacaattacggcaatacatcggcggtgacggttgaccggacgtactttctcctcactattgttcattccttgtgatcgctacgtgagtaaggggtgtcttcatttgataggaggatgctagggtcaattgtcatcgtgaaaggggttgcccatcaaactgatcgtaatcctcgtcagtcttgtcctctaatccgacgatttttctttttcctgggagaaccacgtggcgcttcggctcgtcagtcactttgccctttttttctttgctagacatgtccttgacgtaaaaaacttgggttacatcattggcaaggacaaaaggttcgtccgagtatccaaccttgttaaggtcaaccgttgtcatcccactgtcatcaatcgttacgcctccaccagtcaacctaacccattggcaccggaacaaagggaccttgagaggtccatagtcaagttcccatatgtcctcgatggcaccgtaatacgtgccagttgtaccatcgtgtcccatggcatcgatacgaacagcactgttctggttcgtgctcttcatgtcttgggccctcgtgtagaatgtgtacccattgatttcatatacctggaatgtcgcgatcgagccagatggtcccctcgccaggaaggccagttgttggttaatcgtctcattacccatgagatgttgtcgcagccatgtggagaaagtatcaatgtgatgccttgtaatccatgcatcggacttaccgatgtttttggtgcaaactagagccaagtgctcctcgatgtagagagccaccaatgaagattgttgcagaaccgtgaaatgggctttacggaataaattgttgtctaacgtcattattgctttctttccgagagtcccctttccccgtagtctcccttcatggcgtgattcaggtatcccgattgggcgaaggtcttcgataaattctacgcagaattcgatgacctcctctgttccataccccttggcgatgcttgcctctggacgagcacggttacgaacatacttcttcagaacgcccatgtacctctcgaaaggaaacatgttgtgtaggtacacaggaccgagaataccgatctctttgacaaggtgacaaagcagatgcgtcattatattgaaaaatgaaggtggaaatatcaactcaaagctgacaagacattgcaccacatcattttgcagggcttctaatctatgaggatcgatgaccttctgcgaaattgcgttcatgaaagcacatagctttgttattattgcccggacattgtctgggaggataccccttattacaactggtagcagctgtgtcatcaacacgtgacagtcatgagactttaggtttgtgaacttcttctccttcgtgcttattattcgctttatattcgtggagtatccagacggtaccttgatgctctccaagcattcaaacgtactttccttctctgccttgctaagagtgtagctggctagactcaagtaatggcttcctttctcctttggttctgggtgaaggtcaccgcgttgttccatatgctttagatcattacgtgcttccagtgtatctttcgactttccatatacacctaggaagccaagaaggtttacgcaaagattgttagtgaggtgcatcacgtcgattgcgtggcggacgtccaagaattcccaataggataactcccaaaatatagagttctttttccacatcgccgcgtgaccatcttcgctctctataggctggctgccacgcccctttccaaacactactttaagatctttaaccatagcaaacactgtttttccgctgcgatgtttaggcttcgtacggtggtccgccttatgttcaaagtgcttgcctttcttccgaaccggatggtttgctgcaaggaatcgacgatgacccatgtacacaaccttcctacagtacttaagatacgtactttctgtttcatccatacagtgagtgcaagccttgtaccccttgttggactgcccggataggttgctaagtgcaggccaatcgttgatggttacgaacagcagcgctcgtaggttaaactccttctgtttgtcctcatcccacacggggacaccttccttcttccacaacagtttaagatcttcgaccagtggtcttaggtacacatcgatgtcgttaccaggttgcttgggcccttgaattataatcggcatcattatgtacttcctcttcatgcatagccacggggggaggttgtagatacatatcgtaacgggccaagtgctgtggccgctgctcatctctccaaaaggattcatgccatccgtacttaaaccaaactgtatgtttcgtgcgtcctttccaaagtctttaaattttctatcgatgtttcgccactgcaaaccatcggcggggtgtctcagcatcccgtcctgttgacgctcttcagcgtgccaccgcatcattctagcgttccccttgttcctgaacaaacgccttagccgtgatattatagggaaataccacatcaccttagcaggaattctcttcttcgttagctgcccgtcaacttctcctggatcatctcgtctaatcttttatcgtagtgctttgcaaacagggcatgcttctaggttctcgtactcctcaccgcgatatagaatacaatcattcggacatgcgtgaatcttctgaactttcagtcctagagggcacactatcttcttagcctcgtacgttgtctcgggcaacttgtttccctccggaagaatgttcttaacgagtttcaataaatcgccaaatgccttgtcactaacaccattttttgccttccattgcaagaactccagagtggtatccaactttttgtgcccctgctcgcaacctgggtacaacgacgttctatggtcctctaacatcttgtccaatttatgggcccccttttcactttcgcaatcctccatggcgtcctgcaacatctgaccaagatcatccgcaatgttgttaccatcagcatccctttcctcctcgcccgtttgatttcattcaaatccagcgtactgagcaaagtccggaatattgtcgtcttccacttcatcttcttccatttcaacaccttgctctccgtgggatgtccaacaattatagcttggcatgaaccccgactcaaacaagtggaaatgaatagtcctgcatgcagaatactccttctgattcttacacttattgcatggacaacaaataaaacccttttgcatgttagcttcggccactctcaaaaaataatgcacgccgtcaataaactctttggaccaccggtcagcgtacatccattgccgatccatctacataacatgaaaaaaaatcgtacacacataattattcgtacaataatgacagtcatacaataattataaaataattacaaactctttcaacagtcacacaataatgacatatcattattcctacaaatattatgaaatattacaccgaataattatatatttactatttataaagttttaaactaatattaatgtgttgtacttattttaatttgtcattttactttgttttctattattcaagattaactttcactatattttccttctcaacttttttataaaaccttctttagcaaataaactaaatttctatatattctttattctccacacaaattttctctctcatcaaataacaacaaaattttggtcacaaaaatgtgtgcaaaacatagctccaaatgtaatatgaaaaaaaaaacattggaggatgaagttgctaaccttttaggcacctctgatttgtatataatcaccaaaataaatttactagaaattttggcatgacctcccctcttttttgaagaaattttgaagcttgctcgggctgaaggaggaagaagacatttatataggggtgagactttagtcccggttggtgttatgaaccggggctaaagatcgctgtgatctttagttacgatctttagtcccggttggtgttattaaccgggactaaagatcccgggggacctgacaggcccttacagcatttgaaccgggactaaagttacgatctttagtcccggttggtgtagatcaaatatgcccgttaccctttttaaccgggactaaagatgatctttagtcccggtttttgttgcaaccgggactattgtggaattagcccgaccgacgaaagatggtttctccaccagtggcagttgcactgccaagattgttacacctttgctgataatagccgaggacaatctcgtcggcatccatggcggccagcagctcgaaggagatagtggacgcggtggagaagtggatggcgttccccatctccaccgccgccggcttggagatcgttgccgaggagggctctagcggaagcagcgcccagcagcagcaggcttggcgtccggtggcggcggcgtggtgcgacaacggcggcacgtcggggacgggagcggcatgcaagtcgtcagtggacggcggcgcgcggcggcggccgcgcgtcgtaagactggctgccgcgtgggtgtcgctggaggtcaaggacgcgctgtccagcctgcagcagacgttcgtcgtctccgacgcgacgcgcccggactgccccatcatctacgccaccgaggggttcttcaccatgaccggctactccctcaagggagataaggcgcaagggcatttcggtccaaccacattaaaaaagggctcctgaaccgccacgtcagcatggcaagtttcatttagacggcacggtgctcatcgataaatatctatggttatgtagtgtctttcccccaaagctttgtttttcggtgtccctaggctaaaaccacacaactgcgatgccgcgtagaaaaatttgccttacttattatagtaagtacgaatatggtactgtatatgttatacatacatgaacgtgattaatttattcatataaatatatatctgatgcgtacattcatgtagtagtaagtatagtgtactagtaagggcgctgatcggggaagttgccgggcgggaaatagttgcagctgatgatgacaccgccgccgttgctgcaggcggcgcgcgcgcagccgatcgacgtcgtgctccgccacaccacctgcgtgtagtggccgcagtcgagcagcgcccccctcgtgcacgtgttgctgctgtacacgtagtccgccttctcctccatccacaagccgaccgcgtccgccgccgtcgacgcgctgccggcgccgcccatgtacaggttctcgccgtagcccagctgcacgctgttcgagtggtcgaggctgcaggtggcggcgagcaccgccacgtagctctccgcgaacgcctgcagcgtcgtgttccacaccacgtcggggaggccgacgccctcgccgcggcgggcgtcgttgtgggcgtcgacgaagtcctgcggcgagctctgcgccgccgccgtgctggccgccatggccagcgtcgccgccgccagcagcacgagtgcaaaggctttcgacgccattaattaacagagaagctcgatccagcagatgagtttctcaagctaattaattaatgtcttgtgctgagacttgttgcttgctgaggtatttatagcagttaaatcatgagagctatagctaagctcgattacgagagatcgaggttggaaagacactttagacttggtcctgcactgtcacgttgcttctagtagatgttaattacttccactaaatataattaagtggtcaattgtcgcaaactttccatgcatgtattcacactgtactttaatagtctttggcacacagctcagctgcatactttcttcatctgggcaggtagtgaatgcaacttgatgtttatttttctggcttatttatatatcctatagccaatagctcaacatgcattaaaccacataattttaaaaaaagagagccatatattggatcattcctatgcttaatccattttgtagctactattcatcactaattagtaaataacttagcattcagtgatttacttagctagcgtagaacgttattactgtaaagaagttacaccatcacttgacaacacattggatgacacttctatagttcatatcagcgtgtatatataatctttctcgtatgtacgtattgaaattttacaactgcattgcacacaccaatattccgtctgcactgcacggggtatcatctagtattctagtgtgtgtgcatatgtatccatatcacattatccgaaaatgtgtctttcaaagttgtgatggctcccaaccaatgatggatcataaccgggctacctcggccatagctcaaggcctaagtacaggctcatataaagctatgcacactacgccgaatcaggtcatctctgacggtattcaaaccgtcacctttgacgtgttttggtcctagtcagagattagtggtcgctgatgactttactcacatttgacggaggacgttcgtcagaggtaaccgtcaccatttttttccacaacactccacgaaccggttgagggcttaacccaaagctaggttcatcccttttctaactctaatgcaatacttaaagttacaacaacaatagtgggccctattcataacctggttgagaaatatcaatatacacacacacatagagtaaagatacccttaattagaaataaagcttcgagtaacactgacatagccgatgacaaggtggataccgtgacagatatggtttctagagaatatttttctttttcttatctaaagaattaaagaaatggtaaaaaggtagtttctttcaagattaaaattaaggatcataccataatatatgcccagctggaggcacaagatataacgttgagcatgcacagaggcaatattaatatttggcacgttgcaatgaactttccaatgattttccttggccttttcctctcgtgtagccgcatattaattacctaactcacgaagacgtacgtacggttctactactacgtgttatagtacgtacgtacagcatgcgagagacgttggaaagactttgactggtcttgtactgtcacacgtttacctctagtatagttttttgagtaaaatacagtagcggcccttaaacttgcgggcggatatcatctaggtccattaacttgtaaatcgtgtaattaggccactaaacttgctaaatgtaccatcgccggtccaaaatgtcatttgaccgtggtcgcgccgacgtggcatgccatgtgcacagctgagctggcccgcaccgtgccttttctcacgcgcaccgtgtgtgtcaccggccacacttgtttttttttcatcgaggcccctctgtttttctcattttctttcgtcatccactgctgcttcgtcttccccggagtgccctagcgcagagtgcagcggagatcgtgaggggggtgatcgccggagaaatagggttccaacggaagcgcaaagaggcgagatcgattggctgttgcggcctcccgccgaccataatcgcggggaggaggcatgattttccgcctggaaggggaagggcctccgttgtacagtgagtataacttcaaaatttcgttcgtccattaatctgcagggttagcatgcactgattgatgttggtagatagatacaaaggaataaggcgtttgttatgcaaaaaagatgttatttttccctgtaggatgattatcctgacattgttctcgagtaggctagaacatgagagtaatacagctaattaggattgcaatgcaggtcctgatgatggtaaattcaccgctgaggtacaccatggtggtttttttgttggtcaaagtagcaacagggcatatgtagatcaaacaataaattggattgaccactgtgaagcaggaacatgggatattgtttgtttggatgaatttttagctatgcttgggtatgatatgactccagattttaaggcttattggttgctccctggaaggactcttgaagatggccttagggttatatctactagggctgactttgaagtgatgaaatcagttgtgcacaaggttaagaattttattatctactttgatcagggtgacacaattgcaggtgtagattgggatgatgtagtagctaatccta
